（12） United States Patent
Achmüller et al.

(10) Patent No.: US 11,203,620 B2
(45) Date of Patent: Dec. 21, 2021

(54) CONSTITUTIVE YEAST LLP PROMOTOR-BASED EXPRESSION SYSTEMS

(71) Applicant: Sandoz AG, Basel (CH)

(72) Inventors: Clemens Achmüller, Kundl (AT); Ferdinand Zepeck, Kundl (AT); Franz Hartner, Kundl (AT); Thomas Specht, Kundl (AT)

(73) Assignee: Novartis AG, Basel (CH)

( * ) Notice: Subject to any disclaimer, the term of this patent is extended or adjusted under 35 U.S.C. 154(b) by 292 days.

(21) Appl. No.: 15/554,552

(22) PCT Filed: Mar. 2, 2016

(86) PCT No.: PCT/EP2016/054478
§ 371 (c)(1),
(2) Date: Aug. 30, 2017

(87) PCT Pub. No.: WO2016/139279
PCT Pub. Date: Sep. 9, 2016

(65) Prior Publication Data
US 2018/0079788 A1    Mar. 22, 2018

(51) Int. Cl.
*C07K 14/39*  (2006.01)
*C12N 15/81*  (2006.01)
*C07K 14/395* (2006.01)

(52) U.S. Cl.
CPC ............ *C07K 14/39* (2013.01); *C07K 14/395* (2013.01); *C12N 15/81* (2013.01)

(58) Field of Classification Search
CPC ..................................................... C07K 14/39
See application file for complete search history.

(56) References Cited

U.S. PATENT DOCUMENTS

2002/0155513 A1* 10/2002 Hsu .................. C12Q 1/6886
                                                          435/7.23
2014/0302557 A1* 10/2014 Jiang ................... C07K 14/39
                                                           435/69.1

FOREIGN PATENT DOCUMENTS

EP    2184294 A1 *  5/2010   ........... C07K 14/395
EP    2184294 A1    5/2010

OTHER PUBLICATIONS

Schultz et al., Mol. Cell. Biol., 7, 10. 3637-3645 (Year: 1987).*
Tzamarias et al. Distinct TPR motifs of Cyc8 are involved in recruiting the Cyc8-Tup1 corepressor complex to differentially regulated promoters. 1995 Genes & Development 9:821-831 (Year: 1995).*

Genbank Accession FR839628. 2011. Pichia pastoris CBS 7435 chromosome 1, complete replicon sequence (Year: 2011).*
Kebaara et al. Candida albicans Tup1 Is Involved in Farnesol-Mediated Inhibition of Filamentous-Growth Induction. 2008. Eukaryotic Cell, vol. 7, No. 6, p. 980-987 (Year: 2008).*
Shen et al. The mechanism by which overexpression of Gts1p induces flocculation in a FLO8-inactive strain of the yeast *Saccharomyces cerevisiae*. 2006. FEMS Yeast Res 6. 914-923 (Year: 2006).*
Aloys, Teunissen, et al., Transcriptional regulation of flocculation genes in *Saccharomyces cerevisiae*, Yeast, vol. 11, No. 5, pp. 435-446.
Altschul, et al., Nucleic Acids Res. (1997) 25:3389-3402.
Barrales, Ramon R., et al., et al., Indentification of novel activation mechanisms for FL011 regulation in *Saccharomyces cerevisiae*, Genetics, vol. 178, No. 1.
Braus, Gerhard, et al., Amino acid starvation and Gcn4p regulate adhesive growth and FL011 gene expression in *Saccharomyces cerevisiae*, Molecular Biology of the Cell, vol. 14, No. 10.
Database Geneseq NCBI, Pichia pastoris GS115 chromosome 1, Database accession No. FN392319.
Fleming, Alastair B., et al., The yeast Cyc8-Tup1 complex cooperates with Hdalp and Rpd3p histone deacetylases to robustly repress transcription of the subtelomeric FI01 gene, BBA—Gene Regulatory Mechanisms, vol. 1839, No. 11.
Fleming, Alastair, B., et al., Antagonistic remodeling by Swi-Snf and Tup1-Ssn6 of an extensive chromatin region forms the background for FL01 gene regulation, EMBO Journal, vol. 20, No. 18.
Hua, Shen, et al., The mechanism by which overexpression of Gtslp induces flocculation in a FL08-inactive strain of the yeast *Saccharomyces cerevisiae*, Fems Yeast Research, vol. 6, No. 6.
Kuberl, A., et al., High-quality genome sequence of Pichia pastoris CBS7435, J Biotechnol, vol. 154, issue 4, pp. 312-320 year 2011.
Lo, W-S, et al., FL011, A yeast gene related to the STA genes, encodes a novel cell surface flocculin, Journal of Bacteriology, vol. 178, No. 24.

(Continued)

*Primary Examiner* — Neil P Hammell
*Assistant Examiner* — Tiffany Nicole Grooms
(74) *Attorney, Agent, or Firm* — Luedeka Neely Group, P.C.

(57) ABSTRACT

The present invention provides a modified eukaryotic cell wherein the modified eukaryotic cell is not able to provide an SSN6-like protein that exerts its wildtype function and/or wildtype activity, the amount of SSN6-like protein being present in the modified eukaryotic cell differs from the amount of SSN6-like protein being present in its wildtype form, and/or essentially no SSN6-like protein is present in the modified cell. Additionally, the present invention provides a polynucleotide sequence comprising a modified ssn6-like gene, and a vector comprising said polynucleoptide. Additionally provided is an expression vector comprising a promoter that is repressed in the presence of SSN6-like protein, and a host cell comprising said vectors. The present invention further refers to a method for determining the purity of a composition by using the modified eukaryotic cell, to a method of expressing gene(s) of interest, and eukaryotic cells comprising modified ssn6-like gene.

16 Claims, 28 Drawing Sheets
Specification includes a Sequence Listing.

(56) References Cited

OTHER PUBLICATIONS

Rubintz, Jeffrey, et al., The Minimum Amount of Homology Required for Homologous Recombination in Mammalian Cells, 1984, Mol Cell Biol. 4: 2253-2258.

Search Report and Written Opinion for Singapore App. No. 11201707056U, dated Jul. 2, 2018, 12 pages.

Trumbly, et al., Cloning and characterization of the CYC8 gene mediating glucoserepression in yeast, Gene, vol. 73, No. 1.

Tzamarias, D. et al., Distinct TPR Motifs of CYC8 involved in recruiting the cyc8-tup1 corepressor complex to differentially regulated promoters, Genes and Development, vol. 9, No. 7.

Wasserman, Wyeth, et al., al., Applied bioinformatics for the identification of regulatory elements, Nature Reviews Genetics, vol. 5, No. 4.

Williams, Frederick E., et al., Characterization of TUP1, a mediator of glucose repression in *Saccharomyces cerevisiae*, Mol. Cel. Biol. 10(12), 1990, pp. 6500-6511.

Search Report and Written Opinion for PCT/EP2016/054478, dated Sep. 9, 2016, 24 pages.

\* cited by examiner

Fig. 1: Polynucleotide sequences

Fig. 1 A shows the nucleotide sequence of the coding region of the ssn6-like gene of P. Pastoris (SEQ ID. NO: 1).

```
ATGAACGAACCTTCACAGCCTCCGCCAGTGACACTGGAAGTGAGGCATGATCCCGTACCAACGTCTCAAGCTGACTCCCAGCAACGGAAAG
TGGTATATGATAAACAACTCGAGTTTCGCAAGATAGCTGTCTCCACTTGGCTAGCGCTCGGATCCATGGCTCACGAAGTCCACTTGTACCA
GCTGGCAATTGATTCGTTCGATTTTGCCCTCCAAAATGATCCATTCAACGAGAAGGCTCTTTGTGGACTCGCAGCTGCATTGAGGGCTATG
GATCTGGTCAAGGACCAAACAGACGGTACCGCAGCGGCCCTGGATGTTATCAACGACCTTTTATCACGCTCATCAGAGCTTTACAAAGATC
CATCTATCTGGAGAGAAGCTGCCGAATGCTATCTACTCTTAAACAACACAACGAATGCCATGGAGGCCCTACAAAGATGTATTCAATTAAC
TCCCAACAACTCTGCATTATGGTTACTTAAAGGACAAACATTGATGGCCGCAGGTTCCAAACATGAGGCCGTCGATGCACTGAACACAGCC
TTGGTGAAACTCCCCAATGACGTTGCAGACTATACAAAAGAAGAGATTGACGTGGCCCGTTCCACCCACTCAGAATTTGCCTCCGTTCTTG
CTGCGGAGGGCAACATCGAAGCTGCCAGGGATGAGTTGGAGGCCACTTTGGCTCTTCCGCCTCCCTCTTCTTCCCGCTTCACAGAGTATTC
CTCTCTTTGGTGCGCCCTCATTAGTGCTAATGAGCGCCTTGGAGATATGGCCAAGGCAGTGCGCGTCTGTGAGGAGGCATCTGGACTGTTA
GGATTCGAGCCATGCATATATATATGCCACGCATACTTGTTGCTACTACCGAACAGTCACGTATTTAACCCACAGTCTGCTTGTGTCCTGC
TTCGGCAAGTTGTTAATTCGGAAAGCAACGACTTTCTACCATGGTTTTTACTTGGTGAGGCTTATCAAATGCTGCGCCAACCAAGCGAGGC
CTACGAAGCATTCCAGTTGGCCTTGAAAAGGGCTCCAAACCACACAATTGTATGGCTTGCAGTGGGAAACCTTTATGCCGAACTGGGCCAG
CTGGCTGATGCCCTTAGCGCGTATATGTTTGTCATCAAACGTGAAACAGAACAAGAACAAGAGAGCAAGATTTTGCTCTCATTTGCTTGGG
AGGGTCTTTCATCGGTGTACGAAAAGTGTCATGGTCAGTTGGCTGACTCTATAGAGGCCTGTATGAAGTCAAGCAGCTATGCAAGCCAAGC
GGGTGATAGCTCTCGGGCAAATTTCTTGAACTCGCGATTGGAAACTTTACGAAGAGTGGTATCTGGAGAGATTCCGCTTTCTGATTACAGA
CCAAGCACATGTTGTCAATCTCCGTTATATTTACTGCGAGATCTTACTTCACTGAGTATATCTGAAAGAGAAAATTTGGCCAATGCTTCGT
TAGATGACATCGCATCCGCTCCAGAAATCAAGAGTAGCAGCAAGAAGCGAACTGACACTTCGAGACCAATGCCTCCCTACCCGTCTCACTC
CGCAAATAACTATAACCTACCATCCGAAGATTCACAGCCACAGCGACAGAACTTACCAGTTCACTCACTCCCTAACGTTCCATTAGCACAG
CAACAGCGTGTGCATGCTCCGGCAAACAAGAACTTGTCCCCAAGCGCCGATCAGAGATTCTCAATTGCAACCCATCCTCCTGTTGCCCCCC
CCACAAATTTCCCCTCGTCCTGCTTCACCACAGTTACAACAACAACAGCAACAACAGCAGCAACAGTTTCAACCACAAAACTATCAGCACT
ATGCGCCTTCACCAATGTACCCACCTTCCCAACAATCCCCATTCCCTGA
```

Fig. 1 B shows the nucleotide sequence of the LLP promoter of P. Pastoris, 605 bp 3' from the ATG start codon of LLP (SEQ ID NO: 2)

```
ACAAAATGGCCAAGCTGGGAAACGGGATTTGGTGGAACTTTATTATTCTTTCTACGATCCAAGCATTATGTTGTGGAACAAAGCGAATACT
CTTATTAGCTGGTAATTGAGCGAGTTGAAAAAATCAAGTCTATTGGAGGGTATGGTCAGAGTACTGATAGAGATCCCTGTTAAGATAATCG
ATCTTTTTCAAATATCCAATTTCATTCCATCTTGCCATCGGGTCTTGGCTTCTTACATCAATAATTAAAACTACTTACTCTATTAGTGCCA
AAAATGGTAAACCGTATTCAAATTGCTGCAAGCATATGCTTAAAAGGATCGCGTTGCGAGCTTCTTTTGAGATTCGCAAGCTTGATTTTAT
GCTCTTGTGGGAAGAAAAGCAACCCACTGAATTCCAGATTTGTTGTGTTTTCATGCATGGACGACATACTTTGAGTAATACCGTTACTGAG
ATTTTACCGAATTCGCATTGCGTTGAGGCGTGAAGTTTCTTAATGCTGTGCCATATGGTTAAGTTGCGTTTCAAGATGGTCCACAAGTATT
TTTGTATTTAAGCAGTGTCAATTCAAGCCTAACTGCTCATAAAAACTACACGGTTTGCT
```

Fig. 1 C shows the nucleotide sequence of the signal sequence of the LLP protein of P. Pastoris (SEQ ID NO: 3). Nucleotide at position 45, is underlined.

```
ATGTTTGAGAAGAGTAAATTTGTGGTTTCGTTTCTGCTTTTACTGCAGCTATTTTGTGTCCTTGGTGTACATGGA
```

Fig. 1 D shows the nucleotide sequence of the terminator sequence of llp gene of P. Pastoris (SEQ ID NO: 4).

```
ACGGTCTTGGAGTCATCAGGCTCTGACTGGGCAGCTGCTGCAACTGGAACTTCCCAAGCCTCCCACCAAACAGCAGGTGTAGCCGAAAGTA
TTCACGTGTCCCAGAATGAGGCCCACAGTACATCTGTCACCGTTTCTCAACCCCCTTCAACGGTTTCTTTGCAAATTGGAGAAGCAAATAC
CCTGAAATGGTCAGCTTTCTTTGGAGTAGTAGTTCCGCTGCTCAACGTACTCTTCGTTTAAAAGCCCT
```

Fig. 1 E shows the nucleotide sequence of the SSN6-like promoter of P. Pastoris, 1000 bp 3' from the ATG start codon of SSN6-like (SEQ ID NO: 5).

```
GGAATGGAAGGGTGCAGCCTCTCATTTCTGTTGTGCCCTTTCAAGGCGTGTTTACCATTTTCGGCTGATGGGAGTGGACTAAAAGGAAATT
ACCCTATTGACACAATCCGACTTTCGTGGATCTTGTTTTAGTAAACCCATTTTTGGGTTGCTTTTGAACAAAAAAAAAGCACAAGTCTGCA
TATTACTAAGAATTACCATGGTAACATATTGCACTTGCATGCGCAGAATGCATTAACAACAAGCAGCTCAGAAAGGCTGAAATTGAGGATA
CGCGCTTCATTAAAAAATGCTGCGTTTGAAAATGTGTGCAACAACTTTGCATCAGCACAGAAAACACGACGCAGTAGTCCTAGTAGGGTGA
TATTTGGCCGCCATCTTGCTCTGGAGTGTCGAGTTAATTATTTTGCCCCTTGATTTCAAAACGTTACTTTGTTTCCTTTTTTTCTAGTTCA
CCTTTTGTACGGGTTAGTAACTTTGCATATCTGATTGTTACAAAAGTGGATGGCAATGCAAGCTGGATGCGCATGAACAGTGTTCCAGGCA
CTAATTTTAACGTGATGTGTCTCTTCTCGAAGATGCATTATTTTATACACAGCATCTTGGTTGCATTACATTATGTATGCACCTATCATGT
ATATATGTACGCCCGTAAGTAATCGTAGGTCTAATAAGCAAACGTATGCAGAGGTTGTAAATTTTTGAAACGCTCAGTCGGAGCATCATTT
CCAAGGCTAAGTTGTGTTCTTCTTCTTCTTTCCTCCCTACACTCCCAAAAATTCCTTGCCACTTCAGATTTCTTTTGTGAAAACTTTCAAT
ACTCAGAACACTCCCCTCCAGACTATAGAGTTCCACTCTCCCCCTCCTCTATTCAATTTCAACTCTCTTGTTGTCAAGAGATCCAGTGTTA
GATTGTTGCCACAAGGAAAGAGAAACAAGGAAACATTCCATTTCATCCATTCTCGTATCAACTGGCACCCCACGATATTTACCACTACTT
```

Fig. 1 F shows the nucleotide sequence of the terminator sequence of ssn6-like gene of P. Pastoris (SEQ ID NO: 6).

```
ACACCAGAAAAGTTTGACTTCTTTCAATCAAATGCCGCCTATTCCTCCACCACCTCCTCCTCCTCAACATCAGCAACACCCTCAGCAGATG
CACATTGTACAGCAACAACATGAACAGCAGCATCATCAGCAGCAGCATCTGCACCCGCAACATTTGATGCCTCTCCCTCCGTTACATCAAG
GCCCACCTATTCCTAAGATAGAGTCTCCTTCATATCGGAATCAACAGTCATTCATGGTTGGGGTGCCCTATTCGGGGGTCGGTCCTGATGG
AAGACCAATATACGAACCGTCTCAATTCTATGGGTCACATCCTCCGGCACGCTTTGTGGTTAACGAATAGATATTATAATATGCTTATTTA
GTGATCATAGCAACGAATATATAATCATAACAGCCCAACTAAACGTTCAACGAGCGTTTCCACATCCTGTGCAGCCTCTTGGGCGTGCAAC
AGCACTTCTTCATGGCTGGCATGGCCTTTGCTGTCAGGTGTTTGA
```

Fig. 1 G shows the nucleotide sequence of the ssn6-like modified DNA of P. Pastoris (SEQ ID NO: 7).

```
ATGAACGAACCTTCACAGCCTCCGCCAGTGACACTGGAAGTGAGGCATGATCCCGTACCAACGTCTCAAGCTGACTCCCAGCAACGGAAAG
TGGTATATGATAAACAACTCGAGTTTCGCAAGATAGCTGTCTCCACTTGGCTAGCGCTCGGATCCATGGCTCACGAAGTCCACTTGTACCA
GCTGGCAATTGATTCGTTCGATTTTGCCCTCCAAAATGATCCATTCAACGAGAAGGCTCTTTGTGGACTCGCAGCTGCATTGAGGGCTATG
GATCTGGTCAAGGACCAAACAGACGGTACCGCAGCGGCCCTGGATGTTATCAACGACCTTTTATCACGCTCATCAGAGCTTTACAAAGATC
CATCTATCTGGAGAGAAGCTGCCGAATGCTATCTACTCTTAAACAACACAACGAATGCCATGGAGGCCCTACAAAGATGTATTCAATTAAC
TCCCAACAACTCTGCATTATGGTTACTTAAAGGACAAACATTGATGGCCGCAGGTTCCAAACATGAGGCCGTCGATGCACTGAACACAGCC
TTGGTGAAACTCCCCAATGACGTTGCAGACTATACAAAAGAAGAGATTGACGTGGCCCGTTCCACCCACTCAGAATTTGCCTCCGTTCTTG
CTGCGGAGGGCAACATCGAAGCTGCCAGGGATGAGTTGGAGGCCACTTTGGCTCTTCCGCCTCCCTCTTCTTCCCGCTTCACAGAGTATTC
CTCTCTTTGGTGCGCCCTCATTAGTGCTAATGAGCGCCTTGGAGATATGGCCAAGGCAGTGCGCGTCTGTGAGGAGGCATCTGGACTGTTA
GGATTCGAGCCATGCATATATATGCCACGCATACTTGTTGCTACTACCGAACAGTCACGTATTTAACCCACAGTCTGCTTGTGTCCTGC
TTCGGCAAGTTGTTAATTCGGAAAGCAACGACTTTCTACCATGGTTTTTACTTGGTGAGGCTTATCAAATGCTGCGCCAACCAAGCGAGGC
CTACGAAGCATTCCAGTTGGCCTTGAAAAGGGCTCCAAACCACACAATTGTATGGCTTGCAGTGGGAAACCTTTATGCCGAACTGGGCCAG
CTGGCTGATGAGTGGTACCTGCAGCTAAGGTAA
```

Fig. 1 H shows the nucleotide sequence of the Kozak start sequence (SEQ ID NO: 11).

```
GATATCAAAACGATG
```

Fig. 1 I shows the nucleotide sequence of the LLP promoter of P. Pastoris, 1000 bp 3' from the ATG start codon of LLP (SEQ ID NO: 12). The underlined sequence part is identical to SEQ ID NO: 2, Fig. 1 B.

```
AGATAGATAACTACAATTTATGAGGCCCTATCGTGAAATAGCAACGTAGAATAATTTCCTGGCAGAGTAGGGTGTGGGGTCAGTAGAAGTA
ATATCCAGAAGCTGATGCAGGTTATTGATATTACCACAAGATTCTAGCTTCAAATGCACAGTTCGGATTGGTGATCCGAAGATGCTAAAAA
AAAGACATCAAACTCCAAACCGTATCGCTTTTTACGGCGTATATTGTTGCACGAAAGCGAACTATAATCATGCAGAAAACATGCGGACATG
ACGTAATGTATGCGTTTAGGGAAAGGTACTGCGTATTTCAAACGCATACTTAGATCGTGCCCAGCAACCCACATAATTTTTTCTTCAAGGT
CTGGACATACTGGTTGTGTCAAAATAGGGCAACAAAATGGCCAAGCTGGGAAACGGGATTTGGTGGAACTTTATTATTCTTTCTACGATCC
AAGCATTATGTTGTGGAACAAAGCGAATACTCTTATTAGCTGGTAATTGAGCGAGTTGAAAAAATCAAGTCTATTGGAGGGTATGGTCAGA
GTACTGATAGAGATCCCTGTTAAGATAATCGATCTTTTTCAAATATCCAATTTCATTCCATCTTGCCATCGGGTCTTGGCTTCTTACATCA
ATAATTAAAACTACTTACTCTATTAGTGCCAAAAATGGTAAACCGTATTCAAATTGCTGCAAGCATATGCTTAAAAGGATCGCGTTGCGAG
CTTCTTTTGAGATTCGCAAGCTTGATTTTATGCTCTTGTGGGAAGAAAAGCAACCCACTGAATTCCAGATTTGTTGTGTTTTCATGCATGG
ACGACATACTTTGAGTAATACCGTTACTGAGATTTTACCGAATTCGCATTGCGTTGAGGCGTGAAGTTTCTTAATGCTGTGCCATATGGTT
AAGTTGCGTTTCAAGATGGTCCACAAGTATTTTTGTATTTAAGCAGTGTCAATTCAAGCCTAACTGCTCATAAAAACTACACGGTTTGCT
```

Fig. 1 J shows the amino acid sequence of the SSN6-like protein of P. Pastoris (SEQ ID NO: 13).

```
MNEPSQPPPVTLEVRHDPVPTSQADSQQRKVVYDKQLEFRKIAVSTWLALGSMAHEVHLYQLAIDSFDFALQNDPFNEKALCGLAAALRAM
DLVKDQTDGTAAALDVINDLLSRSSELYKDPSIWREAAECYLLLNNTTNAMEALQRCIQLTPNNSALWLLKGQTLMAAGSKHEAVDALNTA
LVKLPNDVADYTKEEIDVARSTHSEFASVLAAEGNIEAARDELEATLALPPPSSSRFTEYSSLWCALISANERLGDMAKAVRVCEEASGLL
GFEPCIYICHAYLLLLPNSHVFNPQSACVLLRQVVNSESNDFLPWFLLGEAYQMLRQPSEAYEAFQLALKRAPNHTIVWLAVGNLYAELGQ
LADALSAYMFVIKRETEQEQESKILLSFAWEGLSSVYEKCHGQLADSIEACMKSSSYASQAGDSSRANFLNSRLETLRRVVSGEIPLSDYR
PSTCCQSPLYLLRDLTSLSISERENLANASLDDIASAPEIKSSSKKRTDTSRPMPPYPSHSANNYNLPSEDSQPQRQNLPVHSLPNVPLAQ
QQRVHAPANKNLSPSADQRFSIATHPPVAPPTNFPSSCFTTVTTTTATTAATVSTTKLSALCAFTNVPTFPTIPIP
```

Fig. 1 K shows the nucleotide sequence of the MFalpha pre-pro signal sequence without (A) and with the EAEA repeat (B) as used in the examples of this application.

(A): SEQ ID NO: 14

```
ATGCGTTTCCCATCGATTTTCACAGCTGTTCTGTTTGCAGCTTCATCTGCTTTAGCTGCACCTGTTAACACAACTACAGAGGACGAAACGG
CCCAGATCCCAGCTGAGGCAGTCATTGGTTATTCCGATTTGGAAGGTGATTTCGATGTCGCTGTGTTACCATTCAGTAATTCCACAAATAA
CGGTTTGCTGTTCATTAACACCACTATAGCAAGCATCGCTGCAAAAGAGGAAGGTGTTTCCCTAGAAAAGAGG
```

(B): SEQ ID NO: 21

```
ATGAGATTCCCATCTATTTTCACCGCTGTCTTGTTCGCTGCCTCCTCTGCATTGGCTGCCCCTGTTAACACTACCACTGAAGACGAGACTG
CTCAAATTCCAGCTGAAGCAGTTATCGGTTACTCTGACCTTGAGGGTGATTCGACGTCGCTGTTTTGCCTTTCTCTAACTCCACTAACAA
CGGTTTGTTGTTCATTAACACCACTATCGCTTCCATTGCTGCTAAGGAAGAGGGTGTCTCTCTCGAGAAGAGAGAGGCCGAAGCT
```

Fig. 1 L shows the codon optimized DNA sequence of encoding a single chain antibody fragment DLX521 (SEQ ID NO: 15).

```
GCCCAGTCCGTTTTGACTCAACCCCCTTCCGTATCCGCAGCTCCAGGCCAAAAAGTAACGATCTCTTGTTCAGGTTCCACTAGTAACATAG
GTGACAATTATGTGTCATGGTACCAACAGTTGCCCGGAACTGCCCCTCAACTGCTGATCTACGACAATACCAAGAGGCCGTCAGGTATCCC
AGACAGATTTTCCGGTTCTAAGAGCGGCACATCGGCTACACTAGGTATCACGGGACTTCAAACCGGCGACGAGGCAGATTACTACTGCGCA
ACTTGGGATAATGATAAGTGGGGAGTTGTTTTTGGAGGTGGTACTAAACTCGAAGTCTTGGGTGGTGGAGGAGGATCAGGAGGAGGAGGTT
CTGGAGGAGGTGGTTCATCTGGCGGTGGATCTGAAGTGCAGCTTGTGGAGAGTGGTGGTGGTTTGGTTCAACCAGGAGGTAGCTTGAGACT
GTCATGTGCCGCCAGCGGTTTTACTTTCTCCTCCTATGCAATGTCTTGGGTCAGACAAGCACCTGGTAAGGGTTTGGAATGGGTATCAGCT
ATTTCGGGTAGTGGTGGTTCGACATATTATGCTGACTCCGTTAAAGGTCGTTTTACTATTTCTAGAGACAATTCCAAAAATACCTTATATC
TTCAAATGAACTCCCTTAGAGCTGAGGATACTGCTGTTTACTACTGTGCTCGTGATGCTTGGTTGGATGTGTTGTCTGACGGCTTTGACTA
CTGGGGACAAGGTACTTTGGTCACAGTGAGCAGCTGA
```

Fig. 1 M shows the coding region of the Ilp-gene including the signal sequence of P. Pastoris (SEQ ID NO: 16)

```
ATGTTTGAGAAGAGTAAATTTGTGGTTTCGTTTCTGCTTTTACTGCAGCTATTTTGTGTCCTTGGTGTACATGGACAAGAAAGTGGTAACG
GTACCACTAGTGACACTGCCTACGCATGCGACATCGGTGCAACACCTTTTGACGGATTCAATGCTACTATTTATCAGTACCAGGCAAGTGA
TGACAATTCAATACAGGACCCGGTTTTTATGAGCACTGGGTACTTGCAACGTAACCAGTTGCATAGTACAACTGGAGTGACTAATCCGGGG
TTCAACATCTTCACTGCAGGCGTTGCCACCACAACACTTTATGGGATACCAAACGTCAACTACCAAAATATGCTTTTAGAATTGAAAGGCT
ATTTCAGAGCTGACGCCTCTGGAAATTATGGACTATCACTAAGGAACATCGATGATAGTGCGATTCTTTTCTTTGGGAGGGAGACTGCGTT
TGAATGTTGCAATGAAAATTTGATTCCCTTGGACGAAGCCCCAACTGATTACTCACTTTTTACCATTAAAGAAGGGGAAGCTTCAACAAAC
CCCGACTCTTATACGTACACTCAATACTTGGAGGCTGGGAGATACTATCCCGTAAGAACTTTCTTTGCCAACATAAGAACGCGTGCCGTGT
TCAACTTTACGATGACACTGCCAGACGGGAGTGAACTAACAGATTTTCAAAACTACATTTTTCAATTTGGAGCTCTTAACCAACAACAATG
CCAAGCAGAAATAGTTACCAGGGAAAATTACACAACCACCACCGAACCATGGACTGGTACCTTTGAAGCCACGACCACGGTGATTCCAAGT
GGCACTGAGCCAGGTACCGTGATTGTCCAGACTCCTTATTCTACTATCGACTCCACATCTACTTGGACCGGTACTTTCACCACTTTCACCA
CCGATGCTGATGGAAGCACCATCGCCGTTGTGCCATCGTCGACTATTGATGATCACTTTGCGTCGACTGAAACTGTTTTGACAGACACTGC
TATTTCAACTACTGTTATTACCGTGACCAGTTGTGGTACCAGTAAGTGTACCAAGACTACAGCACTAACAGGGGTGACTCAGCGAACTCTC
ACAATCGATGATAGAACTACTGTCGTGACGACTTACTGTCCTTTGCCAACTGACGTTGCCACTATAAAAACAGCAAGTGTTAGCGGAAGTG
AGGTTGTGCAAACAATCTACACTGCGAAACACAGCCAGGCCGTTTCTTATGTTCATCCATCAACTGTTACAATCACAAGAGAGGTATGTGA
TGCCCAAACTTGCACGCAGGCTACTATTGTGACTGGAGAAATTCTGCAAACTACTGTTGTGGACTCTGGTTCTACAACTGTTGTTCCAAAG
TATGTTCCGGTGGAGACGCATGAACCAACATTTGAATTGAGTACTCTTTAA
```

Fig. 1 N shows the codon-optimized nucleotide sequence of the human Growth Hormone (hGH) as used in the examples of this application (SEQ ID NO: 17).

```
TTTCCAACCATCCCGCTGTCCAGATTGTTTGACAATGCCATGTTGAGAGCCCATCGTTTGCATCAGCTCGCATTTGATACGTACCAGGAAT
TTGAGGAGGCTTACATTCCAAAAGAGCAAAAGTATAGCTTTCTACAGAATCCTCAGACTTCGCTGTGTTTCTCTGAATCTATCCCTACACC
CAGTAATAGAGAAGAGACTCAACAAAAGTCTAACTTGGAATTGTTGAGAATATCACTGCTGTTGATTCAATCTTGGCTTGAACCTGTGCAA
TTCTTGAGATCTGTCTTTGCTAATTCACTTGTGTATGGAGCTTCCGACTCAAATGTATACGACCTCTTAAAAGACCTTGAAGAGGGCATCC
AAACTTTGATGGGACGACTTGAAGATGGATCCCCCAGGACCGGTCAAATCTTCAAGCAAACTTACAGCAAGTTCGACACAAACTCCCACAA
TGATGATGCCTTATTGAAAAACTACGGATTGCTATATTGTTTTCGTAAAGATATGGACAAAGTAGAGACTTTTCTGAGAATTGTTCAATGT
AGAAGTGTTGAGGGTTCATGCGGTTTCTAA
```

Fig. 1 O shows the codon optimized nucleotide sequence of the human serum albumin (HSA) incl. the HSA signal sequence as used in the examples of this application (SEQ ID NO: 18).

```
ATGAAATGGGTGACTTTTATCTCCCTACTGTTCCTTTTCTCCTCCGCATACTCAAGAGGTGTTTTTAGAAGAGATGCCCATAAGAGTGAGG
TTGCACACAGATTTAAGGATTTGGGAGAAGAGAATTTCAAGGCTCTGGTGTTGATAGCTTTCGCTCAATACTTACAACAGTGTCCATTTGA
AGATCATGTCAAATTGGTCAATGAAGTAACGGAGTTCGCTAAAACATGCGTCGCTGACGAATCAGCTGAAAATTGTGATAAGTCGTTACAT
ACCTTGTTCGGTGACAAATTGTGCACGGTTGCAACATTGCGAGAAACATATGGCGAAATGGCAGATTGTTGCGCTAAGCAAGAGCCTGAAA
GGAACGAGTGTTTCTTACAGCATAAGGATGATAATCCAAACCTACCTAGATTGGTCAGACCAGAAGTTGACGTTATGTGTACCGCTTTTCA
CGATAACGAAGAGACATTCTTGAAAAAGTACCTGTACGAAATCGCAAGACGTCATCCATACTTCTATGCCCCAGAGCTGTTGTTTTTCGCA
```

Fig. 1 O (continued)

```
AAAAGATATAAGGCCGCATTTACTGAATGCTGTCAAGCTGCTGATAAGGCTGCTTGCCTTCTCCCTAAACTGGATGAGTTGCGTGATGAAG
GAAAAGCAAGTTCGGCCAAGCAAAGACTGAAGTGTGCTAGCTTACAAAAGTTTGGTGAACGTGCGTTCAAGGCTTGGGCTGTGGCAAGATT
ATCTCAAAGATTTCCTAAGGCAGAATTCGCCGAAGTGTCGAAACTTGTAACCGACCTTACTAAAGTGCACACCGAGTGCTGTCATGGAGAT
CTACTCGAATGCGCAGACGACAGAGCTGACCTGGCTAAGTACATTTGTGAGAACCAAGATAGCATTTCTTCCAAATTGAAGGAATGTTGTG
AAAAACCCTTGCTTGAGAAATCTCACTGTATCGCTGAAGTTGAAAATGACGAGATGCCCGCCGACCTTCCAAGTTTAGCAGCTGACTTTGT
TGAATCTAAAGACGTGTGTAAAAACTATGCAGAGGCTAAGGACGTCTTTTTGGGTATGTTTCTGTACGAGTATGCTCGTAGACATCCAGAT
TACTCCGTTGTTCTGCTGTTGAGGCTTGCCAAGACTTACGAGACAACTTTGGAGAAATGTTGTGCCGCAGCAGACCCTCACGAGTGTTATG
CAAAAGTGTTTGATGAATTCAAGCCATTGGTTGAGGAACCACAGAATCTGATTAAACAAAACTGTGAATTGTTTGAACAACTAGGTGAGTA
TAAGTTCCAGAACGCTCTGCTGGTTCGTTATACTAAAAAGGTTCCTCAGGTTTCAACTCCTACATTGGTAGAGGTCAGCAGAAATTTGGGA
AAGGTTGGTTCAAAATGTTGTAAACATCCCGAGGCTAAAAGGATGCCGTGTGCTGAGGATTACTTGTCTGTCGTATTGAATCAGTTATGTG
TGTTACACGAAAAGACACCAGTCTCTGATCGTGTGACGAAATGCTGCACAGAGTCACTCGTTAATCGTAGACCTTGTTTCTCCGCTTTGGA
GGTGGACGAGACTTACGTACCTAAAGAGTTCAATGCTGAAACTTTTACTTTTCACGCTGACATTTGTACTCTTTCCGAAAAAGAGAGGCAA
ATCAAAAAGCAAACTGCTTTGGTTGAATTAGTTAAGCATAAGCCAAAAGCTACTAAGGAGCAACTTAAAGCAGTAATGGACGATTTCGCTG
CATTCGTTGAAAAGTGCTGTAAAGCCGACGATAAAGAGACATGTTTTGCAGAGGAAGGTAAAAAGTTGGTCGCTGCCTCCCAGGCCGCACT
AGGTTTGTAA
```

Fig. 1 P shows the codon-optimized nucleotide sequence of the penicillin V amidase (PVA) as used in the examples of this application (SEQ ID NO: 19).

```
GCTAGAACTACCGAGCCAATCATTGACTTAGGATACGCTAGATACAGAGGTTCAATCAACGACACTACCTCTGTCACTTCATACCTGGGTA
TCAGATTTGCTGAACCTCCAGTTGAGGACTTGAGATGGAGAGCCCCACAACCTGCTAAGAGACTTCCTGGTGTTCAAAACGCCACTATTGT
TCCTCCATTGTGTCCACAAGGTTTCATCAACATCTTGATTCCAGGAGGTATTCCACCTCCAGACTTGACCAACGTTTCTGAAGACTGCTTG
TTCTTGTCCGTTTTTGCACCTAGAAAGTTGCCACCTAAGCGTAAGGAATTGCCAGTGATTGTTTGGATTCATGGTGGAGGATACATCGTCT
CCTCTGCAGCTACTTTCGACGGAACTAACTTGGTTAGAGAGTCTAACGACTCTGTCATTGTGGTGACTATCCAGTACAGACTGGGAATTTT
CGGATTCATGGCTGGTAAGAAGTTGAAGGATAACGGAGACTTGAATGCTGGATTGCTTGACCAAGAGTTGGCTTTGAAGTGGGTTCAACAG
CACATTAACAAGTTCGGTGGTGACCCTAAGCAAGTGACCATTTGGGGTCAATCAGCTGGAGGTGGTTCTGTGTTGCAACAGGTCATTGCTC
ACAACGGACAAACTAACCCACCATTGTTCAGAGCTGCTATGTCTTCCTCTACCTACCTTCCTTCTCAACACCATTTCGACGATCCTGTTCC
AGAAGGTATCTACTCTACCGTTGTCTCAACTGCTGGTTGTGCTGATGCTACTGATCCTCTTACTTGCTTGAGAGCTTCTAACACCTCCATC
TTACAAGCTGCTAACGACAAGGCATGTAGATCCGCATTCTACGGTACTTCCGTTGTTGTTCCTGTTGTTGATGGTGAGTTCATCACCCAAA
GACCATCTGAAGCTCTTAGACAAAGACGTGTCAACGGTAACGCTTTGTTGGCTATCTCTAATACCAACGAAGGTGACATCTTCGTTGACCA
ATCTAAGGCTGACACTGTTACTGCTGCTCAGTTCGTTAGAGACTTGTACCCTAGATTGAACGGTGCTCAAGTTGCTGAGGTTGTTCGTCTG
TACTCTGGTTTAGGTGCTCCAATCCAACAGGCTGACTCTATCATGGGAGATACTCTGTTCCAATGTCCAACCATTTGGTTCTCTCAAGCCT
TCAGACAATCTTTCAAGGGTGAATACGCTGTTCTTCCTGCATTCCACGGTTCTGACATTTCCCAGTACTTCCCATCTTTTGCTCCTAGATT
CTTCGACGATCCTGCTTTCACTTCCTCTTTCACTCAGTCCTTCTTGGACTTCGCTTTGTCTCGTAACTCTGATCCTAACGCAAAGTTTGAC
GACGGTAACTTGACTCCTAGATGGAACAGATACACCTCTTGCTCAAAGTTCGAGATGGTGTTCAACCGTACTGATGGTGAAGAGTTGGACA
TTAGACCAGCTTCTACTGGTGCTGGTTTGTTGGAGAGATGTGCATTCTGGGAATCTGTCTCCGAATTGACTGCTCAATAA
```

Fig. 1 Q shows the nucleotide sequence (SEQ ID NO: 20) of the vector pGAPk used for generating the SSS1 yeast cell line (plasmid without a GOI and with a Geneticin resistance marker). The hybridization site of the primer oligo2398 is labeled in grey and underlined, and of oligo2395 is labeled in grey and double-underlined (reverse-complement sequence)

```
AGATCCAATTCCCGCTTTGACTGCCTGAAATCTCCATCGCCTACAATGATGACATTTGGATTTGGTTGACTCATGTTGGTATTGTGAAATA
GACGCAGATCGGGAACACTGAAAAATACACAGTTATTATTCAGATCTTTTTTGTAGAAATGTCTTGGTGTCCTCGTCCAATCAGGTAGCCA
TCTCTGAAATATCTGGCTCCGTTGCAACTCCGAACGACCTGCTGGCAACGTAAAATTCTCCGGGGTAAAACTTAAATGTGGAGTAATGAA
CCAGAAACGTCTCTTCCCTTCTCTCTCCTTCCACCGCCCGTTACCGTCCCTAGGAAATTTTACTCTGCTGGAGAGCTTCTTCTACGGCCCC
CTTGCAGCAATGCTCTTCCCAGCATTACGTTGCGGGTAAAACGGAGGTCGTGTACCCGACCTAGCAGCCCAGGGATGGAAAAGTCCCGGCC
GTCGCTGGCAATAATAGCGGGCGGACGCATGTCATGAGATTATTGGAAACCACCAGAATCGAATATAAAAGGCGAACACCTTTCCCAATTT
TGGTTTCTCCTGACCCAAAGACTTTAAATTTAATTTATTTGTCCCTATTTCAATCAATTGAACAACTATCAAAACACAGAATTCACTAGTG
GCGCGCCGCGGCCGCTCAAGAGGATGTCAGAATGCCATTTGCCTGAGAGATGCAGGCTTCATTTTTGATACTTTTTATTTGTAACCTATA
TAGTATAGGATTTTTTTTGTCATTTTGTTTCTTCTCGTACGAGCTTGCTCCTGATCAGCCTATCTCGCAGCAGATGAATATCTTGTGGTAG
GGGTTTGGGAAAATCATTCGAGTTTGATGTTTTTCTTGGTATTTCCCACTCCTCTTCAGAGTACAGAAGATTAAGTGAGACCTTCGTTTGT
GCGGATCCTTCAGTAATGTCTTGTTTCTTTTGTTGCAGTGGTGAGCCATTTTGACTTCGTGAAAGTTTCTTTAGAATAGTTGTTTCCAGAG
GCCAAACATTCCACCCGTAGTAAAGTGCAAGCGTAGGAAGACCAAGACTGGCATAAATCAGGTATAAGTGTCGAGCACTGGCAGGTGATCT
TCTGAAAGTTTCTACTAGCAGATAAGATCCAGTAGTCATGCATATGGCAACAATGTACCGTGTGGATCTAAGAACGCGTCCTACTAACCTT
CGCATTCGTTGGTCCAGTTTGTTGTTATCGATCAACGTGACAAGGTTGTCGATTCCGCGTAAGCATGCATACCCAAGGACGCCTGTTGCAA
TTCCAAGTGAGCCAGTTCCAACAATCTTTGTAATATTAGAGCACTTCATTGTGTTGCGCTTGAAAGTAAAATGCGAACAAATTAAGAGATA
ATCTCGAAACCGCGACTTCAAACGCCAATATGATGTGCGGCACACAATAAGCGTTCATATCCGCTGGGTGACTTTCTCGCTTTAAAAAATT
```

Fig. 1Q (continued)

```
ATCCGAAAAAATTTTCTAGAGTGTTGACACTTTATACTTCCGGCTCGTATAATACGACAAGGTGTAAGGAGGACTAAACCATGGGTAAGGA
AAAGACTCACGTTTCGAGGCCGCGATTAAATTCCAACATGGATGCTGATTTATATGGGTATAAATGGGCTCGCGATAATGTCGGGCAATCA
GGTGCGACAATCTATCGATTGTATGGGAAGCCCGATGCGCCAGAGTTGTTTCTGAAACATGGCAAAGGTAGCGTTGCCAATGATGTTACAG
ATGAGATGGTCAGACTAAACTGGCTGACGGAATTTATGCCTCTTCCGACCATCAAGCATTTTATCCGTACTCCTGATGATGCATGGTTACT
CACCACTGCGATCCCCGGCAAAACAGCATTCCAGGTATTAGAAGAATATCCTGATTCAGGTGAAAATATTGTTGATGCGCTGGCAGTGTTC
CTGCGCCGGTTGCATTCGATTCCTGTTTGTAATTGTCCTTTTAACAGCGATCGCGTATTTCGTCTCGCTCAGGCGCAATCACGAATGAATA
ACGGTTTGGTTGATGCGAGTGATTTTGATGACGAGCGTAATGGCTGGCCTGTTGAACAAGTCTGGAAAGAAATGCATAAGCTTTTGCCATT
CTCACCGGATTCAGTCGTCACTCATGGTGATTTCTCACTTGATAACCTTATTTTTGACGAGGGGAAATTAATAGGTTGTATTGATGTTGGA
CGAGTCGGAATCGCAGACCGATACCAGGATCTTGCCATCCTATGGAACTGCCTCGGTGAGTTTTCTCCTTCATTACAGAAACGGCTTTTTC
AAAAATATGGTATTGATAATCCTGATATGAATAAATTGCAGTTTCATTTGATGCTCGATGAGTTTTTCTAACCTCTAGGACACCTTACGAT
TATTTAGAGAGTATTTATTAGTTTTATTGTATGTATACGGATGTTTTATTATCTATTTATGCCCTTATATTCTGTAACTATCCAAAAGTCC
TATCTTATCAAGCCAGCAATCTATGTCCGCGAACGTCAACTAAAAATAAGCTTTTTATGCTCTTCTCTCTTTTTTTCCCTTCGGTATAATT
ATACCTTGCATCCACAGATTCTCCTGCCAAATTTTGCATAATCCTTTACAACATGGCTATATGGGAGCACTTAGCGCCCTCCAAAACCCAT
ATTGCCTACGCATGTATAGGTGTTTTTTCCACAATATTTTCTCTGTGCTCTCTTTTTATTAAAGAGAAGCTCTATATCGGAGAAGCTTCTG
TGGCCGTTATATTCGGCCTTATCGTGGGACCACATTGCCTGAATTGGTTTGCCCCGGAAGATTGGGGAAACTTGGATCTGATTACCTTAGC
TGCAGGTACCACTGAGCGTCAGACCCCGTAGAAAAGATCAAAGGATCTTCTTGAGATCCTTTTTTTCTGCGCGTAATCTGCTGCTTGCAAA
CAAAAAAACCACCGCTACCAGCGGTGGTTTGTTTGCCGGATCAAGAGCTACCAACTCTTTTTCCGAAGGTAACTGGCTTCAGCAGAGCGCA
GATACCAAATACTGTTCTTCTAGTGTAGCCGTAGTTAGGCCACCACTTCAAGAACTCTGTAGCACCGCCTACATACCTCGCTCTGCTAATC
CTGTTACCAGTGGCTGCTGCCAGTGGCGATAAGTCGTGTCTTACCGGGTTGGACTCAAGACGATAGTTACCGGATAAGGCGCAGCGGTCGG
GCTGAACGGGGGGTTCGTGCACACAGCCCAGCTTGGAGCGAACGACCTACACCGAACTGAGATACCTACAGCGTGAGCTATGAGAAAGCGC
CACGCTTCCCGAAGGGAGAAAGGCGGACAGGTATCCGGTAAGCGGCAGGGTCGGAACAGGAGAGCGCACGAGGGAGCTTCCAGGGGGAAAC
GCCTGGTATCTTTATAGTCCTGTCGGGTTTCGCCACCTCTGACTTGAGCGTCGATTTTTGTGATGCTCGTCAGGGGGGCGGAGCCTATGGA
AAAACGCCAGCAACGCGGCCTTTTTACGGTTCCTGGCCTTTTGCTGGCCTTTTGCTCACATGTTCTTTCCTGCGGTACCC
```

Fig. 1 R shows the sequence of a pLLP vector containing a Geneticin resistance marker (pLLPk) corresponding to SEQ ID NO: 22.

```
AAATTTTGCATAATCCTTTACAACATGGCTATATGGGAGCACTTAGCGCCCTCCAAAACCCATATTGCCTACGCATGTATAGGTGTTTTTT
CCACAATATTTTCTCTGTGCTCTCTTTTTATTAAAGAGAAGCTCTATATCGGAGAAGCTTCTGTGGCCGTTATATTCGGCCTTATCGTGGG
ACCACATTGCCTGAATTGGTTTGCCCCGGAAGATTGGGGAAACTTGGATCTGATTACCTTAGCTGCAGGTACCACTGAGCGTCAGACCCCG
TAGAAAAGATCAAAGGATCTTCTTGAGATCCTTTTTTTCTGCGCGTAATCTGCTGCTTGCAAACAAAAAAACCACCGCTACCAGCGGTGGT
TTGTTTGCCGGATCAAGAGCTACCAACTCTTTTTCCGAAGGTAACTGGCTTCAGCAGAGCGCAGATACCAAATACTGTTCTTCTAGTGTAG
CCGTAGTTAGGCCACCACTTCAAGAACTCTGTAGCACCGCCTACATACCTCGCTCTGCTAATCCTGTTACCAGTGGCTGCTGCCAGTGGCG
ATAAGTCGTGTCTTACCGGGTTGGACTCAAGACGATAGTTACCGGATAAGGCGCAGCGGTCGGGCTGAACGGGGGGTTCGTGCACACAGCC
CAGCTTGGAGCGAACGACCTACACCGAACTGAGATACCTACAGCGTGAGCTATGAGAAAGCGCCACGCTTCCCGAAGGGAGAAAGGCGGAC
AGGTATCCGGTAAGCGGCAGGGTCGGAACAGGAGAGCGCACGAGGGAGCTTCCAGGGGGAAACGCCTGGTATCTTTATAGTCCTGTCGGGT
TTCGCCACCTCTGACTTGAGCGTCGATTTTTGTGATGCTCGTCAGGGGGCGGAGCCTATGGAAAAACGCCAGCAACGCGGCCTTTTTACG
GTTCCTGGCCTTTTGCTGGCCTTTTGCTCACATGTTCTTTCCTGCGGTACCCAGATCCAATTCCCGCTTTGACTGCCTGAAATCTCCATCG
CCTACAATGATGACATTTGGATTTGGTTGACTCATGTTGGTATTGTGAAATAGACGCAGATCGGGAACACTGAAAAATACACAGTTATTAT
TCATTTAAATCACGGTCTTGGAGTCATCAGGCTCTGACTGGGCAGCTGCTGCAACTGGAACTTCCCAAGCCTCCCACCAAACAGCAGGTGT
AGCCGAAAGTATTCACGTGTCCCAGAATGAGGCCCACAGTACATCTGTCACCGTTTCTCAACCCCCTTCAACGGTTTCTTTGCAAATTGGA
GAAGCAAATACCCTGAAATGGTCAGCTTTCTTTGGAGTAGTAGTTCCGCTGCTCAACGTACTCTTCGTTTAAAAGCCCTCCTAGGACAAAA
TGGCCAAGCTGGGAACGGGATTTGGTGGAACTTTATTATTCTTTCTACGATCCAAGCATTATGTTGTGGAACAAAGCGAATACTCTTATT
AGCTGGTAATTGAGCGAGTTGAAAAAATCAAGTCTATTGGAGGGTATGGTCAGAGTACTGATAGAGATCCCTGTTAAGATAATCGATCTTT
TTCAAATATCCAATTTCATTCCATCTTGCCCATCGGGTCTTGGCTTCTTACATCAATAATTAAAACTACTTACTCTATTAGTGCCAAAAATG
GTAAACCGTATTCAAATTGCTGCAAGCATATGCTTAAAAGGATCGCGTTGCGAGCTTCTTTTGAGATTCGCAAGCTTGATTTTATGCTCTT
GTGGGAAGAAAAGCAACCCACTGAATTCCAGATTTGTTGTGTTTTCATGCATGGACGACATACTTTGAGTAATACCGTTACTGAGATTTTA
CCGAATTCGCATTGCGTTGAGGCGTGAAGTTTCTTAATGCTGTGCCATATGGTTAAGTTGCGTTTCAAGATGGTCCACAAGTATTTTTGTA
TTTAAGCAGTGTCAATTCAAGCCTAACTGCTCATAAAAACTACACGGTTTGCTGATATCAAAACGATGCGTTTCCCATCGATTTTCACAGC
TGTTCTGTTTGCAGCTTCATCTGCTTTAGCTGCACCTGTTAACACAACTACAGAGGACGAAACGGCCCAGATCCCAGCTGAGGCAGTCATT
GGTTATTCCGATTTGGAAGGTGATTTCGATGTCGCTGTGTTACCATTCAGTAATTCCACAAATAACGGTTTGCTGTTCATTAACACCACTA
TAGCAAGCATCGCTGCAAAAGAGGAAGGTGTTTCCCTAGAAAAGAGGGCCCAGTCCGTTTGACTCAACCCCCTTCCGTATCCGCAGCTCC
AGGCCAAAAAGTAACGATCTCTTGTTCAGGTTCCACTAGTAACATAGGTGACAATTATGTGTCATGGTACCAACAGTTGCCCGGAACTGCC
CCTCAACTGCTGATCTACGACAATACCAAGAGGCCGTCAGGTATCCCAGACAGATTTTCCGGTTCTAAGAGCGGCACATCGGCTACACTAG
GTATCACGGGACTTCAAACCGGCGACGAGGCAGATTACTACTGCGCAACTTGGGATAATGATAAGTGGGGAGTTGTTTTTGGAGGTGGTAC
TAAACTCGAAGTCTTGGGTGGTGGAGGAGGATCAGGAGGAGGAGGTTCTGGAGGAGGTGGTTCATCTGGCGGTGGATCTGAAGTGCAGCTT
GTGGAGAGTGGTGGTGGTTTGGTTCAACCAGGAGGTAGCTTGAGACTGTCATGTGCCGCCAGCGGTTTTACTTTCTCTCCTATGCAATGT
CTTGGGTCAGACAAGCACCTGGTAAGGGTTTGGAATGGGTATCAGCTATTTCGGGTAGTGGTGGTTTCGACATATTATGCTGACTCCGTTAA
AGGTCGTTTTACTATTTCTAGAGACAATTCCAAAAATACCTTATATCTTCAAATGAACTCCCTTAGAGCTGAGGATACTGCTGTTTACTAC
TGTGCTCGTGATGCTTGGTTGGATGTGTTGTCTGACGGCTTTGACTACTGGGGACAAGGTACTTTGGTCACAGTGAGCAGCTGATAAGGGC
GGCCGCAGCGAATTTCTTATGATTTATGATTTTTATTATTAAATAAGTTATAAAAAAAATAAGTGTATACAAATTTTAAAGTGACTCTTAG
GTTTTAAAACGAAAATTCTTATTCTTGAGTAACTCTTTCCTGTAGGTCAGGTTGCTTTCTCAGGTATAGCATGAGGTCGCTCTTATTGACC
ACACCTCTACCGGCATGCCGAGCAAATGCCTGCAAATCGCTCCCCATTTCACCCAATTGTAGATATGCTAACTCCAGCAATGAGTTGATGA
ATCTCGGTGTGTATTTTATGTCCTCAGAGGACAAGGATCCTTCAGTAATGTCTTGTTTCTTTTGTTGCAGTGGTGAGCCATTTTGACTTCG
```

Fig. 1R (continued)

```
TGAAAGTTTCTTTAGAATAGTTGTTTCCAGAGGCCAAACATTCCACCCGTAGTAAAGTGCAAGCGTAGGAAGACCAAGACTGGCATAAATC
AGGTATAAGTGTCGAGCACTGGCAGGTGATCTTCTGAAAGTTTCTACTAGCAGATAAGATCCAGTAGTCATGCATATGGCAACAATGTACC
GTGTGGATCTAAGAACGCGTCCTACTAACCTTCGCATTCGTTGGTCCAGTTTGTTGTTATCGATCAACGTGACAAGGTTGTCGATTCCGCG
TAAGCATGCATACCCAAGGACGCCTGTTGCAATTCCAAGTGAGCCAGTTCCAACAATCTTTGTAATATTAGAGCACTTCATTGTGTTGCGC
TTGAAAGTAAAATGCGAACAAATTAAGAGATAATCTCGAAACCGCGACTTCAAACGCCAATATGATGTGCGGCACACAATAAGCGTTCATA
TCCGCTGGGTGACTTTCTCGCTTTAAAAAATTATCCGAAAAAATTTTCTAGAGTGTTGACACTTTATACTTCCGGCTCGTATAATACGACA
AGGTGTAAGGAGGACTAAACCATGGGTAAGGAAAAGACTCACGTTTCGAGGCCGCGATTAAATTCCAACATGGATGCTGATTTATATGGGT
ATAAATGGGCTCGCGATAATGTCGGGCAATCAGGTGCGACAATCTATCGATTGTATGGGAAGCCCGATGCGCCAGAGTTGTTTCTGAAACA
TGGCAAAGGTAGCGTTGCCAATGATGTTACAGATGAGATGGTCAGACTAAACTGGCTGACGGAATTTATGCCTCTTCCGACCATCAAGCAT
TTTATCCGTACTCCTGATGATGCATGGTTACTCACCACTGCGATCCCCGGCAAAACAGCATTCCAGGTATTAGAAGAATATCCTGATTCAG
GTGAAAATATTGTTGATGCGCTGGCAGTGTTCCTGCGCCGGTTGCATTCGATTCCTGTTTGTAATTGTCCTTTTAACAGCGATCGCGTATT
TCGTCTCGCTCAGGCGCAATCACGAATGAATAACGGTTTGGTTGATGCGAGTGATTTTGATGACGAGCGTAATGGCTGGCCTGTTGAACAA
GTCTGGAAAGAAATGCATAAGCTTTTGCCATTCTCACCGGATTCAGTCGTCACTCATGGTGATTTCTCACTTGATAACCTTATTTTTGACG
AGGGGAAATTAATAGGTTGTATTGATGTTGGACGAGTCGGAATCGCAGACCGATACCAGGATCTTGCCATCCTATGGAACTGCCTCGGTGA
GTTTTCTCCTTCATTACAGAAACGGCTTTTTCAAAAATATGGTATTGATAATCCTGATATGAATAAATTGCAGTTTCATTTGATGCTCGAT
GAGTTTTTCTAACCTCTAGGACACCTTACGATTATTTAGAGAGTATTTATTAGTTTTATTGTATGTATACGGATGTTTTATTATCTATTTA
TGCCCTTATATTCTGTAACTATCCAAAAGTCCTATCTTATCAAGCCAGCAATCTATGTCCGCGAACGTCAACTAAAAATAAGCTTTTTATG
CTCTTCTCTCTTTTTTTCCCTTCGGTATAATTATACCTTGCATCCACAGATTCTCCTGCC
```

Fig. 1 S shows SEQ ID NO: 23, which is part of the nuceleotide sequence of chromosome 1 of the genomic sequence of yeast strain YJK_PVA_021 after random integration of a PVA- and a Zeocin-expression cassette into the coding region of ssn6-like (reverse-complement sequence of ssn6-like) at position 807,480 of chromosome 1 of the reference strain Pichia pastoris CBS 7435. The ssn6-like sequence is underlined, the start codon is shown in bold and double-underlined (ATG → reverse-complement → CAT). Shown is the interrupted ssn6-like coding sequence including 10 nucleotide bases flanking 5' and 3' to the ssn6-like coding sequence. The sequence shown is part of the Illumina-sequenced genome of strain YJK_PVA_021 (SEQ ID NOs: 67-115) and the sequence of SEQ ID NO: 23 is part of the genomic sequence SEQ ID NO: 103 obtained by Illumina Inc. Sequences of oligo2395 (reverse-complement sequence) and oligo2398 are labeled in grey.

```
TTTCTGGTGTTCAGGGAATGGGGATTGTTGGGAAGGTGGGTACATTGGTGAAGGCGCATAGTGCTGATAGTTTTGTGGTTGAAACTGTTGC
TGCTGTTGTTGCTGTTGTTGTTGTAACTGTGGTGAAGCAGGACGAGGGGAAATTTGTGGGGGGGCAACAGGAGGATGGGTTGCAATTGAGA
ATCTCTGATCGGCGCTTGGGGACAAGTTCTTGTTTGCCGGAGCATGCACACGCTGTTGCTGTGCTAATGGAACGTTAGGGAGTGAGTGAAC
TGGTAAGTTCTGTCGCTGTGGCTGTGAATCTTCGGATGGTAGGTTATAGTTATTTGCGGAGTGAGACGGGTAGGGAGGCATTGGTCTCGAA
GTGTCAGTTCGCTTCTTGCTGCTACTCTTGATTTCTGGAGCGGATGCGATGTCATCTAACGAAGCATTGGCCAAATTTTCTCTTTCAGATA
TACTCAGTGAAGTAAGATCTCGCAGTAAATATAACGGAGATTGACAACATGTGCTTGGTCTGTAATCAGAAAGCGGAATCTCTCCAGATAC
CACTCTTCGTAAAGTTTCCAATCGCGAGTTCAAGAAATTTGCCCGAGAGCTATCACCCGCTTGGCTTGCATAGCTGCTTGACTTCATACAG
GCCTCTATAGAGTCAGCCAACTGACCATGACACTTTTCGTACACCGATGAAAGACCCTCCCAAGCAAATGAGAGCAAAATCTTGCTCTCTT
GTTCTTGTTCTGTTTCACGTTTGATGACAAACATATACGCGCTAAGGTCCTCGTCCAATCAGGTAGCCATCTCTGAAATATCTGGCTCCGT
TGCAACTCCGAACGACCTGCTGGCAACGTAAAATTCTCCGGGGTAAAACTTAAATGTGGAGTAATGGAACCAGAAACGTCTCTTCCCTTCT
CTCTCCTTCCACCGCCCGTTACCGTCCCTAGGAAATTTTACTCTGCTGGAGAGCTTCTTCTACGGCCCCCTTGCAGCAATGCTCTTCCCAG
CATTACGTTGCGGGTAAAACGGAGGTCGTGTACCCGACCTAGCAGCCCAGGGATGGAAAAGTCCCGGCCGTCGCTGGCAATAATAGCGGGC
GGACGCATGTCATGAGATTATTGGAAACCACCAGAATCGAATATAAAAGGCGAACACCTTTCCCAATTTTGGTTTCTCCTGACCCAAAGAC
TTTAAATTTAATTTATTTGTCCCTATTTCAATCAATTGAACAACTATCAAAACACAGAATTCCGAAACGATGAGATTCCCATCTATTTTCA
CCGCTGTCTTGTTCGCTGCCTCCTCTGCATTGGCTGCCCCTGTTAACACTACCACTGAAGACGAGACTGCTCAAATTCCAGCTGAAGCAGT
TATCGGTTACTCTGACCTTGAGGGTGATTTCGACGTCGCTGTTTTGCCTTTCTCTAACTCCACTAACAACGGTTTGTTGTTCATTAACACC
ACTATCGCTTCCATTGCTGCTAAGGAAGAGGGTGTCTCTCTCGAGAAGAGAGAGGCCGAAGCTGCTAGAACTACCGAGCCAATCATTGACT
TAGGATACGCTAGATACAGAGGTTCAATCAACGACACTACCTCTGTCACTTCATACCTGGGTATCAGATTTGCTGAACCTCCAGTTGAGGA
CTTGAGATGGAGAGCCCCACAACCTGCTAAGAGACTTCCTGGTGTTCAAAACGCCACTATTGTTCCTCCATTGTGTCCACAAGGTTTCATC
AACATCTTGATTCCAGGAGGTATTCCACCTCCAGATTCGACCAACGTTTCTGAAGACTGCTTGTTCTTGTCCGTTTTTGCACCTAGAAAGT
TGCCACCTAAGCGTAAGGAATTGCCAGTGATTGTTTGGATTCATGGTGGAGGATACATCGTCTCCTCTGCAGCTACTTTCGACGGAACTAA
CTTGGTTAGAGAGTCTAACGACTCTGTCATTGTGGTGACTATCCAGTACAGACTGGGAATTTTCGGATTCATGGCTGGTAAGAAGTTGAAG
GATAACGGAGACTTGAATGCTGGATTGCTTGACCAAGAGTTGGCTTTGAAGTGGGTTCAACAGCACATTAACAAGTTCGGTGGTGACCCTA
AGCAAGTGACCATTTGGGGTCAATCAGCTGGAGGTGGTTCTGTGTTGCAACAGGTCATTGCTCACAACGGACAAACTAACCCACCATTGTT
CAGAGCTGCTATGTCTTCCTCTACCTACCTTCCTTCTCAACACCATTTCGACGATCCTGTTCCAGAAGGTATCTACTCTACCGTTGTCTCA
ACTGCTGGTTGTGCTGATGCTACTGATCCTCTTACTTGCTTGAGAGCTTCTAACACCTCCATCTTACAAGCTGCTAACGACAAGGCATGTA
```

Fig. 1S (continued)

```
GATCCGCATTCTACGGTACTTCCGTTGTTGTTCCTGTTGTTGATGGTGAGTTCATCACCCAAAGACCATCTGAAGCTCTTAGACAAAGACG
TGTCAACGGTAACGCTTTGTTGGCTATCTCTAATACCAACGAAGGTGACATCTTCGTTGACCAATCTAAGGCTGACACTGTTACTGCTGCT
CAGTTCGTTAGAGACTTGTACCCTAGATTGAACGGTGCTCAAGTTGCTGAGGTTGTTCGTCTGTACTCTGGTTTAGGTGCTCCAATCCAAC
AGGCTGACTCTATCATGGGAGATACTCTGTTCCAATGTCCAACCATTTGGTTCTCTCAAGCCTTCAGACAATCTTTCAAGGGTGAATACGC
TGTTCTTCCTGCATTCCACGGTTCTGACATTTCCCAGTACTTCCCATCTTTTGCTCCTAGATTCTTCGACGATCCTGCTTTCACTTCCTCT
TTCACTCAGTCCTTCTTGGACTTCGCTTTGTCTCGTAACTCTGATCCTAACGCAAAGTTTGACGACGGTAACTTGACTCCTAGATGGAACA
GATACACCTCTTGCTCAAAGTTCGAGATGGTGTTCAACCGTACTGATGGTGAAGAGTTGGACATTAGACCAGCTTCTACTGGTGCTGGTTT
GTTGGAGAGATGTGCATTCTGGGAATCTGTCTCCGAATTGACTGCTCAATAAGCGGCCGCTCAAGAGGATGTCAGAATGCCATTTGCCTGA
GAGATGCAGGCTTCATTTTTGATACTTTTTTATTTGTAACCTATATAGTATAGGATTTTTTTTGTCATTTTGTTTCTTCTCGTACGAGCTT
GCTCCTGATCAGCCTATCTCGCAGCAGATGAATATCTTGTGGTAGGGGTTTGGGAAAATCATTCGAGTTTGATGTTTTTCTTGGTATTTCC
CACTCCTCTTCAGAGTACAGAAGATTAAGTGAGACCTTCGTTTGTGCGGATCCTTCAGTAATGTCTTGTTTCTTTTGTTGCAGTGGTGAGC
CATTTTGACTTCGTGAAAGTTTCTTTAGAATAGTTGTTTCCAGAGGCCAAACATTCCACCCGTAGTAAAGTGCAAGCGTAGGAAGACCAAG
ACTGGCATAAATCAGGTATAAGTGTCGAGCACTGGCAGGTGATCTTCTGAAAGTTTCTACTAGCAGATAAGATCCAGTAGTCATGCATATG
GCAACAATGTACCGTGTGGATCTAAGAACGCGTCCTACTAACCTTCGCATTCGTTGGTCCAGTTTGTTGTTATCGATCAACGTGACAAGGT
TGTCGATTCCGCGTAAGCATGCATACCCAAGGACGCCTGTTGCAATTCCAAGTGAGCCAGTTCCAACAATCTTTGTAATATTAGAGCACTT
CATTGTGTTGCGCTTGAAAGTAAAATGCGAACAAATTAAGAGATAATCTCGAAACCGCGACTTCAAACGCCAATATGATGTGCGGCACACA
ATAAGCGTTCATATCCGCTGGGTGACTTTCTCGCTTTAAAAAATTATCCGAAAAAATTTTCTAGAGTGTTGTTACTTTATACTTCCGGCTC
GTATAATACGACAAGGTGTAAGGAGGACTAAACCATGGCTAAACTCACCTCTGCTGTTCCAGTCCTGACTGCTCGTGATGTTGCTGGTGCT
GTTGAGTTCTGGACTGATAGACTCGGTTTCTCCCGTGACTTCGTAGAGGACGACTTTGCCGGTGTTGTACGTGACGACGTTACCCTGTTCA
TCTCCGCAGTTCAGGACCAGGTTGTGCCAGACAACACTCTGGCATGGGTATGGGTTCGTGGTCTGGACGAACTGTACGCTGAGTGGTCTGA
GGTCGTGTCTACCAACTTCCGTGATGCATCTGGTCCAGCTATGACCGAGATCGGTGAACAGCCCTGGGGTCGTGAGTTTGCACTGCGTGAT
CCAGCTGGTAACTGCGTGCATTTCGTCGCAGAAGAGCAGGACTAACAATTGACACCTTACGATTATTTAGAGAGTATTTATTAGTTTTATT
GTATGTATACGGATGTTTTATTATCTATTTATGCCCTTATATTCTGTAACTATCCAAAAGTCCTATCTTATCAAGCCAGCAATCTATGTCC
GCGAACGTCAACTAAAAATAAGCTTTTTATGCTCTTCTCTCTTTTTTTCCCTTCGGTATAATTATACCTTGCATCCACAGATTCTCCTGCC
AAATTTTGCATAATCCTTTACAACATGGCTATATGGGAGCACTTAGCGCCCTCCAAAACCCATATTGCCTACGCATGTATAGGTGTTTTTT
CCACAATATTTTCTCTGTGCTCTCTTTTTATTAAAGAGAAGCTCTATATCGGAGAAGCTTCTGTGGCCGTTATATTCGGCCTTATCGTGGG
ACCACATTGCCTGAATTGGTTTGCCCCGGAAGATTGGGGAAACTTGGATCTGATTACCTTAGCTGCAGGTACCACTCATCAGCCAGCTGGC
CCAGTTCGGCATAAAGGTTTCCCACTGCAAGCCATACAATTGTGTGGTTTGGAGCCCTTTTCAAGGCCAACTGGAATGCTTCGTAGGCCTC
GCTTGGTTGGCGCAGCATTTGATAAGCCTCACCAAGTAAAAACCATGGTAGAAAGTCGTTGCTTTCCGAATTAACAACTTGCCGAAGCAGG
ACACAAGCAGACTGTGGGTTAAATACGTGACTGTTCGGTAGTAGCAACAAGTATGCGTGGCATATATATATGCATGGCTCGAATCCTAACA
GTCCAGATGCCTCCTCACAGACGCGCACTGCCTTGGCCATATCTCCAAGGCGCTCATTAGCACTAATGAGGGCGCACCAAAGAGAGGAATA
CTCTGTGAAGCGGGAAGAAGAGGGAGGCGGAAGAGCCAAAGTGGCCTCCAACTCATCCCTGGCAGCTTCGATGTTGCCCTCCGCAGCAAGA
ACGGAGGCAAATTCTGAGTGGGTGGAACGGGCCACGTCAATCTCTTCTTTTGTATAGTCTGCAAGTCGATTTGGGGAGTTTCACCAAGGCTG
TGTTCAGTGCATCGACGGCCTCATGTTTGGAACCTGCGGCCATCAATGTTTGTCCTTTAAGTAACCATAATGCAGAGTTGTTGGGAGTTAA
TTGAATACATCTTTGTAGGGCCTCCATGGCATTCGTTGTGTTGTTTAAGAGTAGATAGCATTCGGCAGCTTCTCTCCAGATAGATGGATCT
TTGTAAAGCTCTGATGAGCGTGATAAAAGGTCGTTGATAACATCCAGGGCCGCTGCGGTACCGTCTGTTTGGTCCTTGACCAGATCCATAG
CCCTCAATGCAGCTGCGAGTCCACAAAGAGCCTTCTCGTTGAATGGATCATTTTGGAGGGCAAAATCGAACGAATCAATTGCCAGCTGGTA
CAAGTGGACTTCGTGAGCCATGGATCCGAGCGCTAGCCAAGTGGAGACAGCTATCTTGCGAAACTCGAGTTGTTTATCATATACCACTTTC
CGTTGCTGGGAGTCAGCTTGAGACGTTGGTACGGGATCATGCCTCACTTCCAGTGTCACTGGCGGAGGCTGTGAAGGTTCGTTCATAAGTA
GTGGT
```

Fig. 1 T shows SEQ ID NO: 121, which is the codon-optimized human serum albumin (HSA) sequence with its natural signal sequence exchanged by the LLP-signal sequence. The LLP-signal sequence is underlined. Position 45 (labeled in bold and with grey background color) contains a silent mutation from G to C.

```
ATGTTTGAAGAAGAGTAAATTTGTGGTTTCGTTTCTGCTTTTACTCCAGCTATTTTGTGTCCTTGGTGTACATGGAGACGCACACAAGAGCG
AAGTGGCTCATCGTTTCAAAGATCTGGGTGAAGAGAATTTCAAAGCATTGGTGTTGATTGCATTTGCACAATACCTTCAACAATGTCCATT
TGAGGACCACGTCAAACTTGTGAATGAAGTGACAGAGTTTGCTAAAACTTGCGTTGCTGACGAGTCCGCAGAGAATTGCGACAAGTCTTTA
CATACTCTGTTCGGAGATAAGCTGTGTACAGTTGCCACCTTGAGAGAGACTTACGGCGAAATGGCTGACTGTTGCGCTAAACAGGAACCCG
AGAGAAACGAATGTTTTCTGCAACATAAGGATGATAACCCTAATTTGCCAAGGTTAGTACGTCCTGAGGTTGATGTCATGTGTACAGCTTT
TCATGACAATGAGGAAACTTTCTTGAAAAAGTACCTGTACGAGATCGCAAGACGTCACCCATACTTCTACGCTCCAGAACTCCTGTTTTTC
GCTAAGAGATATAAGGCAGCATTCACGGAGTGTTGTCAGGCCGCTGACAAAGCTGCTTGCTTGTTACCTAAGCTTGACGAGTTGAGAGATG
AAGGAAAAGCCTCATCAGCTAAGCAAAGACTAAAATGCGCATCTCTTCAAAAGTTTGGTGAAAGAGCTTTCAAAGCTTGGGCCGTTGCTAG
GCTCTCTCAAAGATTCCCCAAGGCTGAATTTGCTGAAGTCTCTAAGCTTGTAACAGATCTAACTAAAGTCCACACTGAATGCTGTCATGGA
GATCTGCTAGAATGCGCGGACGACAGAGCTGACTTGGCTAAATACATTTGTGAAAATCAGGATTCGATCAGTTCGAAACTCAAAGAGTGTT
GTGAGAAGCCACTATTGGAGAAATCCCATTGCATCGCTGAAGTCGAAAATGACGAAATGCCGGCTGACTTGCCTAGTCTTGCAGCAGATTT
CGTAGAATCAAAGGATGTATGTAAAAACTACGACCGAAGCAAAAGACGTGTTTTTGGGCATGTTTCTGTATGAATATGCCAGGAGACACCCA
GATTATTCCGTAGTTTTGTTGCTGCGTTTGGCTAAGACTTATGAGACAACGTTAGAAAAGTGCTGTGCTGCCGCCGACCCACATGAATGTT
ATGCCAAAGTTTTTGATGAGTTCAAGCCATTGGTTGAGGAACCTCAAAACTTGATAAAACAAAATTGTGAATTGTTTGAACAATTGGGTGA
GTACAAATTTCAAAATGCATTGCTGGTAAGATACACCAAAAAGGTTCCTCAGGTTTCCACCCCTACTCTAGTCGAGGTTTCCAGAAACTTG
GGAAAGGTGGGTTCTAAGTGTTGTAAACACCCCGAGGCCAAACGTATGCCCTGTGCTGAAGATTACTTGAGCGTCGTTCTCAACCAATTAT
GTGTGCTGCATGAAAGACGCCAGTTTCCGATCGAGTCACCAAGTGCTGTACTGAGTCTTTGGTAAATCGTAGACCTTGTTTCTCAGCATT
AGAAGTGGACGAGACTTATGTGCCGAAGGAATTCAATGCTGAAACATTTACTTTTCATGCTGATATTTGTACATTGTCAGAAAAAGAGAGA
CAAATCAAAAAGCAGACTGCCTTGGTGGAGCTTGTTAAACACAAGCCAAAGGCTACTAAAGAGCAATTGAAAGCAGTTATGGATGATTTTG
```

Fig. 1T (continued)

```
CAGCATTCGTTGAGAAATGTTGCAAGGCAGACGACAAGGAGACATGTTTTGCCGAGGAGGGTAAAAAGCTTGTTGCAGCTAGCCAGGCTGC
TTTGGGACTTTAA
```

Fig. 1 U shows SEQ ID NO: 129, which is the shortened LLP-promoter sequence delta29 corresponding to a 576 bases length of the shortened LLP-promoter

```
TGGTGGAACTTTATTATTCTTTCTACGATCCAAGCATTATGTTGTGGAACAAAGCGAATACTCTTATTAGCTGGTAATTGAGCGAGTTGAA
AAAATCAAGTCTATTGGAGGGTATGGTCAGAGTACTGATAGAGATCCCTGTTAAGATAATCGATCTTTTTCAAATATCCAATTTCATTCCA
TCTTGCCATCGGGTCTTGGCTTCTTACATCAATAATTAAAACTACTTACTCTATTAGTGCCAAAAATGGTAAACCGTATTCAAATTGCTGC
AAGCATATGCTTAAAAGGATCGCGTTGCGAGCTTCTTTTGAGATTCGCAAGCTTGATTTTATGCTCTTGTGGGAAGAAAAGCAACCCACTG
AATTCCAGATTTGTTGTGTTTTCATGCATGGACGACATACTTTGAGTAATACCGTTACTGAGATTTTACCGAATTCGCATTGCGTTGAGGC
GTGAAGTTTCTTAATGCTGTGCCATATGGTTAAGTTGCGTTTCAAGATGGTCCACAAGTATTTTTGTATTTAAGCAGTGTCAATTCAAGCC
TAACTGCTCATAAAAACTACACGGTTTGCT
```

Fig. 1 V shows SEQ ID NO: 130, which is the shortened LLP-promoter sequence delta93 corresponding to a 512 bases length of the shortened LLP-promoter

```
TATTAGCTGGTAATTGAGCGAGTTGAAAAAATCAAGTCTATTGGAGGGTATGGTCAGAGTACTGATAGAGATCCCTGTTAAGATAATCGAT
CTTTTTCAAATATCCAATTTCATTCCATCTTGCCATCGGGTCTTGGCTTCTTACATCAATAATTAAAACTACTTACTCTATTAGTGCCAAA
AATGGTAAACCGTATTCAAATTGCTGCAAGCATATGCTTAAAAGGATCGCGTTGCGAGCTTCTTTTGAGATTCGCAAGCTTGATTTTATGC
TCTTGTGGGAAGAAAAGCAACCCACTGAATTCCAGATTTGTTGTTTTCATGCATGGACGACATACTTTGAGTAATACCGTTACTGAGAT
TTTACCGAATTCGCATTGCGTTGAGGCGTGAAGTTTCTTAATGCTGTGCCATATGGTTAAGTTGCGTTTCAAGATGGTCCACAAGTATTTT
TGTATTTAAGCAGTGTCAATTCAAGCCTAACTGCTCATAAAAACTACACGGTTTGCT
```

Fig. 1 W shows SEQ ID NO: 131, which is the shortened LLP-promoter sequence delta133 corresponding to a 472 bases length of the shortened LLP-promoter

```
TTGGAGGGTATGGTCAGAGTACTGATAGAGATCCCTGTTAAGATAATCGATCTTTTTCAAATATCCAATTTCATTCCATCTTGCCATCGGG
TCTTGGCTTCTTACATCAATAATTAAAACTACTTACTCTATTAGTGCCAAAAATGGTAAACCGTATTCAAATTGCTGCAAGCATATGCTTA
AAAGGATCGCGTTGCGAGCTTCTTTTGAGATTCGCAAGCTTGATTTTATGCTCTTGTGGGAAGAAAAGCAACCCACTGAATTCCAGATTTG
TTGTGTTTTCATGCATGGACGACATACTTTGAGTAATACCGTTACTGAGATTTTACCGAATTCGCATTGCGTTGAGGCGTGAAGTTTCTTA
ATGCTGTGCCATATGGTTAAGTTGCGTTTCAAGATGGTCCACAAGTATTTTTGTATTTAAGCAGTGTCAATTCAAGCCTAACTGCTCATAA
AAACTACACGGTTTGCT
```

Fig. 1 X shows SEQ ID NO: 132, which is the shortened LLP-promoter sequence delta201 corresponding to a 404 bases length of the shortened LLP-promoter

```
TTTCATTCCATCTTGCCATCGGGTCTTGGCTTCTTACATCAATAATTAAAACTACTTACTCTATTAGTGCCAAAAATGGTAAACCGTATTC
AAATTGCTGCAAGCATATGCTTAAAAGGATCGCGTTGCGAGCTTCTTTTGAGATTCGCAAGCTTGATTTTATGCTCTTGTGGGAAGAAAAG
CAACCCACTGAATTCCAGATTTGTTGTGTTTTCATGCATGGACGACATACTTTGAGTAATACCGTTACTGAGATTTTACCGAATTCGCATT
GCGTTGAGGCGTGAAGTTTCTTAATGCTGTGCCATATGGTTAAGTTGCGTTTCAAGATGGTCCACAAGTATTTTTGTATTTAAGCAGTGTC
AATTCAAGCCTAACTGCTCATAAAAACTACACGGTTTGCT
```

Fig. 1 Y shows SEQ ID NO: 133, which is the shortened LLP-promoter sequence delta233 corresponding to a 372 bases length of the shortened LLP-promoter

```
CTTACATCAATAATTAAAACTACTTACTCTATTAGTGCCAAAAATGGTAAACCGTATTCAAATTGCTGCAAGCATATGCTTAAAAGGATCG
CGTTGCGAGCTTCTTTTGAGATTCGCAAGCTTGATTTTATGCTCTTGTGGGAAGAAAAGCAACCCACTGAATTCCAGATTTGTTGTGTTTT
CATGCATGGACGACATACTTTGAGTAATACCGTTACTGAGATTTTACCGAATTCGCATTGCGTTGAGGCGTGAAGTTTCTTAATGCTGTGC
CATATGGTTAAGTTGCGTTTCAAGATGGTCCACAAGTATTTTTGTATTTAAGCAGTGTCAATTCAAGCCTAACTGCTCATAAAAACTACAC
GGTTTGCT
```

Fig. 1 Z shows SEQ ID NO: 134, which is the shortened LLP-promoter sequence delta300 corresponding to a 305 bases length of the shortened LLP-promoter

```
GCAAGCATATGCTTAAAAGGATCGCGTTGCGAGCTTCTTTTGAGATTCGCAAGCTTGATTTTATGCTCTTGTGGGAAGAAAAGCAACCCAC
TGAATTCCAGATTTGTTGTGTTTTCATGCATGGACGACATACTTTGAGTAATACCGTTACTGAGATTTTACCGAATTCGCATTGCGTTGAG
GCGTGAAGTTTCTTAATGCTGTGCCATATGGTTAAGTTGCGTTTCAAGATGGTCCACAAGTATTTTTGTATTTAAGCAGTGTCAATTCAAG
CCTAACTGCTCATAAAAACTACACGGTTTGCT
```

Fig. 2: Amino acid sequences

Fig. 2 A shows the amino acid sequence of the SSN6-like protein of P. Pastoris (SEQ ID NO: 8)

```
MNEPSQPPPVTLEVRHDPVPTSQADSQQRKVVYDKQLEFRKIAVSTWLALGSMAHEVHLYQLAIDSFDFALQNDPFNEKALCGLAAALRAM
DLVKDQTDGTAAALDVINDLLSRSSELYKDPSIWREAAECYLLLNNTTNAMEALQRCIQLTPNNSALWLLKGQTLMAAGSKHEAVDALNTA
LVKLPNDVADYTKEEIDVARSTHSEFASVLAAEGNIEAARDELEATLALPPPSSSRFTEYSSLWCALISANERLGDMAKAVRVCEEASGLL
GFEPCIYICHAYLLLLPNSHVFNPQSACVLLRQVVNSESNDFLPWFLLGEAYQMLRQPSEAYEAFQLALKRAPNHTIVWLAVGNLYAELGQ
LADALSAYMFVIKRETEQEQESKILLSFAWEGLSSVYEKCHGQLADSIEACMKSSSYASQAGDSSRANFLNSRLETLRRVVSGEIPLSDYR
PSTCCQSPLYLLRDLTSLSISERENLANASLDDIASAPEIKSSSKKRTDTSRPMPPYPSHSANNYNLPSEDSQPQRQNLPVHSLPNVPLAQ
QQRVHAPANKNLSPSADQRFSIATHPPVAPPTNFPSSCFTTVTTTTATTAATVSTTKLSALCAFTNVPTFPTIPIP
```

Fig. 2 B shows the amino acid sequence of the SSN6-like modified protein of P. Pastoris YJK_PVA_021 (SEQ ID NO: 9)

```
MNEPSQPPPVTLEVRHDPVPTSQADSQQRKVVYDKQLEFRKIAVSTWLALGSMAHEVHLYQLAIDSFDFALQNDPFNEKALCGLAAALRAM
DLVKDQTDGTAAALDVINDLLSRSSELYKDPSIWREAAECYLLLNNTTNAMEALQRCIQLTPNNSALWLLKGQTLMAAGSKHEAVDALNTA
LVKLPNDVADYTKEEIDVARSTHSEFASVLAAEGNIEAARDELEATLALPPPSSSRFTEYSSLWCALISANERLGDMAKAVRVCEEASGLL
GFEPCIYICHAYLLLLPNSHVFNPQSACVLLRQVVNSESNDFLPWFLLGEAYQMLRQPSEAYEAFQLALKRAPNHTIVWLAVGNLYAELGQ
LADEWYLQLR
```

Fig. 2 C shows the amino acid sequence of the LLP protein including LLP signal sequence of P. Pastoris (SEQ ID NO: 10). The LLP signalsequnce is underlined.

```
MFEKSKFVVSFLLLLQLFCVLGVHGQESGNGTTSDTAYACDIGATPFDGFNATIYQYQASDDNSIQDPVFMSTGYLQRNQLHSTTGVTNPG
FNIFTAGVATTTLYGIPNVNYQNMLLELKGYFRADASGNYGLSLRNIDDSAILFFGRETAFECCNENLIPLDEAPTDYSLFTIKEGEASTN
PDSYTYTQYLEAGRYYPVRTFFANIRTRAVFNFTMTLPDGSELTDFQNYIFQFGALNQQQCQAEIVTRENYTTTTEPWTGTFEATTTVIPS
GTEPGTVIVQTPYSTIDSTSTWTGTFTTFTTDADGSTIAVVPSSTIDDHFASTETVLTDTAISTTVITVTSCGTSKCTKTTALTGVTQRTL
TIDDRTTVVTTYCPLPTDVATIKTASVSGSEVVQTIYTAKHSQAVSYVHPSTVTITREVCDAQTCTQATIVTGEILQTTVVDSGSTTVVPK
YVPVETHEPTFELSTL
```

Fig. 2 D shows the amino acid sequence of the LLP signal sequence of P. Pastoris (SEQ ID NO: 140)

MFEKSKFVVSFLLLLQLFCVLGVHG

Fig. 3: Mechanism of the super-secretor strain 1
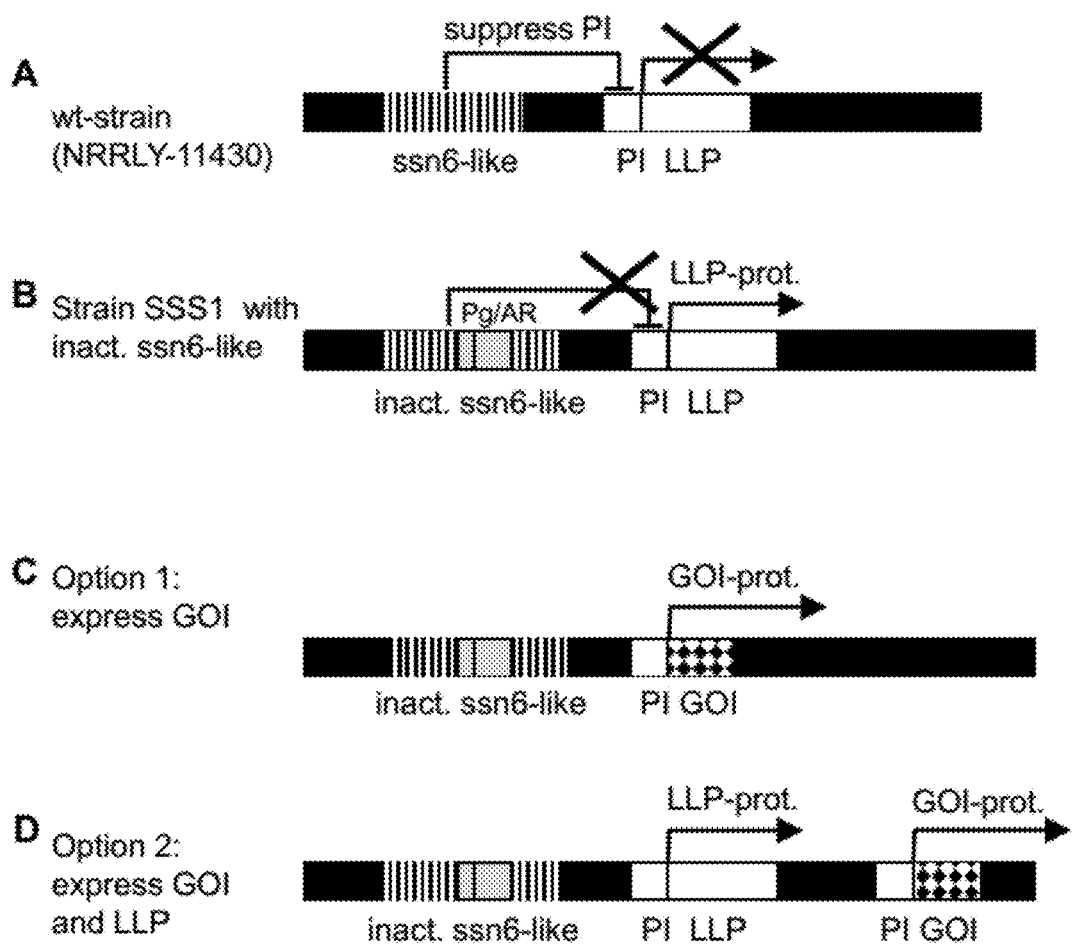

Fig. 7
7 A
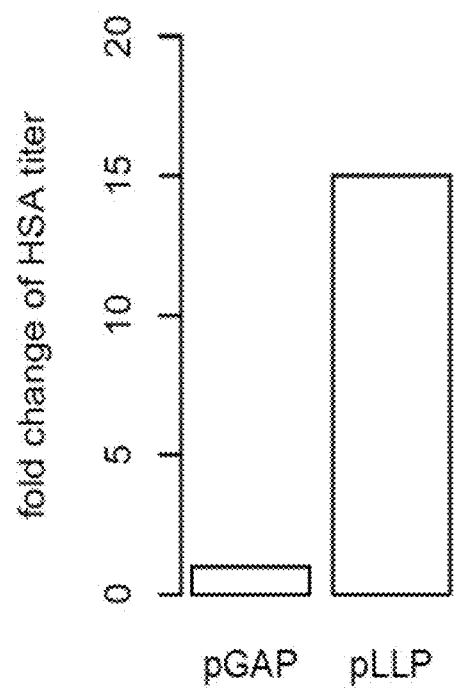
7 B
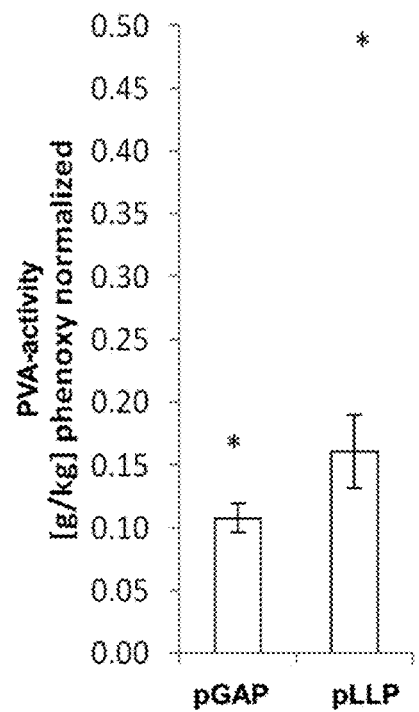

Fig. 8
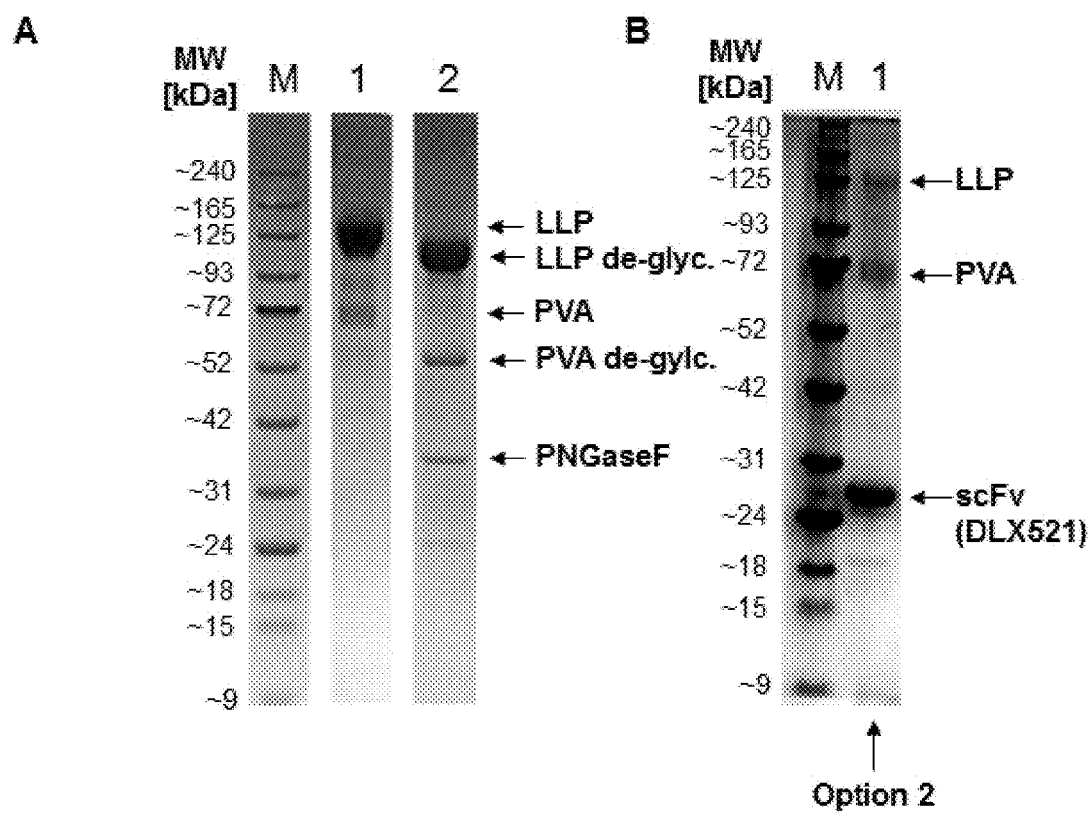
| Lane | M | 1 | 2 | | M | 1 |
|---|---|---|---|---|---|---|
| LLP, glycos. | | ++ | - | | | + |
| LLP, de-glycos. | | - | ++ | | | - |
| PVA, glycos. | | + | o | | | + |
| PVA, de-glycos. | | - | ++ | | | - |
| scFv, glycos. | | - | - | | | ++ |
| PNGaseF added | | no | yes | | | no |
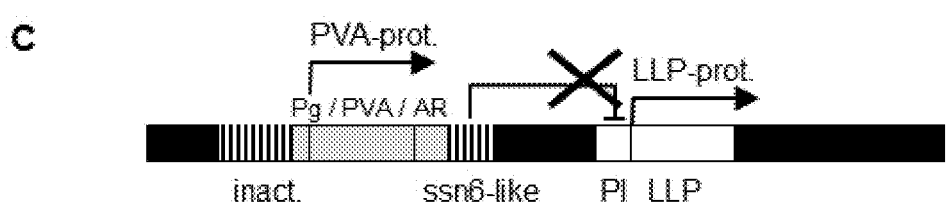

Pichia SSN6-like: WLAVGNLYAELGQLADALSAY
          352  355   360   365   370 372

Consensus Sequence 1:
W(CGL)(SLTA)(IMV)G(VINSTK)LY(YFLA)(QNSRKE)(INLM)
352         355              360
(GNSKR)Q(NFYL)(HRETPAK)D(AST)(LI)(DGTNASE)(AV)(YF)
   365                        370        372

C

Pichia SSN6-like: WEGLSSVYEKCHGQLADSIEACMK
         394   400   405   410  415 417

Consensus Sequence 2:
W(YFLED)(NDG)L(GLAS)(TSIQC)(LIV)YE(TSARKQ)(CS)
394                     400
(NHSDEH)(DNK-RGF)(Q-H)(ILTHVAS)(TSNQERIAMG)D
   405                                    410
(ASV)(LIASC)(DHNE)(SA)(YC)(EAKRQMTLNDS)(RQK)
            415                    417

A: Expression vector pLLP

Fig. 10 (continued)
B: Full sequence of pLLP (SEQ ID NO: 65)

LLP-promoter, LLP-terminator, NotI, EcoRV, AvrII

AAATTTTGCATAATCCTTTACAACATGGCTATATGGGAGCACTTAGCGCCCTCCAAAACCCATATTGCCTACGCATGTATAGGTGTTTTTT
CCACAATATTTTCTCTGTGCTCTCTTTTTATTAAAGAGAAGCTCTATATCGGAGAAGCTTCTGTGGCCGTTATATTCGGCCTTATCGTGGG
ACCACATTGCCTGAATTGGTTTGCCCCGGAAGATTGGGGAAACTTGGATCTGATTACCTTAGCTGCAGGTACCACTGAGCGTCAGACCCCG
TAGAAAAGATCAAAGGATCTTCTTGAGATCCTTTTTTTCTGCGCGTAATCTGCTGCTTGCAAACAAAAAAACCACCGCTACCAGCGGTGGT
TTGTTTGCCGGATCAAGAGCTACCAACTCTTTTTCCGAAGGTAACTGGCTTCAGCAGAGCGCAGATACCAAATACTGTTCTTCTAGTGTAG
CCGTAGTTAGGCCACCACTTCAAGAACTCTGTAGCACCGCCTACATACCTCGCTCTGCTAATCCTGTTACCAGTGGCTGCTGCCAGTGGCG
ATAAGTCGTGTCTTACCGGGTTGGACTCAAGACGATAGTTACCGGATAAGGCGCAGCGGTCGGGCTGAACGGGGGGTTCGTGCACACAGCC
CAGCTTGGAGCGAACGACCTACACCGAACTGAGATACCTACAGCGTGAGCTATGAGAAAGCGCCACGCTTCCCGAAGGGAGAAAGGCGGAC
AGGTATCCGGTAAGCGGCAGGGTCGGAACAGGAGAGCGCACGAGGGAGCTTCCAGGGGGAAACGCCTGGTATCTTTATAGTCCTGTCGGGT
TTCGCCACCTCTGACTTGAGCGTCGATTTTTGTGATGCTCGTCAGGGGGGCGGAGCCTATGGAAAAACGCCAGCAACGCGGCCTTTTTACG
GTTCCTGGCCTTTTGCTGGCCTTTTGCTCACATGTTCTTTCCTGCGGTACCCAGATCCAATTCCCGCTTTGACTGCCTGAAATCTCCATCG
CCTACAATGATGACATTTGGATTTGGTTGACTCATGTTGGTATTGTGAAATAGACGCAGATCGGGAACACTGAAAAATACACAGTTATTAT
TCATTTAAATC<u>ACGGTCTTGGAGTCATCAGGCTCTGACTGGGCAGCTGCTGCAACTGGAACTTCCCAAGCCTCCCACCAAACAGCAGGTGT
AGCCGAAAGTATTCACGTGTCCCAGAATGAGGCCCACAGTACATCTGTCACCGTTTCTCAACCCCCTTCAACGGTTTCTTTGCAAATTGGA
GAAGCAAATACCCTGAAATGGTCAGCTTTCTTTGGAGTAGTAGTTCCGCTGCTCAACGTACTCTTCGTTTAAAAGCCCT</u>CCTAGG*ACAAAA
TGGCC*AAGCTGGGAAACGGGATT*TGGTGGAACTTT*ATTATTCTTTCTACGATCCAAGCATTATGTTGTGGAACAAAGCGAATACTCT*TATT
AGCTGG*TAATTGAGCGAGTTGAAAAAATCAAGTCTA*TTGGAGGGT*ATGGTCAGAGTACTGATAGAGATCCCTGTTAAGATAATCGATCTTT
TTCAAATATCCAATTTCATTCCATCTTGCCATCGGGTCTTGGCTT*CTTACAT*CAATAATTAAAACTACTTACTCTATTAGTGCCAAAAATG
GTAAACCGTATTCAAATTGCTGCAAGCATATGCTTAAAAGGATCGCGTTGCGAGCTTCTTTTGAGATTCGCAAGCTTGATTTTATGCTCTT
GTGGGAAGAAAAGCAACCCACTGAATTCCAGATTTGTTGTGTTTTCATGCATGGACGACATACTTTGAGTAATACCGTTACTGAGATTTTA
CCGAATTCGCATTGCGTTGAGGCGTGAAGTTTCTTAATGCTGTGCCATATGGTTAAGTTGCGTTTCAAGATGGTCCACAAGTATTTTTGTA
TTTAAGCAGTGTCAATTCAAGCCTAACTGCTCATAAAAACTACACGGTTTGCTGATATCAAAACGATGTAAGGGCGGCCGCAGCGAATTTC
TTATGATTTATGATTTTTATTATTAAATAAGTTATAAAAAAAATAAGTGTATACAAATTTTAAAGTGACTCTTAGGTTTTAAAACGAAAAT
TCTTATTCTTGAGTAACTCTTTCCTGTAGGTCAGGTTGCTTTCTCAGGTATAGCATGAGGTCGCTCTTATTGACCACACCTCTACCGGCAT
GCCGAGCAAATGCCTGCAAATCGCTCCCCATTTCACCCAATTGTAGATATGCTAACTCCAGCAATGAGTTGATGAATCTCGGTGTGTATTT
TATGTCCTCAGAGGACAAGGATCCTTCAGTAATGTCTTGTTTCTTTTGTTGCAGTGGTGAGCCATTTTGACTTCGTGAAAGTTTCTTTAGA
ATAGTTGTTTCCAGAGGCCAAACATTCCACCCGTAGTAAAGTGCAAGCGTAGGAAGACCAAGACTGGCATAAATCAGGTATAAGTGTCGAG
CACTGGCAGGTGATCTTCTGAAAGTTTCTACTAGCAGATAAGATCCAGTAGTCATGCATATGGCAACAATGTACCGTGTGGATCTAAGAAC
GCGTCCTACTAACCTTCGCATTCGTTGGTCCAGTTTGTTGTTATCGATCAACGTGACAAGGTTGTCGATTCCGCGTAAGCATGCATACCCA
AGGACGCCTGTTGCAATTCCAAGTGAGCCAGTTCCAACAATCTTTGTAATATTAGAGCACTTCATTGTGTTGCGCTTGAAAGTAAAATGCG
AACAAATTAAGAGATAATCTCGAAACCGCGACTTCAAACGCCAATATGATGTGCGGCACACAATAAGCGTTCATATCCGCTGGGTGACTTT
CTCGCTTTAAAAAATTATCCGAAAAAATTTTCTAGAGTGTTGACACTTTATACTTCCGGCTCGTATAATACGACAAGGTGTAAGGAGGACT
AAACCATGGCTAAACTCACCTCTGCTGTTCCAGTCCTGACTGCTCGTGATGTTGCTGGTGCTGTTGAGTTCTGGACTGATAGACTCGGTTT
CTCCCGTGACTTCGTAGAGGACGACTTTGCCGGTGTTGTACGTGACGACGTTACCCTGTTCATCTCCGCAGTTCAGGACCAGGTTGTGCCA
GACAACACTCTGGCATGGGTATGGGTTCGTGGTCTGGACGAACTGTACGCTGAGTGGTCTGAGGTCGTGTCTACCAACTTCCGTGATGCAT
CTGGTCCAGCTATGACCGAGATCGGTGAACAGCCCTGGGGTCGTGAGTTTGCACTGCGTGATCCAGCTGGTAACTGCGTGCATTTCGTCGC
AGAAGAGCAGGACTAACCTCTAGGACACCTTACGATTATTTAGAGAGTATTTATTAGTTTTATTGTATGTATACGGATGTTTTATTATCTA
TTTATGCCCTTATATTCTGTAACTATCCAAAAGTCCTATCTTATCAAGCCAGCAATCTATGTCCGCGAACGTCAACTAAAAATAAGCTTTT
TATGCTCTTCTCTCTTTTTTTCCCTTCGGTATAATTATACCTTGCATCCACAGATTCTCCTGCC

A: Expression vector pGAP with DLX521 as GOI

Fig. 11 (continued)

B: Full sequence of pGAP with DLX521 as GOI (SEQ ID NO: 66)

```
TCCAAAACCCATATTGCCTACGCATGTATAGGTGTTTTTTCCACAATATTTTCTCTGTGCTCTCTTTTTATTAAAGAGAAGCTCTATATCG
GAGAAGCTTCTGTGGCCGTTATATTCGGCCTTATCGTGGGACCACATTGCCTGAATTGGTTTGCCCCGGAAGATTGGGGAAACTTGGATCT
GATTACCTTAGCTGCAGGTACCACTGAGCGTCAGACCCCGTAGAAAAGATCAAAGGATCTTCTTGAGATCCTTTTTTTCTGCGCGTAATCT
GCTGCTTGCAAACAAAAAAACCACCGCTACCAGCGGTGGTTTGTTTGTCGGATCAAGAGCTACCAACTCTTTTTCCGAAGGTAACTGGCTT
CAGCAGAGCGCAGATACCAAATACTGTTCTTCTAGTGTAGCCGTAGTTAGGCCACCACTTCAAGAACTCTGTAGCACCGCCTACATACCTC
GCTCTGCTAATCCTGTTACCAGTGGCTGCTGCCAGTGGCGATAAGTCGTGTCTTACCGGGTTGGACTCAAGACGATAGTTACCGGATAAGG
CGCAGCGGTCGGGCTGAACGGGGGGTTCGTGCACACAGCCCAGCTTGGAGCGAACGACCTACACCGAACTGAGATACCTACAGCGTGAGCT
ATGAGAAAGCGCCACGCTTCCCGAAGGGAGAAAGGCGGACAGGTATCCGGTAAGCGGCAGGGTCGGAACAGGAGAGCGCACGAGGGAGCTT
CCAGGGGGAAACGCCTGGTATCTTTATAGTCCTGTCGGGTTTCGCCACCTCTGACTTGAGCGTCGATTTTTGTGATGCTCGTCAGGGGGGC
GGAGCCTATGGAAAAACGCCAGCAACGCGGCCTTTTTACGGTTCCTGGCCTTTTGCTGGCCTTTTGCTCACATGTTCTTTCCTGCGGTACC
CAGATCCAATTCCCGCTTTGACTGCCTGAAATCTCCATCGCCTACAATGATGACATTTGGATTTGGTTGACTCATGTTGGTATTGTGAAAT
AGACGCAGATCGGGAACACTGAAAAATACACAGTTATTATTCATTTAAATTTTTTGTAGAAATGTCTTGGTGTCCTCGTCCAATCAGGTAG
CCATCTCTGAAATATCTGGCTCCGTTGCAACTCCGAACGACCTGCTGGCAACGTAAAATTCTCCGGGGTAAAACTTAAATGTGGAGTAATG
GAACCAGAAACGTCTCTTCCCTTCTCTCTCCTTCCACCGCCCGTTACCGTCCCTAGGAAATTTTACTCTGCTGGAGAGCTTCTTCTACGGC
CCCCTTGCAGCAATGCTCTTCCCAGCATTACGTTGCGGGTAAAACGGAGGTCGTGTACCCGACCTAGCAGCCCAGGGATGGAAAAGTCCCG
GCCGTCGCTGGCAATAATAGCGGGCGGACGCATGTCATGAGATTATTGGAAACCACCAGAATCGAATATAAAAGGCGAACACCTTTCCCAA
TTTTGGTTTCTCCTGACCCAAAGACTTTAAATTTAATTTATTTGTCCCTATTTCAATCAATTGAACAACTATCAAAACACAGAATTCAAAA
CGATGCGTTTCCCATCGATTTTCACAGCTGTTCTGTTTGCAGCTTCATCTGCTTTAGCTGCACCTGTTAACACAACTACAGAGGACGAAAC
GGCCCAGATCCCAGCTGAGGCAGTCATTGGTTATTCCGATTTGGAAGGTGATTTCGATGTCGCTGTGTTACCATTCAGTAATTCCACAAAT
AACGGTTTGCTGTTCATTAACACCACTATAGCAAGCATCGCTGCAAAAGAGGAAGGTGTTTCCCTAGAAAAGAGGGCCCAGTCCGTTTTGA
CTCAACCCCCTTCCGTATCCGCAGCTCCAGGCCAAAAAGTAACGATCTCTTGTTCAGGTTCCACTAGTAACATAGGTGACAATTATGTGTC
ATGGTACCAACAGTTGCCCGGAACTGCCCCTCAACTGCTGATCTACGACAATACCAAGAGGCCGTCAGGTATCCCAGACAGATTTTCCGGT
TCTAAGAGCGGCACATCGGCTACACTAGGTATCACGGGACTTCAAACCGGCGACGAGGCAGATTACTACTGCGCAACTTGGGATAATGATA
AGTGGGGAGTTGTTTTTGGAGGTGGTACTAAACTCGAAGTCTTGGGTGGTGGAGGAGGATCAGGAGGAGGAGGTTCTGGAGGAGGTGGTTC
ATCTGGCGGTGGATCTGAAGTGCAGCTTGTGGAGAGTGGTGGTGGTTTGGTTCAACCAGGAGGTAGCTTGAGACTGTCATGTGCCGCCAGC
GGTTTTACTTTCTCCTCCTATGCAATGTCTTGGGTCAGACAAGCACCTGGTAAGGGTTTGGAATGGGTATCAGCTATTTCGGGTAGTGGTG
GTTCGACATATTATGCTGACTCCGTTAAAGGTCGTTTTACTATTTCTAGAGACAATTCCAAAAATACCTTATATCTTCAAATGAACTCCCT
TAGAGCTGAGGATACTGCTGTTTACTACTGTGCTCGTGATGCTTGGTTGGATGTGTTGTCTGACGGCTTTGACTACTGGGGACAAGGTACT
TTGGTCACAGTGAGCAGCTGAGGGGCGGCCGCTCAAGAGGATGTCAGAATGCCATTTGCCTGAGAGATGCAGGCTTCATTTTTGATACTTT
TTTATTTGTAACCTATATAGTATAGGATTTTTTTTGTCATTTTGTTTCTTCTCGTACGAGCTTGCTCCTGATCAGCCTATCTCGCAGCAGA
TGAATATCTTGTGGTAGGGGTTTGGGAAAATCATTCGAGTTTGATGTTTTTCTTGGTATTTCCCACTCCTCTTCAGAGTACAGAAGATTAA
GTGAAACCTTCGTTTGTGCGGATCCTTCAGTAATGTCTTGTTTCTTTTGTTGCAGTGGTGAGCCATTTTGACTTCGTGAAAGTTTCTTTAG
AATAGTTGTTTCCAGAGGCCAAACATTCCACCCGTAGTAAAGTGCAAGCGTAGGAAGACCAAGACTGGCATAAATCAGGTATAAGTGTCGA
GCACTGGCAGGTGATCTTCTGAAAGTTTCTACTAGCAGATAAGATCCAGTAGTCATGCATATGGCAACAATGTACCGTGTGGATCTAAGAA
CGCGTCCTACTAACCTTCGCATTCGTTGGTCCAGTTTGTTGTTATCGATCAACGTGACAAGGTTGTCGATTCCGCGTAAGCATGCATACCC
AAGGACGCCTGTTGCAATTCCAAGTGAGCCAGTTCCAACAATCTTTGTAATATTAGAGCACTTCATTGTGTTGCGCTTGAAAGTAAAATGC
GAACAAATTAAGAGATAATCTCGAAACCGCGACTTCAAACGCCAATATGATGTGCGGCACACAATAAGCGTTCATATCCGCTGGGTGACTT
TCTCGCTTTAAAAAATTATCCGAAAAAATTTTCTAGAGTGTTGTTACTTTATACTTCCGGCTCGTATAATACGACAAGGTGTAAGGAGGAC
TAAACCATGGCTAAACTCACCTCTGCTGTTCCAGTCCTGACTGCTCGTGATGTTGCTGGTGCTGTTGAGTTCTGGACTGATAGACTCGGTT
TCTCCCGTGACTTCGTAGAGGACGACTTTGCCGGTGTTGTACGTGACGACGTTACCCTGTTCATCTCCGCAGTTCAGGACCAGGTTGTGCC
AGACAACACTCTGGCATGGGTATGGGTTCGTGGTCTGGACGAACTGTACGCTGAGTGGTCTGAGGTCGTGTCTACCAACTTCCGTGATGCA
TCTGGTCCAGCTATGACCGAGATCGGTGAACAGCCCTGGGGTCGTGAGTTTGCACTGCGTGATCCAGCTGGTAACTGCGTGCATTTCGTCG
CAGAAGAGCAGGACTAACAATTGACACCTTACGATTATTTAGAGAGTATTTATTAGTTTTATTGTATGTATACGGATGTTTTATTATCTAT
TTATGCCCTTATATTCTGTAACTATCCAAAAGTCCTATCTTATCAAGCCAGCAATCTATGTCCGCGAACGTCAACTAAAAATAAGCTTTTT
ATGCTCTTCTCTCTTTTTTTCCCTTCGGTATAATTATACCTTGCATCCACAGATTCTCCTGCCAAATTTTGCATAATCCTTTACAACATGG
CTATATGGGAGCACTTAGCGCCC
```

Fig. 12 A: Deep well plate expression of HSA fused to the LLP-signal sequence
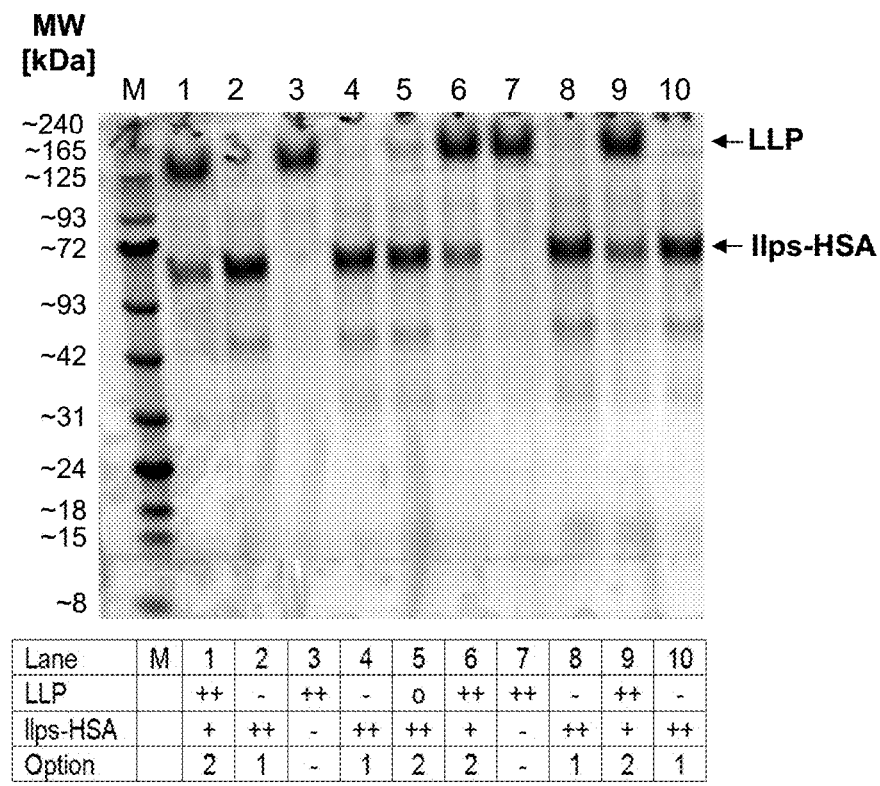
Fig. 12 B: Fermenter expression of HSA fused to the LLP-signal sequence
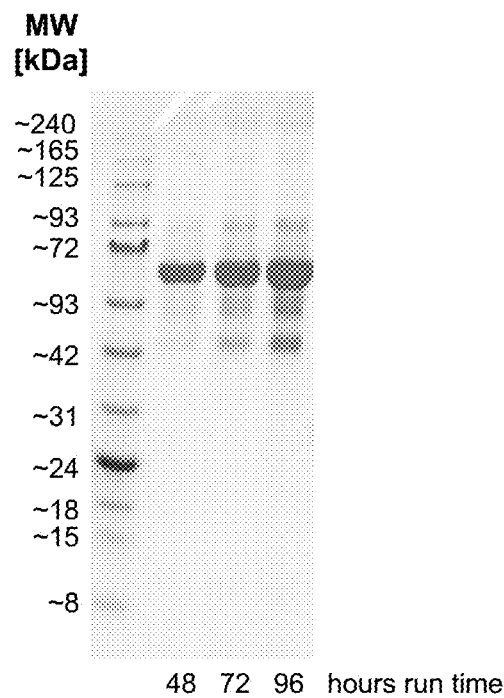

Fig. 13: Truncation-analysis of the LLP-promoter
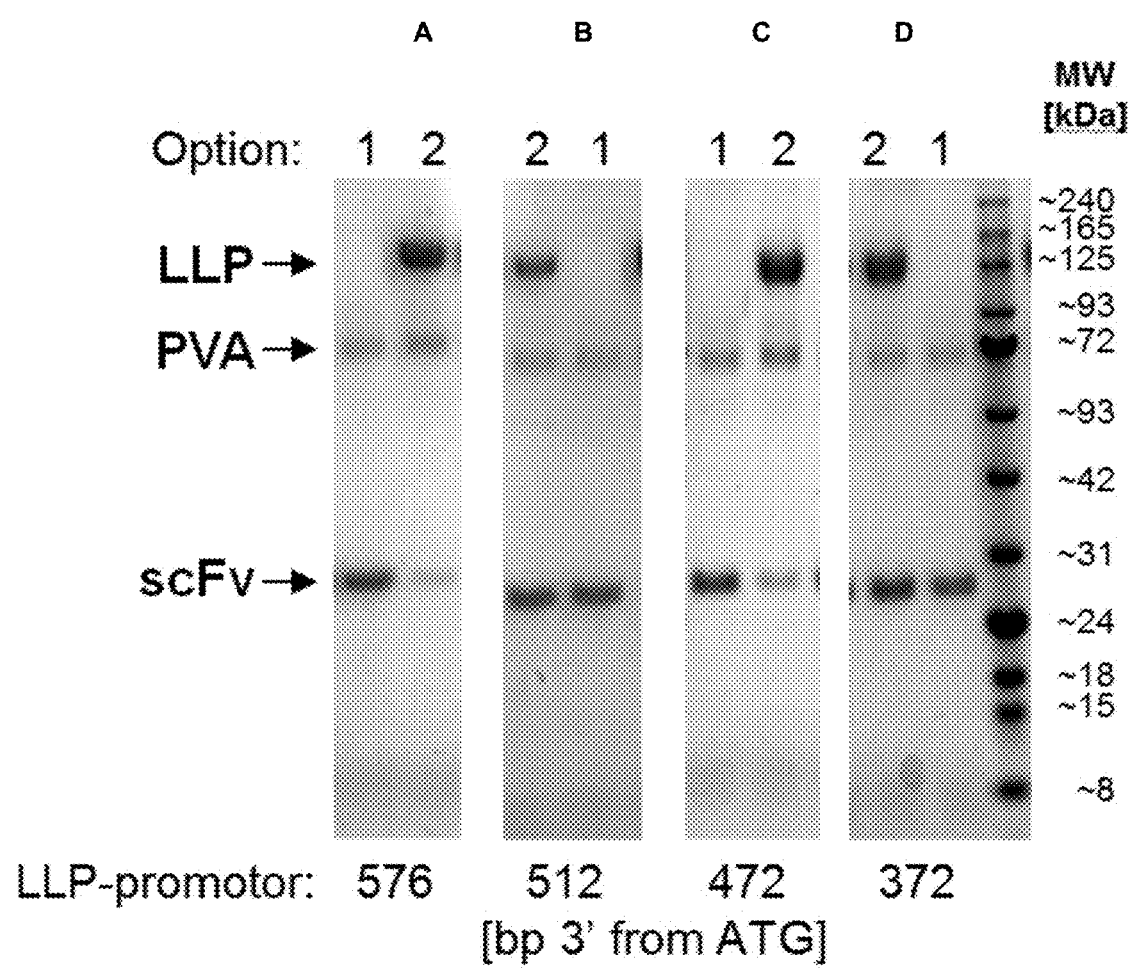

Fig. 14: Sequences S. cerevisae ssn6 and TUP1 (complete coding region)

A. Ssn6-nucleic acid (cyc8 = ssn6): SEQ ID NO: 135

>gi|398364854|ref|NM_001178460.3| Saccharomyces cerevisiae S288c
transcription regulator CYC8 (CYC8), partial mRNA

```
ATGAATCCGGGCGGTGAACAAACAATAATGGAACAACCCGCTCAACAGCAACAACAACAGCAACAACAACAGCAG
CAACAGCAACAGCAGGCAGCAGTTCCTCAGCAGCCACTCGACCCATTAACACAATCAACTGCGGAAACTTGGCTC
TCCATTGCTTCTTTGGCAGAAACCCTTGGTGATGGCGACAGGGCCGCAATGGCATATGACGCCACTTTACAGTTC
AATCCCTCATCTGCAAAGGCTTTAACATCTTTGGCTCACTTGTACCGTTCCAGAGACATGTTCCAAAGAGCTGCA
GAATTATATGAAAGAGCACTTTTGGTAAATCCCGAACTATCAGATGTGTGGGCTACTTTAGGTCATTGTTATCTG
ATGCTGGATGATCTGCAAAGAGCTTACAATGCCTATCAACAGGCTCTCTACCACCTCAGTAATCCCAACGTACCG
AAATTATGGCATGGAATCGGCATTCTTTATGACAGATATGGTTCGCTCGACTATGCCGAAGAAGCTTTTGCCAAA
GTTTTGGAATTGGACCCTCATTTTGAAAAGGCAAACGAAATTTACTTCAGACTAGGTATTATTTATAAACATCAG
GGTAAATGGTCTCAAGCTTTGGAATGCTTCAGATACATTCTCCCTCAACCTCCTGCTCCCTTGCAGGAGTGGGAC
ATATGGTTTCAGTTGGGTAGTGTTTTGGAGAGTATGGGAGAGTGGCAAGGTGCGAAGGAAGCCTACGAGCATGTC
TTGGCTCAAAATCAACATCATGCCAAAGTATTACAACAATTAGGTTGTCTTTACGGTATGAGTAACGTACAATTT
TATGACCCTCAAAAGGCATTGGATTATCTTCTAAAGTCGTTAGAAGCAGATCCCTCCGATGCCACTACATGGTAC
CATCTCGGTAGAGTGCATATGATTAGAACAGATTATACTGCCGCATATGATGCTTTCCAACAAGCTGTTAATAGA
GATTCAAGAAACCCTATCTTTTGGTGCTCAATCGGTGTTTTATATTACCAAATTTCTCAATACAGAGACGCCTTA
GACGCGTACACAAGAGCCATAAGATTAAATCCTTATATTAGTGAAGTTTGGTACGATCTAGGTACTCTTTACGAA
ACTTGTAACAACCAATTATCTGACGCCCTTGATGCGTATAAGCAAGCTGCAAGACTGGACGTAAATAATGTTCAC
ATAAGAGAAAGATTAGAAGCTTTAACAAAGCAGTTAGAAAACCCAGGCAATATAAACAAATCGAACGGTGCGCCA
ACGAATGCCTCTCCTGCCCCACCTCCTGTGATTTTACAACCTACCTTACAACCTAATGATCAAGGAAATCCTTTG
AACACTAGAATTTCAGCCCAATCTGCCAATGCTACTGCTTCAATGGTACAACAACAGCATCCTGCTCAACAAACG
CCTATTAACTCTTCTGCAACAATGTACAGTAATGGAGCTTCCCCTCAATTACAAGCTCAAGCTCAAGCTCAAGCT
CAAGCACAAGCTCAAGCACAAGCACAAGCTCAAGCACAAGCACAAGCACAAGCGCAAGCACAAGCACAAGCACAG
GCGCAAGCACAGGCACAAGCACAAGCACAAGCACATGCACAAGCGCAAGCACAAGCACAAGCACAGGCACAAGCA
CAAGCACAGGCGCAGGCACAACAACAACAACAACAACAGCAACAACAACAACAACAACAACAACAACAACAACAA
CAACAACAACAACAACAACAACAACAGCAGCAGCAATTACAGCCCCTACCAAGACAACAGCTGCAGCAAAAGGGA
GTTTCTGTGCAAATGTTAAATCCTCAACAAGGGCAACCATATATCACACAGCCAACAGTCATACAAGCTCACCAA
CTGCAACCATTTTCTACACAAGCTATGGAACATCCGCAAAGCTCTCAACTGCCACCTCAACAGCAACAACTACAA
TCTGTTCAACATCCACAACAACTTCAAGGCCAGCCTCAAGCCCAAGCTCCCCAACCTTTAATCCAGCATAACGTG
GAACAGAACGTTTTACCTCAAAAGAGATACATGGAAGGTGCAATCCACACTTTAGTAGATGCCGCCGTATCCAGT
AGCACCCACACAGAGAATAACACAAAGTCTCCTCGTCAACCAACCCATGCCATTCCAACGCAAGCTCCCGCAACA
GGAATAACGAACGCTGAACCACAGGTAAAGAAGCAAAAGTTGAACTCTCCAAATTCAAACATCAACAAATTAGTA
AATACTGCTACTTCCATTGAAGAAAATGCAAAATCTGAGGTGAGCAACCAATCGCCAGCAGTAGTGGAGTCTAAT
ACCAATAATACTTCACAAGAAGAAAAACCTGTAAAAGCAAACTCAATACCTTCAGTAATTGGCGCACAGGAACCT
CCACAGGAAGCTAGTCCTGCTGAAGAAGCTACCAAAGCAGCTTCTGTTTCTCCTTCTACAAAACCGCTTAATACG
GAACCAGAGTCATCTAGTGTCCAACCAACTGTATCATCAGAAAGTTCAACAACAAAAGCAAATGACCAAAGCACT
GCTGAGACCATAGAACTTTCTACTGCTACTGTTCCTGCAGAAGCAAGCCCTGTAGAAGACGAAGTAAGACAGCAT
TCTAAAGAGGAAAACGGCACAACTGAAGCATCTGCACCTTCTACTGAAGAGGCGGAGCCAGCAGCTTCCAGAGAT
GCTGAAAAACAACAAGATGAAACCGCTGCTACAACGATAACTGTAATCAAACCTACTTTGGAAACAATGGAAACA
GTGAAAGAGGAGGCCAAAATGCGTGAGGAAGAGCAAACATCTCAAGAAAATCCCCACAGGAGAACACACTTCCA
AGAGAAAATGTAGTAAGGCAAGTGGAAGAAGATGAAAACTACGACGACTAA
```

B. SSN6-Protein (SEQ ID NO: 137)
>NP_009670.3_SSN6_Saccharomyces cerevisiae

```
MNPGGEQTIMEQPAQQQQQQQQQQQQQQQAAVPQQPLDPLTQSTAETWLSIASLAETLGDGDRAAMAYDATLQF
NPSSAKALTSLAHLYRSRDMFQRAAELYERALLVNPELSDVWATLGHCYLMLDDLQRAYNAYQQALYHLSNPNVP
KLWHGIGILYDRYGSLDYAEEAFAKVLELDPHFEKANEIYFRLGIIYKHQGKWSQALECFRYILPQPPAPLQEWD
IWFQLGSVLESMGEWQGAKEAYEHVLAQNQHHAKVLQQLGCLYGMSNVQFYDPQKALDYLLKSLEADPSDATTWY
HLGRVHMIRTDYTAAYDAFQQAVNRDSRNPIFWCSIGVLYYQISQYRDALDAYTRAIRLNPYISEVWYDLGTLYE
TCNNQLSDALDAYKQAARLDVNNVHIRERLEALTKQLENPGNINKSNGAPTNASPAPPPVILQPTLQPNDQGNPL
NTRISAQSANATASMVQQQHPAQQTPINSSATMYSNGASPQLQAQAQAQAQAQAQAQAQAQAQAQAQAQAQAQAQ
AQAQAQAQAHAQAQAQAQAQAQAQAQQQQQQQQQQQQQQQQQQQQQQQQQLQPLPRQQLQQKG
VSVQMLNPQQGQPYITQPTVIQAHQLQPFSTQAMEHPQSSQLPPQQQQLQSVQHPQQLQGQPQAQAPQPLIQHNV
EQNVLPQKRYMEGAIHTLVDAAVSSSTHTENNTKSPRQPTHAIPTQAPATGITNAEPQVKKQKLNSPNSNINKLV
NTATSIEENAKSEVSNQSPAVVESNTNNTSQEEKPVKANSIPSVIGAQEPPQEASPAEEATKAASVSPSTKPLNT
```

Fig. 14 (continued)

EPESSSVQPTVSSESSTTKANDQSTAETIELSTATVPAEASPVEDEVRQHSKEENGTTEASAPSTEEAEPAASRD
AEKQQDETAATTITVIKPTLETMETVKEEAKMREEEQTSQEKSPQENTLPRENVVRQVEEDENYDD

C. Tup1-nucleic acid (SEQ ID NO: 136)

>gb|M35861.1|YSCAER2:247-2388 S.cerevisiae heme-regulated and catabolite
repressed genes repressor (TUP1) gene, complete cds ATGACTGCCAGCGTTTCGAATACGCAGAATAAGCTGAATGAGCTTCTCGATGCCATCAGACAGGAGTTTCTCCAA
GTCTCACAAGAGGCAAATACCTACCGTCTTCAAAACCAAAAGGATTACGATTTCAAAATGAACCAGCAGCTGGCT
GAGATGCAGCAGATAAGAAACACCGTCTACGAACTGGAACTAACTCACAGGAAAATGAAGGACGCGTACGAAGAA
GAGATCAAGCACTTGAAACTAGGGCTGGAGCAAAGAGACCATCAAATTGCATCTTTGACCGTCCAGCAACAGCGG
CAACAGCAACAGCAGCAACAGGTCCAGCAGCATTTACAACAGCAACAGCAGCAGCTAGCCGCTGCATCTGCATCT
GTTCCAGTTGCGCAACAACCACCGGCTACTACTTCGGCCACCGCCACTCCAGCAGCAAACACAACTACTGGTTCG
CCATCGGCCTTCCCAGTACAAGCTAGCCGTCCTAATCTGGTTGGCTCACAGTTGCCTACCACCACTTTGCCTGTG
GTGTCCTCAAACGCCCAACAACAACTACCACAACAGCAACTGCAACAGCAGCAACTTCAACAACAGCAACCACCT
CCCCAGGTTTCCGTGGCACCATTGAGTAACACAGCCATCAACGGATCTCCTACTTCTAAAGAGACCACTACTTTA
CCCTCTGTCAAGGCACCTGAATCTACGTTGAAAGAAACTGAACCGGAAAATAATAATACCTCGAAGATAAATGAC
ACCGGATCCGCCACCACGGCCACCACTACCACCGCAACTGAAACTGAAATCAAACCTAAGGAGGAAGACGCCACC
CCGGCTAGTTTGCACCAGGATCACTACTTAGTCCCTTATAATCAAAGAGCAAACCACTCTAAACCTATCCCACCT
TTCCTTTTGGATCTAGATTCCCAGTCTGTTCCCGATGCTCTGAAGAAGCAAACAAATGATTATTATATTTTATAC
AACCCGGCACTACCAAGAGAAATTGACGTTGAGTTACACAAATCTTTGGATCATACTTCAGTTGTTTGTTGCGTG
AAGTTCAGTAACGATGGTGAATACTTAGCCACAGGCTGCAACAAAACTACTCAAGTGTATCGCGTTTCAGATGGT
TCTCTGGTGGCCCGTCTATCTGACGATTCTGCTGCCAATAACCATCGAAATTCGATCACTGAAAATAACACCACC
ACGTCCACGGATAACAATACAATGACAACCACTACTACCACCACAATTACTACCACAGCGATGACTTCGGCAGCA
GAATTGGCAAAAGATGTGGAAAACCTGAACACTTCGTCTTCCCCATCATCCGACTTGTATATCCGTTCAGTGTGT
TTTTCTCCAGATGGGAAATTTTTGGCAACAGGTGCTGAAGACAGACTGATTAGAATTTGGGATATTGAAAATAGA
AAGATTGTTATGATTCTTCAAGGCCACGAACAAGATATTTATTCATTGGACTACTTTCCCTCAGGTGACAAATTA
GTCTCCGGTTCTGGTGACCGTACCGTTCGTATTTGGGACTTACGTACAGGCCAGTGTTCATTGACTTTATCCATT
GAAGATGGTGTTACCACCGTCGCTGTATCACCAGGTGATGGTAAATACATCGCTGCTGGTTCTCTAGATCGTGCT
GTGAGAGTTTGGGATTCCGAGACCGGATTCTTGGTGGAAAGACTAGATTCGGAAAACGAATCCGGTACAGGCCAC
AAGGACTCTGTTTATAGCGTTGTCTTCACTAGAGATGGACAAAGCGTTGTATCCGGCTCATTAGATAGATCTGTT
AAGCTCTGGAATTTGCAGAATGCAAACAACAAGAGCGATTCGAAAACTCCAAATTCCGGCACTTGTGAAGTTACG
TATATCGGGCATAAAGACTTTGTATTGTCCGTGGCCACCACACAAAATGATGAGTACATCTTGTCCGGTTCCAAA
GATCGTGGTGTCCTGTTTTGGGATAAGAAATCCGGCAATCCGTTATTGATGTTGCAAGGTCATAGGAATTCAGTT
ATATCTGTGGCTGTGGCAAACGGGTCTCCGCTGGGTCCAGAATATAACGTTTTTGCTACTGGTAGCGGTGATTGT
AAAGCAAGGATTTGGAAGTATAAAAAAATAGCGCCAAATTAA

D. Tup1-Protein (SEQ ID NO: 138)

MTASVSNTQNKLNELLDAIRQEFLQVSQEANTYRLQNQKDYDFKMNQQLAEMQQIRNTVYELELTHRKMKDAYEE
EIKHLKLGLEQRDHQIASLTVQQQRQQQQQQQVQQHLQQQQQQLAAASASVPVAQQPPATTSATATPAANTTTGS
PSAFPVQASRPNLVGSQLPTTTLPVVSSNAQQQLPQQQLQQQQLQQQQPPPQVSVAPLSNTAINGSPTSKETTTL
PSVKAPESTLKETEPENNNTSKINDTGSATTATTTTATETEIKPKEEDATPASLHQDHYLVPYNQRANHSKPIPP
FLLDLDSQSVPDALKKQTNDYYILYNPALPREIDVELHKSLDHTSVVCCVKFSNDGEYLATGCNKTTQVYRVSDG
SLVARLSDDSAANNHRNSITENNTTTSTDNNTMTTTTTTTITTTAMTSAAELAKDVENLNTSSSPSSDLYIRSVC
FSPDGKFLATGAEDRLIRIWDIENRKIVMILQGHEQDIYSLDYFPSGDKLVSGSGDRTVRIWDLRTGQCSLTLSI
EDGVTTVAVSPGDGKYIAAGSLDRAVRVWDSETGFLVERLDSENESGTGHKDSVYSVVFTRDGQSVVSGSLDRSV
KLWNLQNANNKSDSKTPNSGTCEVTYIGHKDFVLSVATTQNDEYILSGSKDRGVLFWDKKSGNPLLMLQGHRNSV
ISVAVANGSPLGPEYNVFATGSGDCKARIWKYKKIAPN

CONSTITUTIVE YEAST LLP PROMOTOR-BASED EXPRESSION SYSTEMS

This application is a Section 371 national phase entry of PCT application PCT/EP2016/054478, filed Mar. 2, 2016. This application also claims the benefit of the earlier filing date of European patent application 15157284.9, filed Mar. 3, 2015.

This application contains a Sequence Listing which has been submitted electronically in ASCII format and is herein incorporated by reference. The ASCII file, created on Aug. 17, 2017, is named 73091us-topto-20170830-SequenceListing.txt, and is 12,638,596 bytes in size.

FIELD OF THE INVENTION

The present invention belongs to the field of biotechnology, recombinant protein production, molecular biology, microbiology and microbial genetics. Specifically, the present invention relates to a modified eukaryotic cell, or expression system, respectively, comprising a modified gene, a polynucleotide sequence comprising said modified gene, an expression vector comprising said polynucleotiode sequence, a host cell comprising said expression vector, as well as to the use of said components.

Further, the present invention refers to methods using said components.

DESCRIPTION OF THE BACKGROUND ART

Expression systems for the expression of genes of interest (GOI) and also for the production of proteins of interest are widely known and of great importance in the field of molecular biology, microbiology and microbial genetics.

Until now, there are several expression systems known that allow the expression of certain desired genes and proteins, such as cell-based systems and cell-free systems. Cell-based systems comprise bacterial systems and eukaryotic systems, and cell-free systems are based for instance on the use of purified RNA polymerase, ribosomes, tRNA and ribonucleotides or are based on the use of systems containing cell-free protein synthesis systems such as for example rabbit reticulocyte lysates. The choice of the respectively used expression system depends on various factors such as the type of protein (eukaryotic or prokaryotic source of the protein) that is to be expressed, or whether post-translational modifications are necessary in order to ensure proper function and/or structure.

For instance, in general, if eukaryotic proteins are to be expressed, typically a eukaryotic expression system is selected. The reason therefore is that most eukaryotic proteins are modified for instance by phospohorylation, acylation, methylation, ubiquitylation or glycosylation. Bacteria are known to be no ideal host organisms for such modified proteins, as bacteria are prokaryotes which are not equipped with the full enzymatic machinery to accomplish the post-translational modifications or molecular folding that are required for many proteins to function properly. Thus, if eukaryotic proteins are to be expressed, typically expression systems using eukaryotic cells are used. Such expression systems are for instance based on yeast, fungi or insect cells. Expression systems in yeast use either inducible or non-inducible promoters for expression. Inducible promoters for methylotrophic yeast such as Pichia pastoris (P. Pastoris) often require the use of methanol as inducing substance.

Despite the known expression systems, there is still a need for an improved expression system, in particular for a eukaryotic expression system. Improvements are for instance desired with regard to the handling of the expression system, costs, safety aspects (e.g. avoiding the use of highly inflammable inducers such as methanol), complexity of the system, the time needed for expressing the proteins, or the yield of the expressed proteins.

SUMMARY OF THE INVENTION

The present invention provides the following aspects, subject-matters and preferred embodiments, which respectively taken alone or in combination, contribute to solving the object of the present invention:

(1) A modified eukaryotic cell, which is modified compared to its wildtype cell at least in that it comprises
- a modified ssn6-like gene or a modified ssn6-like related gene, and/or
- a modified expression level of SSN6-like protein or of SSN6-like related protein, or
- in that
- an ssn6-like gene or an ssn6-like related gene is deleted, respectively to the effect that
- the modified eukaryotic cell is not able to provide an SSN6-like protein or an SSN6-like related protein that exerts its wildtype function and/or wildtype activity,
- the amount of SSN6-like protein or of SSN6-like related protein being present in the modified eukaryotic cell differs from the amount of SSN6-like protein or of SSN6-like related protein being present in its wildtype form, and/or
- no SSN6-like protein or SSN6-like related protein is present in the modified cell, wherein said modified eukaryotic cell, compared to its wildtype cell, exhibits different SSN6-like protein or SSN6-like related -protein activity and/or function, preferably with respect to the proteins' ability in regulating gene expression.

In a preferred embodiment, said modified eukaryotic cell exhibits different SSN6-like protein or SSN6-like related protein activity and/or function with respect to the proteins' activity and/or function in regulating the expression of genes that are under control of the lectin-like protein (LLP) promoter.

(2) The modified eukaryotic cell according to item (1), wherein said modified eukaryotic cell exhibits reduced SSN6-like protein or SSN6-like related -protein activity and/or reduced function, or no SSN6-like protein or SSN6-like related -protein activity and/or function at all, preferably with regard to the proteins' activity and/or function in regulating gene expression, preferably in regulating the expression of genes that are under control of the LLP promoter.

(3) The modified eukaryotic cell according to item (1) or (2), wherein the ssn6-like gene and/or the ssn6-like related gene is/are modified in a regulatory sequence, such as promoter(s), enhancer(s), terminator(s), silencer(s), IRES-sequence(s), ribosome-binding site(s), and sequence(s) stabilizing or destabilizing the mRNA by secondary structure(s), and/or in a coding sequence.

(4) The modified eukryotic cell according to any of items (1) to (3), wherein the modified expression level of SSN6-like protein or of SSN6-like related protein is obtained by modifying the coding sequence of the ssn6-like gene and/or of the ssn6-like related gene.

(5) The modified eukaryotic cell according to any of items (1) to (4), wherein the total activity, function, preferably gene regulatory function, and/or amount of SSN6-like protein or SSN6-like related protein of the modified eukaryotic cell is at most 20%, preferably at most 15%, more preferably at most 10%, even more preferably at most 5% of the total activity, function and/or amount of SSN6-like protein or SSN6-like related protein of its wildtype form, and most preferably there is no activity and/or no function of the SSN6-like protein or SSN6-like related protein of the modified eukaryotic cell at all.

(6) The modified eukaryotic cell according to any of items (1) to (5), wherein the ssn6-like gene or the ssn6-like related gene and/or the expression level of the SSN6-like protein or of the SSN6-like related protein is modified by introduction of one or more point mutations, e.g. substitution, insertion or deletion of a single or more nucleotides in the polynucleotide sequence of the ssn6-like gene or of the ssn6-like related gene, partial or complete deletion of the polynucleotide sequence of the ssn6-like gene or of the ssn6-like related gene, and/or partial or complete replacement of the polynucleotide sequence of the ssn6-like gene or of the ssn6-like related gene by a different, e.g. heterologous, nucleotide sequence, wherein the polynucleotide sequence of the ssn6-like gene or of the ssn6-like related gene comprises coding and regulatory polynucleotide sequences, and wherein said regulatory polynucleotide sequences of the ssn6-like gene or of the ssn6-like related gene comprise promoters, enhancers, terminators, silencers, IRES-sequences, ribosome-binding sites, or sequences stabilizing or destabilizing the mRNA by secondary structures.

(7) The modified eukaryotic cell according to any of the preceding items, wherein said cell is a fungal cell, preferably a yeast cell, more preferably selected from the group consisting of *Saccharomyces* species (e.g., *Saccharomyces cerevisiae*), *Kluyveromyces* species (e.g., *Kluyveromyces lactis*), *Torulaspora* species, *Yarrowia* species (e.g., *Yarrowia lipolitica*), *Schizosaccharomyces* species (e.g., *Schizosaccharomyces pombe*), *Pichia* species (e.g., *Pichia pastoris* or *Pichia methanolica*), *Hansenula* species (e.g., *Hansenula polymorpha*), *Torulopsis* species, *Komagataella* species, *Candida* species (e.g., *Candida boidinii*), and *Karwinskia* species, even more preferably the eukaryotic cell is a *Pichia* cell, most preferably a *Pichia pastoris* cell according to current classification.

(8) The modified eukaryotic cell according to item (7), wherein the cell can be any *Pichia pastoris* cell, preferably a cell of a strain selected from the group consisting of NRRL Y-11430, CBS704, GS115, and KM71.

(9) The modified eukaryotic cell according to any of the preceding items, wherein said modified eukaryotic cell comprises a polynucleotide sequence which represents a modification of SEQ ID NO: 1, preferably the modified eukaryotic cell comprises SEQ ID NO: 7.

SEQ ID NO: 1 represents the coding region of the ssn6-like gene.

SEQ ID NO: 7 represents modified ssn6-like nucleotide sequence.

(10) The modified eukaryotic cell according to any of the proceding items, wherein said wildtype cell contains a SSN6-like or SSN6-like related protein, which protein comprises one or both of the consensus amino acid sequences depicted in SEQ ID NO: 63 and 64.

In other words, the eukaryotic cell, prior to its modification resulting in said modified eukaryotic cell, contained an SSN6-like or SSN6-like related protein, which protein comprised one or both of the amino acid sequences depicted in SEQ ID NO: 63 and 64.

(11) A polynucleotide sequence comprising, preferably consisting of, a modified ssn6-like gene or nucleotide sequence, e.g. as depicted in SEQ ID NO: 7, or a modified ssn6-like related gene, wherein, if said polynucleotide sequence (a) is introduced into a suitable expression system, and tried to be expressed, essentially no SSN6-like protein or SSN6-like related protein is expressed, or (b) is expressed in a suitable expression system, SSN6-like protein or SSN6-like related protein is expressed that does not exert its wildtype function and/or wildtype activity, preferably with respect to its activity and/or function in regulating gene expression, more preferably in regulating the expression of genes that are under control of the LLP promoter, and/or (c) is expressed in a suitable expression system, an amount of SSN6-like protein or SSN6-like related protein is expressed that differs from the amount of wildtype SSN6-like protein or of SSN6-like related protein.

In order to assess any of (a) to (c), the corresponding wildtype polynucleotide sequence is tried to be expressed under comparable or the same conditions, under which the modified ssn6-like gene or modified ssn6-like related gene is tried to be expressed.

(12) The polynucleotide sequence according to item (11), wherein, if said polynucleotide sequence is introduced into a suitable expression system, and tried to be expressed, or is expressed in a suitable expression system, the amount of SSN6-like protein or SSN6-like related protein is reduced, or there is essentially no, preferably no, SSN6-like protein or SSN6-like related protein at all present, compared to the amount of SSN6-like protein or SSN6-like related protein that is expressed when the corresponding wildtype polynucleotide sequence is expressed under comparable or the same conditions.

(13) The polynucleotide sequence according to item (11) or (12), wherein a regulatory sequence of the ssn6-like gene or of the ssn6-like related gene is selected from the group comprising promoters, enhancers, terminators, silencers, IRES-sequences, ribosome-binding sites, and sequences stabilizing or destabilizing the mRNA by secondary structures, preferably said regulatory sequence is selected from the group consisting of promoters, enhancers, and terminators.

(14) The polynucleotide sequence according to any of items (11) to (13), wherein the ssn6-like gene or the ssn6-like related gene has been modified as defined in item (6).

(15) The polynucleotide sequence according to any of items (11) to (14), wherein the polynucleotide sequence comprises, preferably consists of, modifications of SEQ ID NO: 1, preferably the polynucleotide sequence comprises, more preferably consists of, SEQ ID NO: 7.

(16) A nucleic acid sequence comprising the polynucleotide sequence according to any of items (11) to (15).

(17) A vector comprising the polynucleotide sequence/nucleic acid sequence according to any of items (11) to (16).

(18) A host cell comprising the vector according to item (17), or a polynucleotide according to any of items (11) to (13).

(19) The host cell according to item (18), wherein said host cell is a bacterium, preferably *Escherichia coli*.

(20) A polypeptide encoded by the polynucleotide sequence according to any of items (11) to (15).

(21) An expression vector comprising a promoter, wherein said promoter is characterized in that it is repressed in the presence of SSN6-like related protein or SSN6-like protein if said expression vector is introduced into a suitable expression system, e.g. into a eukaryotic cell as defined in item (7) or (8).

(22) The expression vector according to item (21), which further comprises one or more gene(s) of interest.

(23) The expression vector according to item (22), wherein the gene(s) of interest is/are under control of the promoter defined in item (21).

(24) The expression vector according to any of items (21) to (23), wherein said promoter is an LLP promoter, preferably an LLP promoter comprising, preferably consisting of, SEQ ID NO: 2 or 12, or consisting of a sequence having a length of 1000, 775, 675, 605, 576, 512, 472, 415, 404, 372, 305, 285, 235, 165, or 100 nucleotides counted in each case from the 3'-end of SEQ ID NO: 12, or modified versions thereof, said modified versions being characterized in that they still exhibit the promoter function.

(25) The expression vector according to any of items (21) to (24), wherein, if the promoter is an LLP promoter as defined in item (24), LLP protein is not encoded by the polynucleotide sequence of this expression vector, and preferably the gene of interest is selected from the group consisting of genes encoding enzymes, antibodies or fragments thereof, hormones, structural proteins (such as albumin), and protein-antigens being suitable for vaccines.

(26) The expression vector according to any of items (21) to (24), wherein, if the promoter is an LLP promoter as defined in item (24), LLP protein is encoded by the polynucleotide sequence of this expression vector, and preferably the gene of interest is selected from the group consisting of genes encoding enzymes, antibodies or fragments thereof, hormones, structural proteins (such as albumin), and protein-antigens being suitable for vaccines.

(27) The expression vector according to any of items (21) to (26), wherein said expression vector further comprises features selected from any one of the following: a selection marker;
(ii) a purification marker;
(iii) a signal sequence, preferably an alpha-factor secreting signal sequence, more preferably the MFalpha pre-pro signal sequence, even more preferably a signal sequence comprising or consisting of, preferably consisting of, SEQ ID NO: 14 or SEQ ID NO: 21;
(iv) an origin of replication; and/or
(v) a nucleotide sequence for targeted and/or random integration into the genome of a host cell.

In a preferred embodiment, the signal sequence (iii) of the expression vector according to item (27) comprises or consists, preferably consists of, SEQ ID NO: 14.

(28) The expression vector according to any of items (21) to (27), wherein said vector contains more than one promoter as defined in item (21), and/or wherein said vector contains more than one LLP promotor according to item (24), preferably 2, 3, 4, 5, or 6 LLP promoters according to item (24) and preferably different LLP promoters, e.g. different length LLP-promoters, according to item (24) which result in different expression rates of the genes of interest under control of said LLP promoter.

(29) The expression vector according to any of items (21) to (27), wherein said vector contains, besides one or more LLP promoters, in addition one or more other promoters different from a LLP promoter, which other promoters result in expression rates different to the expression rates of the LLP promoters.

(30) Use of an expression vector according to item (28) or (29) for the expression of a multimeric protein, said multimeric protein consisting of two or more individual protein chains, which individual protein chains are connected to each other by one or more disulfide bridges and/or which individual protein chains form a multimeric protein by other forms of protein chain-protein chain interactions.

(31) Use according to item (30) wherein said multimeric protein is expressed by transforming a cell with two or more individual vectors, wherein each vector is containing one or more promoter(s) as defined in item (21) and/or in item (24), or wherein at least one vector contains a LLP promoter and at least one vector contains other promoter different from a LLP promoter.

(32) A host cell, comprising the vector according to item (17) or any of items (21) to (29).

(33) The host cell according to item (32), wherein said host cell is a bacterium, preferably *Escherichia coli,* or the modified eukaryotic cell according to any of items (1) to (9).

(34) The modified eukaryotic cell according to any of items (1) to (10), comprising the expression vector according to any of items (21) to (29).

(35) An expression system, comprising
a) the modified eukaryotic cell as defined in any of items (1) to (10);
b) the expression vector as defined in any of items (21) to (29), wherein said expression vector can also be present in linearized form and/or at least parts of the vector being integrated into the genome of the modified eukaryotic cell.

(36) The modified eukaryotic cell according to any of items (1) to (10), further comprising a promoter as defined in item (21) or (24).

(37) The modified eukaryotic cell according to item (36), further comprising (a) gene(s) of interest being under control of the promoter as defined in item (21) or (24).

(38) The modified eukaryotic cell according to item (37), wherein the gene(s) of interest is (are) as defined in item (25).

(39) The modified eukaryotic cell according to item (37) or (38), wherein the LLP gene is not expressed in addition to the gene(s) of interest, or wherein the LLP gene is expressed in addition to the gene(s) of interest.

(40) The modified eukaryotic cell according to item (39),
wherein the LLP promoter or the LLP-like promoter controls (a) gene(s) of interest which is (are) different from LLP, and in addition another copy of said promoter controls the LLP-gene (e.g. Option 2 in FIG. 3D); or
wherein the LLP promoter or the LLP-like promoter only controls (a) gene(s) of interest which is (are) different from LLP and no LLP-gene is present (e.g. Option 1 in FIG. 3C).

(41) Use of
(A) the modified eukaryotic cell,
(B) the polynucleotide sequence,
(C) the expression vector,
(D) the host cell, or
(E) an expression system
according to any of items (1) to (40)
in a method of expressing, preferably overexpressing, gene(s) of interest.

(42) Method for determining the purity of a composition comprising the expression product of a gene of interest, comprising the following steps:

(a) expressing gene(s) of interest by using a modified eukaryotic cell according to any of items (1) to (10) and by using an expression vector according to item (25), wherein
  (a1) the modified eukaryotic cell comprises a gene encoding LLP protein under control of an LLP promoter or an LLP-like promoter, and wherein
  (a2) the expression vector comprises one or more gene(s) of interest under control of an LLP promoter or an LLP-like promoter, wherein said gene(s) of interest does (do) not encode LLP,
thereby obtaining a composition comprising the expression product of the gene(s) of interest, i.e. the protein(s) of interest, and the LLP protein;
(b) determining the amount of the expression product of the gene(s) of interest, i.e. the amount of the protein(s) of interest, and the amount of LLP protein being present in the composition obtained in step (a), wherein the amount of LLP protein compared to the amount of expression product of the gene(s) of interest, i.e. of the protein(s) of interst, is indicative for the purity of the composition obtained in step (a); and, optionally,
(c) subjecting the composition of step (a) to one or more downstream purification step(s), followed by step (b) for determining the amount of the the protein(s) of interest, and the amount of LLP protein being present in the composition obtained after having carried out said downstream purification step, i.e. monitoring host-cell-protein depletion (purity of gene of interest protein in the course of its purification).

(43) A method of expressing one or more gene(s) of interest in a eukaryotic cell comprising an ssn6-like gene or an ssn6-like related gene, wherein the translation of the mRNA transcript of the ssn6-like gene or the ssn6-like related gene is prevented by hybridizing a complementary sequence or a partial sequence thereof to the mRNA transcript.

(44) The method of item (43), wherein the partial sequence of the complementary sequence is a siRNA, antisense RNA, a ribozyme, or triplex RNA or DNA.

(45) A method of expressing one or more gene(s) of interest in a eukaryotic cell comprising an SSN6-like related expression cassette or SSN6-like expression cassette, wherein the SSN6-like related protein or the SSN6-like protein in said eukaryotic cell is modified or inhibited in its function and/or activity.

(46) The method according to item (45), wherein the SSN6-like related protein or SSN6-like protein of said eukaryotic cell is modified or inhibited in its function and/or activity in regulating the LLP promoter, preferably the SSN6-like related protein or SSN6-like protein exhibits reduced SSN6-like protein or SSN6-like related -protein activity and/or function, or no SSN6-like protein or SSN6-like related -protein activity and/or function at all.

(47) A eukaryotic cell comprising
a modified ssn6-like gene or a modified ssn6-like related gene, wherein said gene has inserted a foreign nucleotide sequence, to the effect that
  (i) the eukaryotic cell is not able to provide an SSN6-like protein or an SSN6-like related protein that exerts its wildtype function and/or wildtype activity, preferably with respect to its activity and/or function in regulating the LLP promoter or LLP-like promoter,
  (ii) the amount of SSN6-like protein or of SSN6-like related protein being present in the eukaryotic cell differs from the amount of SSN6-like protein or of SSN6-like related protein being present in its wildtype form, preferably the amount of the SSN6-like protein or of the SSN6-like related protein is reduced, and/or
  (iii) no SSN6-like protein or SSN6-like related protein is present in the eukaryotic cell,
and
a gene of interest that replaces a part or all of the coding region of the gene encoding the LLP protein, and that is under control of the LLP promoter, to the effect that essentially no LLP protein is present in the eukaryotic cell,
preferably wherein said eukaryotic cell exhibits reduced SSN6-like protein or SSN6-like related -protein activity and/or function, or no SSN6-like protein or SSN6-like related -protein activity and/or function at all.

(48) A eukaryotic cell comprising
a modified ssn6-like gene or a modified ssn6-like related gene, wherein said gene has inserted a foreign nucleotide sequence, to the effect that
  (i) the eukaryotic cell is not able to provide an SSN6-like protein or an SSN6-like related protein that exerts its wildtype function and/or wildtype activity, preferably with respect to its activity and/or function in regulating the LLP promoter,
  (ii) the amount of SSN6-like protein or of SSN6-like related protein being present in the eukaryotic cell differs from the amount of SSN6-like protein or of SSN6-like related protein being present in its wildtype form, preferably the amount of the SSN6-like protein or of the SSN6-like related protein is reduced, and/or
  (iii) no SSN6-like protein or SSN6-like related protein is present in the eukaryotic cell,
a gene of interest under control of the LLP promoter, and
an llp gene,
preferably wherein said eukaryotic cell exhibits reduced SSN6-like protein or SSN6-like related -protein activity and/or function, or no SSN6-like protein or SSN6-like related -protein activity and/or function at all.

(49) Nucleotide sequence comprising at it's 5'-end a nucleotide sequence which codes for the peptide sequence of the LLP-signalsequence and which is depicted in SEQ ID NO: 3, and further comprising a nucleotide sequence which is coding for a protein different to the native LLP-protein sequence.

(50) Use of a nucleotide sequence according to item (45) for the manufacture of a non-LLP-protein in a yeast cell, which yeast cell secreates said non-LLP-protein into the cell culture medium, due to the secretion-promoting activity of said peptide sequence of the LLP-signalsequence which is depicted in SEQ ID NO: 3.

(51) Use of a promotor comprising the LLP-promoter sequence according to SEQ ID NO: 12 (1000 bp of LLP-promoter), or according to SEQ ID NO: 2 (605 bp of LLP-promoter), or according to SEQ ID NO: 129 (576 bp of LLP-promoter), or according to SEQ ID NO: 130 (512 bp of LLP-promoter), or according to SEQ ID NO: 131 (472 bp of LLP-promoter), or according to SEQ ID NO: 132 (404 bp of LLP-promoter), or according to SEQ ID NO: 133 (372 bp of LLP-promoter), or according to SEQ ID NO: 134 (305 bp of LLP-promoter), in a vector for expression of a gene of interest, wherein said LLP-promoter sequence has at least 30%, preferably 40%, preferably 50%, preferably 60%, preferably 70%, preferably, preferably 80%, preferably 90%, preferably 95%, preferably 97%, preferably 99%, preferably 100% sequence identity with SEQ ID NO: 12.

(52) Vector comprising the LLP-promoter sequence as defined in item (51).

(53) Host cell comprising a vector according to item (52) or comprising one or more of the LLP-promoter sequences according to item (51).

(54) Nucleic acid comprising one or more of the LLP-promoter sequences according to item (51). In a preferred embodiment, the nucleic acid according to item (54) is used as a promoter, Definitions of Terms as Used Within the Meaning of the Present Invention Within the meaning of the present invention, the SSN6-like protein is a protein that comprises, preferably consists of, the amino acid sequence as depicted in SEQ ID NO: 8.

The term "ssn6-like gene" denotes a gene encoding the SSN6-like protein.

The coding region of the ssn6-like gene of *P. pastoris* is depicted in SEQ ID NO: 1.

Genes or proteins that resemble the ssn6-like gene or SSN6-like protein in respect of function, activity and sequence, or only in respect of function and activity, are denoted herein as "ssn6-like related genes" or "ssn6-like related proteins".

Within the meaning of the present invention, the term "gene" denotes a certain nucleic acid sequence that encodes a polypeptide or an RNA chain that has a function in the organism. The nucleic acid sequence comprises regulatory regions (herein also denoted as regulatory polynucleotide sequences or regulatory sequences), transcribed regions (such as regions that code for proteins, but also regions that are transcribed but do not code for proteins, such as introns) and/or other functional sequence regions.

In general, regulatory regions are primarily regions flanking the 3'- and 5'-region of the coding region of the gene, but certain regulatory regions such as Trans-regulatory elements, might be located quite distant within the same chromosome or might even be located on a different chromosome. In particular, within the meaning of the present invention, the regulatory regions of the ssn6-like (or ssn6-like related) gene comprise the flanking region being located up to 200 nucleotides up- and downstream of the 3'- and 5'-end of the ssn6-like coding region.

Examples of regulatory polynucleotide sequences are promoters, enhancers, terminators, silencers, IRES-sequences, ribosome-binding sites, and sequences stabilizing or destabilizing the mRNA by secondary structures. Within the meaning of the present invention, the term "regulatory polynucleotide sequence" denotes polynucleotide sequences that modify the expression of genes, for example the ssn6-like gene and/or of the ssn6 gene, and/or a gene of interest and/or the Llp gene.

"Protein-antigens that are suitbale for vaccines" are antigens that are able to elicit a proper, desired immune response upon vaccination. For instance, such antigens are neuraminidase (NA) or haemagglutinin (HA) of influenza virus. Further antigens that are suitbale for vaccination purpose are known to a person skilled in the art. Methods for testing the suitability of proteins for eliciting a proper immune response are known to a skilled person.

A "polynucleotide" or "nucleic acid" sequence includes DNA (desoxyribonucleic acid) or RNA (ribonucleic acid), in single stranded or double stranded form or otherwise.

In general, the term "ssn6-like gene" denotes a gene encoding the SSN6-like protein. The ssn6-like gene belongs to an evolutionary conserved family of proteins (see FIG. 9A), and it is known that certain yeasts, flies, worms and mammals contain proteins that resemble SSN6-like proteins in sequence and function/activity. These proteins are denoted herein as "SSN6-like related proteins", and the genes that encode these proteins are denoted herein as "ssn6-like related genes". Examples of yeasts that contain proteins that belong to the SSN6-like related protein family are *Pichia pastoris* (*P. Pastoris*), *Saccharomyces cerevisiae* (*S. cerevisiae*) and *Candida albicans* (*C. albicans*).

Within the meaning of the present invention, the term "ssn6-like-related protein" for example denotes the respective proteins whose NCBI (National Center for Biotechnology Information, USA) GenBank accession numbers are noted on the left hand site of FIG. 9A. FIG. 9A only shows an internal part of these sequences aligned to the corresponding sequence part of the *P. Pastoris* ssn6-like sequence (NCBI GenBank accession number CCA36593.1). In detail these proteins include XP_004181958.1 (SEQ ID NO: 24), KDQ17717.1 (SEQ ID NO: 25), CCK71477.1 (SEQ ID NO: 26), EDK38165.2 (SEQ ID NO: 27), XP_003688172.1 (SEQ ID NO: 28), XP_003667908.1 (SEQ ID NO: 29), EGA59684.1 (SEQ ID NO: 30), EDN64727.1 (SEQ ID NO: 31), AAA34545.1 (SEQ ID NO: 32), NP_009670.3 (SEQ ID NO: 33), XP_001731010.1 (SEQ ID NO: 34), CCU98386.1 (SEQ ID NO: 35), XP_646078.1 (SEQ ID NO: 36), XP_003288629.1 (SEQ ID NO: 37), CCF50299.1 (SEQ ID NO: 38), XP_761648.1 (SEQ ID NO: 39), XP_007880878.1 (SEQ ID NO: 40), EPB82504.1 (SEQ ID NO: 41), CDK26448.1 (SEQ ID NO: 42), ESW97404.1 (SEQ ID NO: 43), CCH42354.1 (SEQ ID NO: 44), CDR41214.1 (SEQ ID NO: 45), XP_002489776.1 (SEQ ID NO: 46), XP_002770760.1 (SEQ ID NO: 47), EDK37317.2 (SEQ ID NO: 48), XP_001485744.1 (SEQ ID NO: 49), XP_002619527.1 (SEQ ID NO: 50), XP_004200097.1 (SEQ ID NO: 51), XP_004199242.1 (SEQ ID NO: 52), XP_002419644.1 (SEQ ID NO: 53), BAF31137.1 (SEQ ID NO: 54), XP_719833.1 (SEQ ID NO: 55), EMG49052.1 (SEQ ID NO: 56), XP_002551300.1 (SEQ ID NO: 57), XP_001526425.1 (SEQ ID NO: 58), CCE42279.1 (SEQ ID NO: 59), XP_003868368.1 (SEQ ID NO: 60), XP_001387682.2 (SEQ ID NO: 61), XP_007376632.1 (SEQ ID NO: 62) as found in the NCBI data base.

Within the meaning of the present invention, the term "SSN6-like protein" denotes the protein comprising (preferably consisting of) the amino acid sequence as depicted in the sequence depicted in FIG. 2A (SEQ ID NO: 8).

Furthermore within the meaning of the present invention, the term "SSN6-like protein" denotes a protein comprising consensus amino acid sequences depicted in FIG. 9B or 9C, namely:

```
FIG. 9 B: Consensus sequence 1
                                      (SEQ ID NO: 63)
W(CGL)(SLTA)(IMV)G(VINSTK)LY(YFLA)(QNSRKE)(INLM)

(GNSKR)Q(NFYL)(HRETPAK)D(AST)(LI)(DGTNASE)(AV)(YF)
and/or

FIG. 9 C: Consensus sequence 2
                                      (SEQ ID NO: 64)
W(YFLED)(NDG)L(GLAS)(TSIQC)(LIV)YE(TSARKQ)(CS)

(NHSDEH)(DNK-RGF)(Q-H)(ILTHVAS)(TSNQERIAMG)D(ASV)

(LIASC)(DHNE)(SA)(YC)(EAKRQMTLNDS)(RQK)
```

The both consensus sequences are written in single letter code and groups of amino acids in brackets. Groups of amino acids in brackets means that either amino acid in the brackets can be present at that position within the consensus sequence. For example the consensus sequence in FIG. 9B starts with W at position 1, and at position 2 there can be present either C or G or L, at position 3 there can be present either S or L or T or A, etc.

The corresponding amino acid position within the context of the *P. pastoris* SSN6-like protein is given below the consensus sequences of FIGS. 9B and 9C, e.g. the Tryptophane residue (W) in position 1 of the consensus sequence in FIG. 9B corresponds to the amino acid position 352 of the *P. pastoris* SSN6-like protein sequence.

In case there is written a "-" (dash), for example at position 407 of consensus sequence in FIG. 9C, (Q-H), this means that on this position there can be either a Q, no amino acid, or a H.

Further within the meaning of the present invention, the term "ssn6-like related gene" or "SSN6-like related protein" denotes a gene or protein that resembles the ssn6-like gene or SSN6-like protein in respect of function, activity and sequence, or only in respect of function and activity.

The coding region of the ssn6-like gene of *P. Pastoris* is depicted in FIG. 1A (SEQ ID NO: 1). The amino acid sequence of the SSN6-like protein of *P. Pastoris* is depicted in FIG. 1J (SEQ ID NO: 13).

The term "llp gene" denotes a gene encoding LLP protein. SEQ ID NO: 16 depicts the nucleotide sequence of the coding region of the llp gene from *P. Pastoris,* including the signal sequence.

"Resembling with respect to function" or "resembling with respect to activity" defines that the ssn6-like related gene product, i.e. the SSN6-like related protein that is encoded by the "ssn6-like related gene", exhibits essentially the same function and activity as the SSN6-like protein of *P. Pastoris* (depicted in SEQ ID NO: 13) with regard to the LLP-promoter ("Lectin-like protein with similarity to Flo1p"), when said function and activity is compared in a suitable system when applying comparable, preferably corresponding, conditions. The function and activity that is of interest in the present invention, and thus has to be compared or assessed, respectively, is the ability of the SSN6-like protein and SSN6-like related protein, respectively, to regulate, preferably repress (reduce), and even more preferably prevent, the expression of genes that are under control of the LLP-promoter. For instance, in a wildtype situation, typically the gene that is under control of the LLP promter is a gene encoding LLP protein. In this case, in order to determine whether the SSN6-like related protein exhibits essentially the same function and/or activity as the SSN6-like protein, for instance the amount of LLP protein being present is compared, i.e. the amount of LLP protein in an expression system wherein an ssn6-like related gene (and, thus, an SSN6-like related protein) is present, compared to an expression system wherein an SSN6-like gene (and, thus, an SSN6-like protein) is present. If it is shown that the candidate ssn6-like related gene and the ssn6-like gene (and its gene products, (candidate) SSN6-like related protein and SSN6-like protein, respectively (also referred to herein as "SSN6-like/SSN6-like related protein" or "SSN6-like related/SSN6-like protein") exhibit essentially the same function/activity with regard to the LLP-promoter (and with regard to the gene that is under control of said promoter, such as the llp gene), e.g. with regard to the determined amount of LLP protein, then the candidate ssn6-like related gene is a ssn6-like related gene within the meaning of the present invention.

A promoter is defined as a DNA regulatory region capable of binding an RNA polymerase in a cell and that initiates transcription of a particular gene to which it operably links. Typically, promoters are located near the transcription start sites of the respective gene(s) that is under control of said promoter, on the same strand. FIG. 1B (SEQ ID NO: 2) and FIG. 1I (SEQ ID NO: 12) show nucleotide sequences of the LLP promoter of *P. Pastoris* (FIG. 1B=first 605 nucleotides 5' from ATG start codon, FIG. 1I=fist 1000 nucleotides 5' from ATG start codon).

Whenever reference is made herein to an LLP promoter, an "LLP-like promoter" is also comprised by this expression. Within the meaning of the present invention, an LLP-like promoter is a promoter that exhibits essentially the same function/activity as the LLP promoter, i.e. is still able to essentially exert the LLP promoter's wildtype function/activity.

In order to determine whether a candidate ssn6-like-related gene and SSN6-like-related protein, respectively, exhibits essentially the same function and activity as the ssn6-like-gene and SSN6-like protein, respectively, with respect to the LLP-promoter, any suitable method that is known to a person skilled in the art can be used. Examples of such methods are measuring the amount of LLP protein in the supernatant of a cell culture for example by Enzyme Linked Inmmunosorbent Assay (ELISA), or by western blotting, or measuring the level of LLP mRNA by northern blotting or by quantitative Polymerase Chain Reaction (qPCR) or reverse transcriptase qPCR, or measuring the activity of the LLP-promoter or LLP-like promoter ("LLP/LLP-like promoter") for example by using luciferase reporter gene assays or by using LLP-promoter-green fluorescent protein (GFP) constructs, etc. All these methods are well known to a person skilled in the art and represent routine work. A textbook comprising protocols for routine methods is for instance Sambrook et al., "Molecular Cloning: A Laboratory Manual", 4$^{th}$ Edition, Cold Spring Harbor Laboratory Press, (2012), referred to herein as Sambrook et al. Within the meaning of the present invention, a candidate ssn6-like-related gene is considered as exhibiting essentially the same function/activity as the ssn6-like-gene, if its effect (and the effect of its gene product, respectively) on the LLP protein expression is essentially the same.

Within the meaning of the present invention, the expression "essentially the same" defines a deviation of up to 20%, preferably of up to 10%, more preferably of up to 7% and even more preferably of up to 3% of a given value.

Accordingly, the expression "essentially no" defines that there is an amount/activity of the respective matter (such as protein) present (or left) that corresponds to at most 20%, preferably at most 10%, more preferably at most 7%, and even more preferably at most 3% of the respective wildtype amount/activity. "Essentially no" also includes the absence of the respective matter/amount/activity, preferably meaning below the detection limit of the methods described in this application for that matter/amount/activity.

Within the meaning of the present invention the term "reduced", e.g. "reduced" activity, "reduced" function, or "reduced" amount denotes that the total activity, function, preferably gene regulatory function, or amount of a matter (e.g. SSN6-like protein or SSN6-like related protein of the modified eukaryotic cell; or LLP promoter) is at most 20%, preferably at most 15%, more preferably at most 10%, even more preferably at most 5% of the total activity, function and/or amount of the wildtype form of this matter (e.g. SSN6-like protein or SSN6-like related protein; or LLP promoter).

It is possible that nucleotide sequences and the proteins they encode, respectively, which exhibit essentially the same function and activity as ssn6-like gene and SSN6-like protein, respectively, exhibit a comparably low degree of sequence identity such as 50%, 40% or 30% or even lower, such as 25%, 20%, 19%, 18%, 17%, 16%, 15%, 12%, 10%, or 5%. Thus, ssn6-like-related genes/SSN6-like-related proteins within the meaning of the present invention are genes/proteins that—first of all—exhibit essentially the same function/activity as the ssn6-like gene/SSN6-like protein with regard to the LLP protein (in wild type situation). Hence, in a preferred embodiment of the present invention, the term "ssn6-like-related gene" denotes genes that resemble the ssn6-like gene as defined herein in respect of function/activity, i.e. the ability of the SSN6-like-related protein being encoded by the ssn6-like-related gene to regulate the expression of genes that are under control of the LLP-promoter, and LLP-promoter sequence, respectively.

It is also possible that an SSN6-like related protein comprises the consensus amino acid sequences depicted in FIG. 9B and/or FIG. 9C.

In a further preferred embodiment of the present invention, the "ssn6-like related gene" resembles the ssn6-like gene as defined herein not only in respect of function/activity, i.e. the ability of the SSN6-like related protein being encoded by the ssn6-like related gene to regulate the expression of genes that are under control of the LLP-promoter or modified LLP promoter, and LLP-promoter sequence, respectively, but additionally originates from a microorganism being selected from the group consisting of *Komagataella pastoris* CBS 7435 (Synonym/other names: *Pichia pastoris, Pichia pastoris* CBS 7435), *Komagataella pastoris* GS115 (Synonym/other names: *Pichia pastoris, Pichia pastoris* GS115), *Scheffersomyces stipitis* CBS 6054 (Synonym/other names: *Pichia stipitis, Pichia stipitis* CBS 6054), *MNerozyma farinosa* CBS 7064 (other name: *Pichia farinosa* CBS 7064), *Candida parapsilosis, Candida orthopsilosis* Co 90-125, *Debaryomyces hansenii* CBS767, *Spathaspora passalidarum* NRRL Y-27907, *Candida albicans, Candida albicans, Candida albicans* SC5314, *Candida maltosa* Xu316, *Candida tropicalis* MYA-3404 (other name: *Candida tropicalis* T1), *Lodderomyces elongisporus* NRRL YB-4239 (other name: *Saccharomyces elongisporus*), *Clavispora lusitaniae* ATCC 4272 (genebank anamorph: *Candida lusitaniae* ATCC 42720), *Meyerozyma guilliermondii* ATCC 6260 (genebank anamorph: *Pichia guilliermondii* ATCC 6260), *Wickerhamomyces ciferrii, Ogataea parapolymorpha* DL-1 (synonym and other names: *Hansenula polymorpha, Hansenula polymorpha* DL-1, *Ogataea angusta* DL-1, *Ogataea parapolymorpha* ATCC 26012, *Ogataea parapolymorpha* DL-1, *Pichia angusta* DL-1), *Cyberlindnera fabianii* (synonyms and other names: *Hansenula fabianii, Pichia fabianii,* ... ) *Kuraishia capsulata* CBS 1993, *Dictyostelium discoideum* AX4 (belongs to social amoebae), *Tetrapisispora phaffil* CBS 4417 (synonym: *Fabospora phaffii, Dictyostelium purpureum* (belongs to social amoebae), *Pseudozyma flocculosa* PF-1, *Malassezia globosa* CBS 7966, *Botryobasidium botryosum* FD-172 SS1 (basidiomycete), *Naumovozyma dairenensis* CBS 421 (synonyme: *Saccharomyces dairenensis*), *Tetrapisispora blattae* CBS 6284, *Mucor circinelloides* f. *circinelloides* 1006PhL (Early diverging fungal lineage), *Malassezia sympodialis* ATCC 42132, *Kazachstania naganishii* CBS 8797 (*Saccharomyces naganishii*), *Saccharomyces cerevisiae* YJM789, *Saccharomyces cerevisiae* FostersB, *Saccharomyces cerevisiae, Saccharomyces cerevisiae* S288c, *Ustilago hordei* (Corn smut fungus, basidiomycete), *Meyerozyma guilliermondii* ATCC 6260 (synonym/other names: *Candida guilliermondii, Pichia guilliermondii* ATCC 6260), and *Ustilago maydis* 521 (Corn smut fungus, basidiomycete).

In a preferred embodiment, the "modified ssn6-like gene" and "modified ssn6-like related gene", and the respective proteins these genes encode, do not correspond to/are not derived from *Saccharomyces cerevisiae* ssn6 or Tup1 nucleotide or amino acid sequences, especially do not correspond to the following sequences:

SEQ ID NO: 135 (nucleotide sequence encoding SSN6)
SEQ ID NO: 136 (nucleotide sequence encoding Tup1)
SEQ ID NO: 137 (amino acid sequence of SSN6)
SEQ ID NO: 138, (amino acid sequence of Tup1).

In a further preferred embodiment, the modified eukaryotic cell comprises modified ssn6-like genes or ssn6-like related genes, but no other modified gene(s) that regulate(s) the expression of a gene that is under control of a promoter that is repressed in the presence of SSN6-like related protein or SSN6-like protein.

"Sequence identity" or "% identity" refers to the percentage of residue matches between at least two polypeptide or polynucleotide sequences aligned using a standardized algorithm. Such an algorithm may insert, in a standardized and reproducible way, gaps in the sequences being compared in order to optimize alignment between two sequences, and therefore achieve a more meaningful comparison of the two sequences. For purposes of the present invention, the sequence identity between two amino acid sequences or nucleotide is determined using the NCBI BLAST program version 2.2.29 (Jan. 06, 2014) (Altschul et al., Nucleic Acids Res. (1997) 25:3389-3402). Sequence identity of two amino acid sequences can be determined with blastp set at the following parameters: Matrix: BLOSUM62, Word Size: 3; Expect value: 10; Gap cost: Existence=11, Extension=1; Filter=low complexity activated; Filter String: L; Compositional adjustments: Conditional compositional score matrix adjustment. For purposes of the present invention, the sequence identity between two nucleotide sequences is determined using the NCBI BLAST program version 2.2.29 (Jan. 06, 2014) with blastn set at the following exemplary parameters: Word Size: 11; Expect value: 10; Gap costs: Existence=5, Extension=2; Filter=low complexity activated; Match/Mismatch Scores: 2,-3; Filter String: L; m.

Nucleic acid sequences alternatively can be characterized by their degree of complementarity. As used herein, the term "complementary" refers to the ability of purine and pyrimidine nucleotide sequences to associate through hydrogen bonding to form double-stranded nucleic acid molecules. Guanine and cytosine, adenine and thymine, and adenine and uracil are complementary and can associate through hydrogen bonding resulting in the formation of doublestranded nucleic acid molecules when two nucleic acid molecules have "complementary" sequences. The complementary DNA sequences are referred to as a "complement." In accordance with the invention "highly stringent conditions" means hybridization at 65° C. in 5× SSPE and 50% formamide, and washing at 65° C. in 0.5× SSPE. Conditions for high stringency hybridization are described in Sambrook et al., "Molecular Cloning: A Laboratory Manual", 3rd Edition, Cold Spring Harbor Laboratory Press, (2001), incorporated herein by reference. In some illustrative aspects, hybridization can occur along the full-length of the isolated nucleic acid, or along part of its length, or to a fragment thereof.

The following list indicates examples of organisms that comprise ssn6-like related genes: *Komagataella pastoris* CBS 7435 (Synonym/other names: *Pichia pastoris, Pichia pastoris* CBS 7435), *Komagataella pastoris* GS115 (Synonym/other names: *Pichia pastoris, Pichia pastoris* GS115), *Scheffersomyces stipitis* CBS 6054 (Synonym/other names:

*Pichia stipitis, Pichia stipitis* CBS 6054), *Millerozyma farinosa* CBS 7064 (other name: *Pichia farinosa* CBS 7064), *Candida parapsilosis, Candida orthopsilosis* Co 90-125, *Debaryomyces hansenii* CBS767, *Spathaspora passalidarum* NRRL Y-27907, *Candida albicans, Candida albicans, Candida albicans* SC5314, *Candida maltosa* Xu316, *Candida tropicalis* MYA-3404 (other name: *Candida tropicalis* T1), *Lodderomyces elongisporus* NRRL YB-4239 (other name: *Saccharomyces elongisporus*), *Clavispora lusitaniae* ATCC 4272 (genebank anamorph: *Candida lusitaniae* ATCC 42720), *Meyerozyma guilliermondii* ATCC 6260 (genebank anamorph: *Pichia guilliermondii* ATCC 6260), *Wickerhamomyces ciferrii, Ogataea parapolymorpha* DL-1 (synonym and other names: *Hansenula polymorpha, Hansenula polymorpha* DL-1, *Ogataea angusta* DL-1, *Ogataea parapolymorpha* ATCC 26012, *Ogataea parapolymorpha* DL-1, *Pichia angusta* DL-1), *Cyberlindnera fabianii* (synonyms and other names: *Hansenula fabianii, Pichia fabianii, . . .* ), *Kuraishia capsulata* CBS 1993, *Dictyostelium discoideum* AX4 (belongs to social amoebae), *Tetrapisispora phaffii* CBS 4417 (synonym: *Fabospora phaffii, Dictyostelium purpureum* (belongs to social amoebae), *Pseudozyma flocculosa* PF-1, *Malassezia globosa* CBS 7966, *Botryobasidium botryosum* FD-172 SS1 (basidiomycete), *Naumovozyma dairenensis* CBS 421 (synonyme: *Saccharomyces dairenensis*), *Tetrapisispora blattae* CBS 6284, *Mucor circinelloides f. circinelloides* 1006PhL (Early diverging fungal lineage), *Malassezia sympodialis* ATCC 42132, *Kazachstania naganishii* CBS 8797 (*Saccharomyces naganishii*), *Saccharomyces cerevisiae* YJM789, *Saccharomyces cerevisiae* FostersB, *Saccharomyces cerevisiae, Saccharomyces cerevisiae* S288c, *Ustilago hordei* (Corn smut fungus, basidiomycete), *Meyerozyma guilliermondii* ATCC 6260 (synonym/other names: *Candida guilliermondii, Pichia guilliermondii* ATCC 6260), *Ustilago maydis* 521, (Corn smut fungus, basidiomycete).

Within the meaning of the present invention, the term "wildtype" denotes that a certain matter is present in its natural occurring state, and thus exerts its natural function and/or activity.

A "certain matter" can for instance be an organism such as a microorganism, a cell, or, preferably, a certain protein such as the SSN6 protein or the SSN6-like protein. The wildtype state, or wildtype form, respectively, of a certain matter is distinguishable from mutant forms of said matter, as for instance structural mutant forms can result from modifications that are carried out artificially, such as by in vitro, in vivo or ex vivo modifications or manipulations. Modifications that can be carried out artificially are described elsewhere herein. An organism that comprises modifications is "modified" compared to its wildtype form with regard to the modified structure.

Within the meaning of the present invention, the term "function" defines the physiological role of a certain matter, such as the SSN6-like protein or SSN6-like related protein, and the term "activity" defines to which extent said certain matter exerts its function. An example of a physiological role of a certain matter is the regulating, preferably repressing, role of SSN6-like protein or SSN6-like related protein, on the activity of the LLP-promoter, and hence, on the expression of genes that are under control of said promoter.

Within the meaning of the present invention, the term "wildtype function" denotes the function a certain structure or matter (such as an organism, a protein, or a gene) exerts in its natural state. Accordingly, the term "wildtype activity" denotes the activity a certain structure exerts in its natural state.

Within the meaning of the present invention, an organism can be modified only with regard to a single specific structural and/or functional feature, or with regard to multiple structural and/or functional features. Specific structural and/or functional features that are modified are features that modulate (i.e. influence, either positively or negatively, preferably negatively) the expression of the ssn6 gene or ssn6-like gene.

An example of a specific feature that can be modified is for instance the nucleotide sequence of ssn6-like gene or ssn6-like related gene, with this gene comprising a coding sequence and a regulatory sequence that influences the expression of said genes as disclosed elsewhere herein.

Regulatory sequences are sequences that control the expression of certain genes. Within the meaning of the present invention, said regulatory sequences are for example sequences that control the expression of the ssn6-like gene, the ssn6-like related gene or the LLP-gene, such as promoters, enhancers, terminators, silencers, IRES-sequences, ribosome-binding sites, and sequences stabilizing or destabilizing the mRNA by secondary structures.

Within the meaning of the present invention, the term "heterologous nucleotide sequence" is a polynucleotide that does not naturally occur in the cell, e.g. because the nucleotide sequence of the polynucleotide does not naturally occur in eukaryotic cells, such as eukaryotic cells as defined elsewhere herein.

Within the meaning of the present invention, the names "*Komagataella pastoris*" and "*Pichia pastoris*" are synonymous.

The names "NRRL Y-11430, CBS7435" are synonymously used in the present invention. The genome of CBS7435 comprises chromosomes 1 to 4 and a mitochondrium. The respective nucleotide sequences have the following GenBank Accession Numbers: Chromosome 1: FR839628.1; Chromosome 2: FR839629.1; Chromosome 3: FR839630.1; Chromosome 4: FR839631.1; Mitochondrium: FR839632.1 (Publication: High-quality genome sequence of Pichia pastoris CBS7435, Kuberl A, Schneider J, Thallinger G G, Anderl I, Wibberg D, Hajek T, Jaenicke S, Brinkrolf K, Goesmann A, Szczepanowski R, Puhler A, Schwab H, Glieder A, Pichler H, J Biotechnol, volume 154 issue 4, pages 312-320 year 2011).

A "vector" is a replicon, such as plasmid, phage, bacterial artificial chromosome (BAC) or cosmid, into which another DNA segment (e.g. a foreign gene) may be inserted so as to bring about the replication of said inserted DNA segment, resulting in expression of said inserted sequence. Vectors may comprise a promoter and one or more control elements (e.g., enhancer elements) that are homologous or heterologous to said inserted DNA segment but are recognized and used by the host cell. A "replicon" is any genetic element (e.g., plasmid, chromosome, virus) that functions as a unit of DNA replication within a cell. A replicon can be an autonomous unit. This means that it is capable of replication under its own control. Within the meaning of the present invention, the vector comprises a promoter, wherein said promoter is characterized in that it is repressed in the presence of SSN6-like related protein or SSN6-like protein if said vector is introduced into a suitable host cell. In a preferred embodiment of the present invention, the vector comprises a promoter for the coding sequence of the LLP-protein and/or for the coding sequence of a protein of interest, wherein said promoter is characterized in that it is repressed in the presence of SSN6-like related protein or SSN6-like protein if said vector is introduced into a suitable host cell.

A common type of vector is a "plasmid", which generally is a self-contained molecule of double-stranded DNA, usually of bacterial origin, that can readily accept additional (foreign) DNA and which can be readily introduced into a suitable host cell. In general, vectors enable the introduction of nucleotide sequences into a host cell, so as to transform the host and, optionally, to promote expression and/or replication of the introduced sequence.

A vector often contains coding DNA and regulatory sequences such as promoter DNA and has one or more restriction sites suitable for inserting additional, e.g. foreign such as heterologous, DNA. Promoter DNA and coding DNA may be from the same gene or from different genes, and may be from the same or different organisms. Vectors, such as recombinant cloning vectors, will often include one or more replication systems for cloning or expression, one or more markers for selection in the host, e.g. antibiotic resistance, and one or more expression cassettes. Vector, or vector constructs, respectively, may be produced using conventional molecular biology and recombinant DNA techniques within the skill of the art. Such techniques are explained fully in the literature. See, e.g., Sambrook, Fritsch & Maniatis, Molecular Cloning: A Laboratory Manual, 4$^{th}$ Edition (2012) Cold Spring Harbor Laboratory Press, Cold Spring Harbor, N.Y. (herein "Sambrook et al., 2012"); DNA Cloning: A Practical Approach, Volumes I and II (D. N. Glover ed. 1985); F. M. Ausubel et al. (eds.), Current Protocols in Molecular Biology, John Wiley & Sons, Inc. (1994).

Generally, the specific structural elements of a vector depend on the intended use of said vector. For instance, in order to propagate a vector in a host cell, it may contain one or more "origins of replication" sites (often also termed "ori"), which is a specific nucleic acid sequence at which replication is initiated. Accordingly, the term "origin of replication" or "ori" refers to a nucleic acid sequence that initiates nucleic acid replication.

"Ori T" refers to an "origin of transfer" that permits the transfer of the vector from one bacterial cell to another.

Dependent on in which organism/cell the (expression) vector is intended for being used, a person skilled in the art knows which markers have to be present in the vector. If, for instance, the vector is intended for being used in yeast, amongst others, commonly used yeast markers are present, such as beta-galactosidase, Zeocin, Geneticin, URA3, HIS3, LEU2, TRP1 and LYS2. If the vector is intended for being used in bacteria such as E. coli, amongst others an ori (see above) and/or selectable markers such as genes conferring antibiotic resistance can be present.

Suitable selectable markers depend on the respective system that is used and are known to a person skilled in the art. Transformed microorganisms, that is, those containing recombinant molecules such as a vector (expression vector) or plasmid, may be selected with a variety of positive and/or negative selection methods or markers. For instance, a positive selection marker can be a gene that allows growth in the absence of an essential nutrient, such as an amino acid. A variety of suitable positive/negative selection pairs are available and known in the art. For example, various amino acid analogs known in the art could be used as a negative selection, while growth on minimal media (relative to the amino acid analog) could be used as a positive selection. Visually detectable markers are also suitable for being uses in the present invention, and may be positively and negatively selected and/or screened using technologies such as fluorescence activated cell sorting (FACS) or microfluidics. Examples of detectable markers include various enzymes, prosthetic groups, fluorescent markers, luminescent markers, bioluminescent markers, and the like. Examples of suitable fluorescent proteins include, but are not limited to, yellow fluorescent protein (YFP), green fluorescence protein (GFP), cyan fluorescence protein (CFP), umbelliferone, fluorescein, fluorescein isothiocyanate, rhodamine, dichlorotriazinylamine fluorescein, dansyl chloride, phycoerythrin and the like. Examples of suitable bioluminescent markers include, but are not limited to, luciferase (e.g., bacterial, firefly, click beetle and the like), luciferin, aequorin and the like. Examples of suitable enzyme systems having visually detectable signals include, but are not limited to, galactosidases, glucorinidases, phosphatases, peroxidases, cholinesterases and the like. In other aspects, the positive selection marker is a gene that confers resistance to a compound, which would be lethal to the cell in the absence of the gene. For example, a cell expressing an antibiotic resistance gene would survive in the presence of an antibiotic, while a cell lacking the gene would not. For instance, the presence of a tetracycline resistance gene could be positively selected for in the presence of tetracycline, and negatively selected against in the presence of fusaric acid. Suitable antibiotic resistance genes include, but are not limited to, genes such as ampicillin-resistance gene, neomycin-resistance gene, blasticidin-resistance gene, hygromycin-resistance gene, puromycin-resistance gene, chloramphenicol-resistance gene, apramycin-resistance gene, geneticin-resistance gene, zeocin-resistance gene, and the like. In certain aspects, the negative selection marker is a gene that is lethal to the target cell in the presence of a particular substrate. For example, the thyA gene is lethal in the presence of trimethoprim. Accordingly, cells that grow in the presence trimethoprim do not express the thyA gene.

In order to purify the recombinant proteins, the respective (expression) vectors used often comprise suitable purification sequences (purification markers). For instance, a vector may comprise a C-terminal c-myc epitope and polyhistidine sequence for detection and purification of the recombinant protein(s).

As described elsewhere herein, a vector can be used for introducing a nucleic acid sequence into a host cell, or into the host cell's genome, such as the genome of a yeast such as P. pastoris, or of a bacterium, such as E. coli. The introduction of (heterologous) nucleic acid into a host cell's nucleic acid is denoted as "recombination". Such a recombination process can be targeted, i.e. take place at a defined, desired site of the genome (nucleic acid sequence) it is to be introduced. In this case, the recombination is denoted as "homologous recombination" (or "targeted recombination"/ "targeted integration"). Also, the recombination process can be random ("random recombination"/"random integration"). In this case, the recombination is non-homologous.

The term "homologous recombination" refers to a type of genetic recombination, a process of physical rearrangement occurring between two different strands of DNA molecules. Homologous recombination involves the alignment of identical or similar sequences, a crossover between the aligned homologous DNA strands of the two molecules, and breaking and repair of the DNA to produce an exchange of material between the strands. Homologous recombination is distinguished from other types of recombination. For example, "site specific recombination", as exemplified by invertible elements, resolvases, and some phage integration events are examples of non-homologous recombination. Though in many cases identical or similar sequences are required at the two recombining sites, the sequences are short, distinguishing them from the longer stretches (hundreds of base pairs) used in homologous recombination. (J Rubnitz and S Subramani. 1984, Mol Cell Biol. 4: 2253-2258).

If the vector aligns in a non-homologous region of the target nucleic acid, the recombination is random.

Within the meaning of the present invention, in connection with homologous recombination, two DNA sequences are "substantially homologous" if they are able to mediate a homologous recombination. This may for instance the case when at least about 80%, preferably at least about 90% or 95%, more preferably at least about 97% or 98% of the nucleotides match over a defined length of the DNA sequences, as determined by sequence comparison algorithms known to a person skilled in the art and described elsewhere in this application. It is also possible that two DNA sequences exhibit 100% match of the nucleotides over a defined length. In this case, the two DNA sequences are homologous to each other. Within the meaning of the present invention, a DNA sequence in the vector, e,g. the expression vector, is substantially homologous, or homologous, to a desired target integration site in the host cell.

Within the meaning of the present invention, both integration/recombination events can occur, i.e. the homologous recombination and the random recombination. For instance, if it is desired to replace a certain gene (or coding sequence) by the gene of interest, then a homologous recombination will be carried out. Within the meaning of the present invention, it may be desired to replace a gene that is under the control of a promoter that is repressable by SSN6-like related or SSN6-like protein, such as a nucleic acid sequence encoding LLP protein ("Option 1" in FIG. 3C).

Within the meaning of the present invention it is however also possible that it may be desired to not replace a gene that is under the control of a promoter that is repressable by SSN6-like related or SSN6-like protein, such as a nucleic acid sequence encoding LLP protein, but to express said gene (such as the gene encoding LLP), and to additionally express the gene of interest ("Option 2" in FIG. 3D). In such a case, a random (heterologous) recombination is carried out.

Within the meaning of the present invention, the term "gene of interest" (GOI) refers to a gene that is intended for being expressed in a host cell. In the present invention, genes of interest are genes selected for example from the group encoding enzymes, antibodies or fragments thereof, hormones, structural proteins (e.g. albumin) and protein-antigens present in vaccines.

Within the meaning of the present invention, the term "expression cassette" refers to a part of vector DNA that is for instance used for cloning and/or transformation. An expression cassette comprises one or more genes and sequences controlling their expression. An expression cassette can be inserted in a nucleotide sequence such as a genome for instance by means of homologous recombination or by heterologous recombination.

Within the meaning of the present invention, the term "host cell" denotes any cell that, under suitable conditions, is capable of propagating or expressing a vector such as an expression vector. For instance, in the present invention an expression vector can comprise a promoter, wherein said promoter is characterized in that it is repressed in the presence of SSN6-like protein or SSN6-like related protein.

The host cell that comprises a vector can be any suitable host cell, such as a bacterial cell, preferably an *E. coli* cell. It is also possible that the vector, such as the expression vector, is present in a eukaryotic cell. In this case, the host cell is said eukaryotic cell. If, as described elsewhere herein, said eukaryotic cell is modified with regard to the ssn6-like gene, ssn6-like related gene, SSN6-like protein or SSN6-like related protein, the eukaryotic cell is denoted as "modified eukaryotic cell". In a preferred embodiment of the present invention, the eukaryotic cell is a fungal cell, preferably a yeast cell, more preferably selected from the group consisting of *Saccharomyces, Kluyveromyces, Candida, Hansenula, Pichia, Komagataella* and *Torulopsis*, even more preferably the eukaryotic cell is a *Pichia* cell, most preferably a *Pichia pastoris* cell.

If the expression vector is intended for being present in a eukaryotic cell, which may be modified or not, it is preferred that the expression vector comprises features selected from any one of the following: a selection marker; a purification marker; a signal sequence, preferably the yeast alpha-factor secreting signal sequence, the yeast KILM1 signal peptide, the yeast PHO1 signal peptide, or the yeast SUC2 signal peptide, more preferably an alpha-factor secreting signal sequence, even more preferably the MFalpha pre-pro signal sequence; an origin of replication; and/or a nucleotide sequence for targeted (option 1, of FIG. 3C) and/or random integration (option 2, FIG. 3D) into the genome of a host cell.

Within the meaning of the present invention, the eukaryotic cells that are used are modified compared to their wildtype cell. This means that the modified eukaryotic cell (at least) comprises a modified ssn6-like related gene or a modified ssn6-like gene; and/or a modified, preferably reduced, expression level of SSN6-like related protein or of SSN6-like protein, or that an ssn6-like related gene or an ssn6-like gene is deleted resulting in the complete lack of said SSN6-like related protein or complete lack of said SSN6-like protein.

The effect of the respective modifications is that the modified eukaryotic cell is not able to provide an SSN6-like related protein or an SSN6-like protein that exerts its wildtype function and/or wildtype activity, preferably with respect to regulating the LLP promoter; and/or the amount of SSN6-like related protein or of SSN6-like protein being present in the modified eukaryotic cell differs (preferably in that it is reduced) from the amount of SSN6-like related protein or of SSN6-like protein being present in its wildtype form; and/or no SSN6-like related protein or SSN6-like protein is present in the modified cell. This, in turn, has the effect that said modified eukaryotic cell, compared to its wildtype cell, exhibits different (preferably reduced) SSN6-like related protein or SSN6-like protein activity and/or function, preferably with respect to its activity and/or function in regulating the LLP promoter.

As described elsewhere herein, if the modified eukaryotic cell is not able to provide a proper, sufficiently working SSN6-like related protein or SSN6-like protein (e.g. in terms of function, activity, and/or amount), as a result the regulatory sequences that are controlled by said protein, such as promoters, like the LLP promoter, are not affected in their function (e.g. are not repressed) any more. This, in turn, results in an overexpression of the protein that is under control of said regulatory polynucleotide sequence.

In other words, proper, sufficiently working SSN6-like related protein or SSN6-like protein represses the LLP promoter, which means that the LLP promoter exhibits reduced function, when compared to the function of the LLP promoter that is not repressed by said proteins. As to the term "reduced", reference is made to the description elsewhere herein.

Within the meaning of the present invention, the term "overexpression" defines that the expression of a protein (encoded for instance by the gene of interest) in a cell such as a (modified) eukaryotic cell is at levels greater than normal in a wildtype cell. For instance, in the present invention the modified eukaryotic cell can be used in order to overexpress a gene of interest.

Within the meaning of the present invention, the term "modification" denotes any suitable amendment that is known to a person skilled in the art that can be applied to a nucleotide sequence or gene, respectively, that results in one or more of the following effects (if the modified nucleotide sequence is expressed in a suitable expression system): the SSN6-like or SSN6-like related protein does not exert its wildtype function and/or wildtype activity; the amount of SSN6-like or SSN6-like related protein being present is lower as compared to non-modified cells; and/or no SSN6-like or SSN6-like related protein is present at all. In an embodiment of the present invention, the nucleotide sequence of the ssn66-like or ssn66-like related gene, respecticely, is modified by introduction of a point mutation, e.g. substitution, insertion or deletion of a single or more nucleotides; by partial or complete deletion; and/or by replacement by a different, e.g. heterologous, nucleotide sequence.

It is also possible that the expression level of the affected SSN6-like or SSN6-like related protein is modified, for instance by introduction of a point mutation, e.g. substitution, insertion or deletion of a single or more nucleotides in regulatory polynucleotide sequences of the affected ssn6-like or ssn6-like related nucleotide sequence or ssn6-like or ssn6-like related gene, respectively; by partial or complete deletion of regulatory polynucleotide sequences of the affected ssn6-like or ssn6-like related nucleotide sequence or ssn6-like or ssn6-like related gene, respectively; and/or by replacement of the regulatory polynucleotide sequences of the affected ssn6-like or ssn6-like related nucleotide sequence or ssn6 or ssn6-like gene, respectively, by different, e.g. heterologous, nucleotide sequences. The regulatory polynucleotide sequences are selected from the group as defined elsewhere herein.

In order to assess whether a modification in the meaning of the present invention has been carried out on a nucleotide sequence, suitable sequence alignments can be carried out: For instance, the sequence of the potentially modified polynucleotide sequence can be aligned with the respective wildtype counterpart. The resulting alignment indicates whether a modification has been carried out, and if so, which kind of modification.

Within the meaning of the present invention, the term "coding sequence" denotes a nucleotide sequence (e.g. heterologous or homologous nucleotide sequence or heterologous or homologous polynucleotide, respectively), such as a nucleotide sequence being comprised in a gene of interest, that encodes an expression product, such as an RNA or polypeptide, that, when expressed, results in production of the product (e.g. polypeptide (for instance a heterologous polypeptide), such as enzymes, antibodies or fragments thereof, hormones, or protein-antigens present in vaccines).

Here, the term "a promoter that is repressed" defines that the promoter is not able to exert its full, natural function and its full, natural activity. An example of such a promoter that is repressed in the presence of SSN6-like or SSN-like related protein is the LLP promoter: It is not yet known which mechanism is underlying said repression, however it is speculteted that the repression could be based on alteration of the local chromatin structure, or on interaction with the general transcription machinery (Smith et al., TIBS 25, July 2000, 325-330).

Within the meaning of the present invention, as a result of the repression of the promoter, the expression of a gene that is under control of said promoter is influenced to the effect that the respective encoded protein is not expressed; and that the amount of said expressed protein differs from the wildtype amount of said protein.

Within the meaning of the present invention a coding sequence (e.g. of a heterologous polynucleotide) is "under control of" (or the like) a transcriptional or translational control sequence (regulatory polynucleotide sequence) when the regulatory polynucleotide sequence directs RNA, preferably mRNA, which then may be spliced (if it contains introns) and, optionally, translated into a protein encoded by the coding sequence. In an embodiment of the present invention, a gene (such as a gene of interest) is under control of the LLP promoter. This means that as long as the promoter works as in a wildtype situation (for instance, is repressed by SSN6-like protein or SSN6-like related protein), a gene that is under control of said promoter is not expressed or expressed at low levels when the cells are cultivated in standard conditions. As soon as the LLP promoter is derepressed due to the presence of a modified SSN6-like related protein or SSN6-like protein or different cultivation conditions, a gene that is under control of this promoter is expressed at high to very high levels (compared to a situation where the promoter is not repressed). Based on the ratio underlying the present invention, it is likely that a SSN6-like protein or a SSN6-like related protein might be blocked not only be mutation of the ssn6-like gene or the ssn6-like related gene, but also by inhibitors of ssn6-like gene or protein or by inhibitors of ssn6-like related gene or protein, which also could result in increased activity of the LLP-promoter.

The term "functional" defines that the respective matter exhibits its natural function.

The term "selecting" refers to the identification and isolation of a recipient cell that contains the vector of interest. Transformed microorganisms, that is, those containing recombinant molecules such as a vector or plasmid, may be selected with a variety of positive and/or negative selection methods or markers. Details according to such selection methods and markers are described elsewhere in this appilication. Negative selection markers include, but are not limited to, genes such as thyA, sacB, gnd, gapC, zwJ, talA, taiB, ppc, gdhA, pgi, Jbp, pykA, cit, acs, edd, icdA, groEL, secA and the like.

In general, the term "expression system" denotes a system that is specifically designed for the production of a gene product of choice, also referrd to herein as protein of interest (POI). In the present invention, the expression system comprises a modified ssn6-like related gene or a modified ssn6-like gene, or an ssn6-like related gene or an ssn6-like gene and a modified regulatory polynucleotide sequence that is involved in the reglation of the expression of said genes, to the effect that said expression system is not able to express an SSN6-like related protein or SSN6-like protein, that SSN6-like related protein or SSN6-like protein is expressed that does not exert its wildtype function and/or wildtype activity, and/or that an amount of SSN6-like related protein or SSN6-like protein is expressed that differs, preferably is lower, when compared to the amount of SSN6-like related protein or of SSN6-like protein that is expressed by said expression system when the corresponding wildtype polynucleotide sequence is expressed by such an expression system under the same conditions.

The expression system of the present invention is a eukarytic expression system, i.e. an expression system that comprises a eukaryotic cell. In particular, within the meaning of the present invention, said eukaryotic cell is modified as described elsewhere herein.

DETAILED DESCRIPTION OF THE INVENTION

The present invention is now described in more detail by preferred embodiments and examples, which are however presented for illustrative purpose only and shall not be understood as limiting the scope of the present invention in any way.

Although expression systems for expressing proteins are widely known in prior art, these expression systems often exhibit disadvantages, for instance with regard to the yield of the expression product, or with regard to the expression system itself.

The present invention is based on the surprising general finding that an improved constitutive eukaryotic expresson system can be generated by modifying an ssn6-like related gene or ssn6-like gene ("ssn6-like related/ssn6-like gene") that is present in a eukaryotic cell, and/or by modifying the expression level of SSN6-like related protein or SSN6-like protein; or by deleting the ssn6-like related gene or ssn6-like gene, respectively to the effect that the resulting modified eukaryotic cell is not able to provide an SSN6-like related protein or an SSN6-like protein that exerts its wildtype function and/or wildtype activity in particular with regard to regulatory sequences such as a promoter that is regulated by said proteins (such as the LLP promoter); the amount of SSN6-like related protein or of SSN6-like protein being present in the modified eukaryotic cell differs (preferably is lower) from the amount of SSN6-like related protein or of SSN6-like protein being present in its wildtype form, to the effect that said proteins are not able to exert their wildtype function and/or activity in particular with regard to regulatory sequences such as a promoter that is regulated by said proteins; and/or no SSN6-like related protein or SSN6-like protein ("SSN6-like related/SSN6-like protein") is present in the modified cell, again to the effect that said proteins are not able to exert their wildtype function and/or activity in particular with regard to regulatory sequences such as a promoter that is regulated by said proteins. Thus, by preventing the SSN6-like related protein or SSN6-like protein from exerting its natural (wildtype) function, which function comprises the repressive direct and/or indirect interactions with regulatory sequences such as promoters (e.g. the LLP promoter), the expression of a gene that is under control of said regulatory sequences (e.g. LLP promoter) in a suitable expression system is, at least to a certain degree, not repessed any more. In other other words, the respective gene being under control of said promoter is overexpressed compared to its wildtype expression.

By applying the principle underlying the present invention, a eukaryotic expression system is provided, which is for instance improved with regard to expression product yield compared to the yield that is obtained when applying prior art expression systems. Moreover, the inventive expression system is improved with regard to safety aspects: Contrary to certain prior art eukaryotic expression systems, the present eukaryotic expression system is not based on the commonly used AOX (alcohol oxidase) promoters, which are tightly regulated by methanol. The presence of flammable and toxic methanol represents a major security risk, and also imposes a risk on alcohol-sensitive expression products or host cells. Especially in large scale fermentation of recombinant proteins the use of methanol is a serious safety and envirionmental risk. Alternative eukaryotic expression systems that use promoters that are not regulated by methanol are for instance based on the constitutive GAP (glyceraldehyde-3-phosphate dehydrogenase) promoter. However, the resulting yield for instance when applying a GAP-based expression system leaves much to be desired.

Within the meaning of the present invention it has been surprisingly found that the modification of an ssn6-like related gene or of an ssn6-like gene and/or the modification of the expression level of SSN6-like related protein or SSN6-like protein that is present in a eukaryotic cell to the effect that the resulting modified eukaryotic cell is not able to exert the wildtype function of SSN6-like related protein or SSN6-like protein with regard to a regulatory sequence that is regulted by said SSN6-like related protein or SSN6-like protein, such as a promoter (e.g. the LLP promoter), results in an enhanced expression of the gene that is under control of said regulatory sequence.

Thus, the present invention provides a modified eukaryotic cell, which is modified compared to its wildtype cell at least in that it comprises a modified ssn6-like related gene or a modified ssn6-like gene, and/or a modified expression level of SSN6-like related protein or of SSN6-like protein, or in that an ssn6-like related gene or an ssn6-like gene is deleted, respectively to the effect that the modified eukaryotic cell is not able to provide an SSN6-like related protein or an SSN6-like protein that exerts its wildtype function and/or wildtype activity, the amount of SSN6-like related protein or of SSN6-like protein being present in the modified eukaryotic cell differs from the amount of SSN6-like related protein or of SSN6-like protein being present in its wildtype form, and/or no SSN6-like related protein or SSN6-like protein is present in the modified cell.

In accordance with the ratio underlying the present invention, the resulting modified eukaryotic cell, when compared to its wildtype cell, exhibits different SSN6-like related protein or SSN6-like protein activity and/or function, preferably with respect to its activity and/or function in regulating the expression of a gene.

Whenever the term "wildtype function" is used in connection with SSN6-like related protein or SSN6-like protein, or the respective genes encoding said proteins, the function with regard to a regulatory sequence that is regulated by SSN6-like related protein or SSN6-like protein, such as a promoter (preferably the LLP promoter), is referred to.

As it is known to a person skilled in the art, the expression of a gene is, amongst others, regulated by a complex interplay of various factors that contribute to the regulation of the expression of (a) certain gene(s), such as promoters, enhancers, terminators, silencers, transcription factors, IRES-sequences, ribosome-binding sites, and sequences stabilizing or destabilizing the mRNA by secondary structures or enhancers.

Thus, in a preferred embodiment, the resulting modified eukaryotic cell exhibits different SSN6-like related protein or SSN6-like protein activity and/or function with regard to any promoter that is regulated by said proteins, preferably the LLP promoter. Hence, it is a preferred embodiment of the present invention that the modified eukaryotic cell, when compared to its wildtype cell, exhibits different SSN6-like related protein or SSN6-like protein activity and/or function with regard to regulating the expression of genes that are under control of the LLP promoter. The activity and/or function of said proteins (SSN6-like related and SSN6-like) results in that the genes that are under control of said promoter (LLP-promoter) are overexpressed.

The different activity and/or function of the SSN6-like related protein or SSN6-like protein can be any different activity and/or function that results in an overexpression of the respective gene that is under control of the affected regulatory sequence. For example an SSN6-like related protein or SSN6-like protein might be altered in its activity and/or function by "gain of function" or "loss of function" modifications. If several copies of different modified versions or wild-type SSN6-like related protein or SSN6-like protein are present within a cell at the same time, certain SSN6-like related proteins or SSN6-like proteins might be dominant regarding their activity and/or function. "Loss-of-function" mutants comprise a mutation that results in reduced or abolished protein function. "Gain-of-function" mutants comprise a mutation that results in an abnormal activity on a protein. Preferably, it is a reduced activity and/or function of the SSN6-like related protein or of the SSN6-like protein. It can also be that there is no SSN6-like related protein or SSN6-like protein at all present in the modified eukaryotic cell, or that there is no SSN6-like related protein or SSN6-like protein within the detection limit of commonly know methods such as for example RT-PCR, qPCR or other PCR-related techniques, western blotting, ELISA, or other immunological detection assays, reporter gene assays, mass spectrometric detection methods, chip assays detecting proteins or nucleic acids, etc.

In order to arrive at a modified eukaryotic cell that exhibits different, preferably reduced, more preferably essentially no, SSN6-like related protein or SSN6-like protein function and/or activity, the ssn6-like related gene or ssn6-like gene can be modified. This modification can for instance have taken place in a coding sequence encoding the respective protein, and/or in a respective regulatory sequence. A regulatory sequence that can be modified is for instance a promoter, enhancer, terminator, silencer, IRES-sequence, ribosome-binding site, and sequence stabilizing or destabilizing the mRNA by secondary structures or enhancer.

According to the present invention, the above modifications on the regulatory and/or coding regions of the genes encoding SSN6-like related protein and/or SSN6-like protein have an effect on the expression level of the SSN6-like related protein or SSN6-like protein in that the modified eukaryotic cell is not able to express said proteins, or that the amount of said proteins is different, preferably reduced, when compared with its wildtype form. The above modifications can also have an effect on the function and/or activity of SSN6-like related protein or SSN6-like protein in that said proteins do not exert their wildtype function and/or activity, It is also possible to arrive at a modified eukaryotic cell exhibiting impaired SSN6-like related/SSN6-like protein as defined above by impairing the transcription or translation of the gene encoding SSN6-like related/SSN6-like protein. Transkription and translation can be impaired by any suitable method that is known to a person skilled in the art, for instance translation can be impaired by hybridizing a complementary sequence or a partial sequence thereof to the mRNA transcript. The partial sequence of the complementary sequence is for example selected from siRNA, antisense RNA, ribozyme, and triplex RNA or DNA, etc.

Irrespective of whether the regulatory and/or coding regions of the ssn6-like related/ssn6-like gene is modified, or whether the transcription and/or translation of the gene encoding SSN6-like related/SSN6-like protein is impaired, as a result, the modified eukaryotic cell is not able to provide an SSN6-like related protein or an SSN6-like protein that exerts its wildtype function and/or wildtype activity, the amount of SSN6-like related protein or of SSN6-like protein being present in the modified eukaryotic cell differs from the amount of SSN6-like related protein or of SSN6-like protein being present in its wildtype form, and/or no SSN6-like related protein or SSN6-like protein is present in the modified cell, as it is disclosed elsewhere herein.

The ssn6-like related/ssn6-like gene and/or the expression level of the SSN6-like related/SSN6-like protein can be modified by any suitable method that is known to a person skilled in the art. For instance, the ssn6-like related/ssn6-like gene and/or the expression level of the SSN6-like related/SSN6-like protein is modified by introduction of one or more point mutations, e.g. substitution, insertion or deletion of a single or more nucleotides in the polynucleotide sequence of the ssn6-like related gene or of the ssn6-like gene, partial or complete deletion of the polynucleotide sequence of the ssn6-like related gene or of the ssn6-like gene, and/or partial or complete replacement of the polynucleotide sequence of the ssn6-like related gene or of the ssn6-like gene by a different, e.g. heterologous, nucleotide sequence.

In a preferred embodiment, the total activity, function, preferably gene regulatory function, and/or amount of SSN6-like related protein or SSN6-like protein of the modified eukaryotic cell is at most 20%, preferably at most 15%, more preferably at most 10%, even more preferably at most 5% of the activity, function and/or amount of SSN6-like related protein or SSN6-like protein of its wildtype form, and most preferably there is no activity and/or no function of the SSN6-like related protein or SSN6-like protein of the modified eukaryotic cell at all.

Within the meaning of the present invention, the term "total activity, function, and/or amount of SSN6-like related protein or SSN6-like protein of the modified eukaryotic cell" defines the overall activity, function, and/or amount of SSN6-like related protein or SSN6-like protein of a sample of modified eukaryotic cells. For instance, in order to assess whether the activity, function, and/or amount of SSN6-like related protein or SSN6-like protein of the modified eukaryotic cells differs from the corresponding feature of the wildtype cells, the total amount of SSN6-like protein being present in a sample of a certain number of wildtype cells is compared with the total amount of SSN6-like protein being present in a sample of essentially the same number of modified eukaryotic cells.

Within the meaning of the present invention, the modified eukaryotic cell can be any suitable cell, i.e. any suitable eukaryotic cell that comprises, in its wildtype form, a polynucleotide sequence encoding SSN6-like related/SSN6-like protein. In a preferred embodiment, said suitable cell additionally comprises a nucleotide sequence representing the LLP promoter. In order to determine whether a eukaryotic cell comprises the above defined sequences, any suitable method that is known to a person skilled in the art can be used, for instance techniques such as northern blotting, real time PCR, reverse transcriptase quantitative PCR (RT-qPCR), or microarray hybridization experiments. Microarray hybridization expriments can be used to quantify the expression of hundreds to thousands of genes at the same time. Suitable protocols can for instance be found in Sambrook et al.

In a preferred embodiment of the present invention, the modified eukaryotic cell is a fungal cell, preferably a yeast cell, more preferably selected from the group consisting of *Saccharomyces* species (e.g., *Saccharomyces cerevisiae*), *Kluyveromyces* species (e.g., *Kluyveromyces lactis*), *Torulaspora* species, *Yarrowia* species (e.g., *Yarrowia lipolitica*), *Schizosaccharomyces* species (e.g., *Schizosaccharomyces pombe*), *Pichia* species (e.g., *Pichia pastoris* or *Pichia methanolica*), *Hansenula* species (e.g., *Hansenula polymorpha*), *Torulopsis* species, *Komagataella* species, *Candida* species (e.g., *Candida boidinii*), and *Karwinskia* species, even more preferably the eukaryotic cell is a *Pichia* cell, most preferably a *Pichia pastoris* cell according to current classification.

In a further preferred embodiment, the modified eukaryotic cell is a *P. Pastoris* cell, preferably a cell of a strain selected from the group consisting of NRRL Y-11430, CBS704, GS115, and KM71.

As disclosed herein, the modified eukaryotic cell according to the present invention can comprise a modified ssn6-like related gene or a modified ssn6-like gene. Thus, in a further embodiment, the modified eukaryotic cell comprises a polynucleotide sequence which represents a modification of SEQ ID NO: 1.

As explained elsewhere herein, it has been found that a modification of ssn6-like related/ssn6-like gene according to the present invention, i.e. a modification that results in a modified expression of SSN6-like related/SSN6-like protein, results in an overexpression of genes that are under control of a promoter that is regulated by SSN6-like related/SSN6-like protein, such as the LLP promoter. Thus, the present invention also refers to a polynucleotide sequence comprising a modified ssn6-like related gene or a modified ssn6-like gene comprising a coding sequence and a regulatory sequence, wherein, if said polynucleotide sequence is expressed in a suitable expression system, essentially no SSN6-like related protein or SSN6-like protein is expressed, or SSN6-like related protein or SSN6-like protein is expressed that does not exert its wildtype function and/or wildtype activity, preferably with respect to its activity and/or function in regulating gene expression, more preferably in regulating the expression of genes that are under control of the LLP promoter, and/or an amount of SSN6-like related protein or SSN6-like protein is expressed that differs from the amount of SSN6-like related protein or of SSN6-like protein that is expressed when the corresponding wildtype polynucleotide sequence is expressed under comparable or the same conditions.

In a preferred embodiment, the amount of SSN6-like related protein or SSN6-like protein that is expressed differs from the amount of SSN6-like related protein or of SSN6-like protein that is expressed when the corresponding wildtype polynucleotide sequence is expressed under comparable or the same conditions in that it is reduced.

In a further embodiment, the above polynucleotide consists of said modified ssn6-like/ssn6 gene.

In a preferred embodiment, the amount of SSN6-like related/SSN6-like protein is reduced, or there is no SSN6-like related protein or SSN6-like protein present at all, compared to the amount of SSN6-like related/SSN6-like protein that is expressed when the corresponding wildtype polynucleotide sequence is expressed under comparable or the same conditions.

The modifications can be carried out in the regulatory sequence (regulatory region) and/or in the coding sequence (coding region) of the ssn6-like related/ssn6-like gene. The regulatory sequence can be any regulatory sequence, preferably the regulatory sequence is selected from the group comprising or consisting of promoters, enhancers, terminators, silencers, IRES-sequences, ribosome-binding sites, and sequences stabilizing or destabilizing the mRNA by secondary structures, more preferably said regulatory sequence is selected from the group consisting of promoters, enhancers, and terminators.

The ssn6-like related/ssn6-like gene has been modified as disclosed elsewhere herein. In a preferred embodiment, the polynucleotide comprises, preferably consists of, modifications of SEQ ID NO: 1. An example of a modified ssn6-like gene is depicted in FIG. 1G (SEQ ID NO: 7). Thus, in a further preferred embodiment, the polynucleotide according to the present invention comprises, preferably consists of, SEQ ID NO: 7.

As it is known to a person skilled in the art, it is possible to propagate and/or express a certain nucleotide sequence by inserting this sequence into a vector, which is then, in turn, introduced in a host cell such as a bacterium, with this bacterium preferably being *Escherichia coli* (*E. coli*) or a eukaryotic cell for instance as disclosed elsewhere herein, Thus, the present invention also refers to a vector comprising the polynucleotide sequence comprising the modified ssn6-like related/ssn6-like gene, as well as to a host cell comprising said vector or parts of said vector.

Depending on the respective intended use, said vector contains specific structural elements. If it is for instance intended to propagate the nucleotide sequence, then the corresponding vector has to contain an ori.

The present invention also refers to a polypeptide encoded by the polynucleotide sequence according to the present invention. If the polynucleotide sequence according to the present invention, comprising a modified ssn6-like related/ssn6-like gene as disclosed above, is expressed in a suitable expression system, the expression of a gene product, e.g. of a polypeptide or protein, depends on the modifications that have been carried out. For instance, if the modification results in a shift of the complete reading frame, in all likelihood no gene product can be expressed. It can however also be that the modification only results in a truncated ("shortened") nucleotide sequence, which in turn results in the expression of a truncated gene product which may also contain a short heterolgous amino acid sequence at its C-terminus which is coded by the inserted heterologous nucleotide sequence (see FIG. 2B, SEQ ID NO: 9, with 7 heterologous C-terminal amino acids (EWYLQLR, underlined in FIG. 2B; SEQ ID NO: 139), as compared to the non-mutated sequence in FIG. 2A, SEQ ID NO: 8).

In the present invention it has been surprisingly found that by partially or completely inhibiting the wildtype function and/or activity of SSN6-like related/SSN6-like protein, or by effecting that SSN6-like related/SSN6-like protein is essentially not present, respectively in a cell that in its wildtype form comprises a gene encoding said protein, a gene being under the control of a promoter that is repressed in the presence of SSN6-like related/SSN6-like protein can be overexpressed in a suitable expression system.

Thus, the present invention further refers to an expression vector comprising a promoter, wherein said promoter is characterized in that it is repressed in the presence of SSN6-like protein or SSN6-like related protein if said expression vector is introduced into a suitable expression system, e.g. into a eukaryotic cell as defined elsewhere herein. By using this expression vector, a gene under control of a promoter that is repressed in the presence of SSN6-like related/SSN6-like protein can be overexpressed in a suitable expression system. In order to determine whether a promoter is repressible by SSN6-like related/SSN6-like protein, any suitable method that is known to a person skilled in the art can be used. For instance, expression vectors can be designed that comprise the promoter to be tested, and an indicator gene (also called reporter-gene) such as luciferase that is under control of the promoter to be tested. If, in the presence of SSN6-like related/SSN6-like protein, the espression of the gene product is reduced, then the candidate promoter is repressed in the presence of SSN6-like related/SSN6-like. Determination of the reduced candidate promoter activity for example can be measured by quantifying the indicator gene product or its activity, for example luciferase, by methods known in the art. There are a number of assays know in the art, which can be used to determine promoter-activity or mesure interaction of proteins with promoter-sequences and which thereby are suitable to test wether the activity of a certain promoter is influenced by an SSN6-like or SSN6-like related protein. Examples of such assays are reporter gene assays, electrophoretic mobility shift assays (EMSA, gel shift assays), double-stranded DNA pull-down assay, chromatin immune-precipitation assays, and DNase footprinting assays, etc.

In a preferred embodiment of the present invention, the expression vector comprises one or more gene(s) of interest that are under control of said promoter, i.e. the promoter that is repressed in the presence of SSN6-like related/SSN6-like protein. By applying suitable protocols that are known to a skilled person, such as a protocol as disclosed above, a person skilled in the art is able to assess whether a promoter is repressed in the presence of SSN6-like related/SSN6-like protein, or not. In a preferred embodiment of the present invention, the promoter being comprised in the expression vector and contolling the gene(s) of interest is an LLP promter or a modified version thereof. Preferably, the LLP promoter comprises, preferably consists of, the polynucleotide sequence depicted in SEQ ID NO: 2 or 12. The term "modified version" of the LLP promoter defines that said modified LLP promoter still exhibits the function of an LLP promoter in terms of regulating the expression of the gene that is under its control.

It is further possible that the promoter is an LLP promoter, and that LLP is encoded or is not encoded by the polynucleotide sequence of the expression vector. In either case, and also in case the promoter is not LLP promoter but a different promoter that is repressed in the presence of SSN6-like related/SSN6-like protein, the gene of interest preferably is selected from the group consisting of genes encoding enzymes, antibodies or fragments thereof, hormones, structural proteins, and protein-antigens being present in vaccines.

Preferably, the expression vector further comprises features selected from any one of the following:
(i) a selection marker;
(ii) a purification marker;
(iii) a signal sequence, preferably an alpha-factor secreting signal sequence, more preferably the MFalpha pre-pro signal sequence, even more preferably a signal sequence comprising or consisting of, preferably consisting of, SEQ ID NO: 14 or SEQ ID NO: 21;
(iv) an origin of replication; and/or
(v) a nucleotide sequence for targeted and/or random integration into the genome of a host cell.

The expression vector can be comprised in a host cell as described herein, preferably in a bacterium such as E. coli, for instance for propagation purposes.

The expression vector can also be introduced into the modified eukaryotic cell according to the present invention, resulting in the introduction of the expression vector's expression cassette into the modified eukaryotic cell's genome. The introduction of the expression vector into the host cell can be carried out according to any suitable method that is known to a skilled person, for instance by electroporation. In addition, transient expression, i.e. the expression vector is not integrated into the genome, can also be considered.

The present invention also refers to a modified eukaryotic cell comprising the expression vector as defined herein.

The introduction of the expression cassette of the expression vector into the modified eukaryotic cell is also denoted as "recombination" and can be a targeted, i.e. homologous, recombination, or a random recombination. If a random recombination takes place, the expression cassette integrates in such a way into the genome of the modified eukaryotic cell that the nucleotide sequence encoding LLP protein present in the modified eukaryotic cell is not affected. In other words, the modified eukaryotic cell expresses not only the gene of interest, but also the LLP protein. In this case, the amount of LLP protein being present in the modified cell, the supernatant of the modified cell or in subfractions thereof can be used as an indicator of the purity of the expression product of the gene of interest, i.e. the protein of interest, for example during purification of the protein of interest. This situation, where the LLP protein is expressed in addition to the gene(s) of interest, is referred to as "Option 2" (FIG. 3D).

Thus, the present invention also refers to a eukaryotic cell comprising
a modified ssn6-like related gene or a modified ssn6-like gene, wherein said gene has inserted a foreign nucleotide sequence, to the effect that
(i) the eukaryotic cell is not able to provide an SSN6-like related protein or an SSN6-like protein that exerts its wildtype function and/or wildtype activity, preferably with respect to its activity and/or function in regulating the LLP promoter,
(ii) the amount of SSN6-like related protein or of SSN6-like protein being present in the eukaryotic cell differs from the amount of SSN6-like related protein or of SSN6-like protein being present in its wildtype form, preferably the amount of the SSN6-like related protein or of the SSN6-like protein is reduced, and/or
(iii) no SSN6-like related protein or SSN6-like protein is present in the eukaryotic cell,
a gene of interest under control of the LLP promoter, and an llp gene,
preferably wherein said eukaryotic cell exhibits reduced SSN6-like related protein or SSN6-like protein activity and/or function, or no SSN6-like related protein or SSN6-like protein activity and/or function at all.

If a targeted, i.e. homologous, recombination takes place, and if additionally the promoter of the expression cassette is an LLP promoter or a modification thereof, then the expression cassette is inserted in such a way that it replaces (partially or completely) the nucleotide sequence of the gene encoding the LLP protein. In this case, there is no expression of LLP. This situation, where only the gene(s) of interest, but no LLP protein, is expressed, is referred to as "Opition 1".

Thus, the present invention also refers to a eukaryotic cell comprising
- a modified ssn6-like related gene or a modified ssn6-like gene, wherein said gene has inserted a foreign nucleotide sequence, to the effect that
  (i) the eukaryotic cell is not able to provide an SSN6-like related protein or an SSN6-like protein that exerts its wildtype function and/or wildtype activity, preferably with respect to its activity and/or function in regulating the LLP promoter,
  (ii) the amount of SSN6-like related protein or of SSN6-like protein being present in the eukaryotic cell differs from the amount of SSN6-like related protein or of SSN6-like protein being present in its wildtype form, preferably the amount of the SSN6-like related protein or of the SSN6-like protein is reduced, and/or
  (iii) no SSN6-like related protein or SSN6-like protein is present in the eukaryotic cell,
and
- a gene of interest that replaces a part or all of the coding region of the gene encoding the LLP protein, to the effect that essentially no LLP protein is present in the eukaryotic cell, and that is under control of the LLP promoter,
preferably wherein said eukaryotic cell exhibits reduced SSN6-like related protein or SSN6-like protein activity and/or function, or no SSN6-like related protein or SSN6-like-protein activity and/or function at all.

The present invention further refers to an expression system, comprising
  a) the modified eukaryotic cell as defined herein;
  b) the expression vector as defined herein, wherein said expression vector can also be present in linearized form and/or at least parts of the vector being integrated into the genome of the modified eukaryotic cell.

In a further preferred embodiment of the present invention, the modified eukaryotic cell additionally comprises a promoter, wherein said promoter is repressed in the presence of SSN6 protein or SSN6-like protein. Preferably, said promoter is an LLP promoter, preferably an LLP promoter comprising, preferably consisting of, SEQ ID NO: 2 or 12, or modified versions thereof, said modified versions being characterized in that they still exhibit essentially the same promoter function as a wildtype LLP promoter.

In a further embodiment, the modified eukaryotic cell additionally comprises (a) gene(s) of interest, preferably selected from the group consisting of genes encoding enzymes, antibodies or fragments thereof, hormones, structural proteins, and protein-antigens being present in vaccines, wherein said gene(s) of interest is (are) under control of a promoter being repressed in the presence of SSN6-like protein or SSN6-like related protein. Preferably, this promoter is an LLP promoter, preferably an LLP promoter comprising, preferably consisting of, SEQ ID NO: 2 or 12, or modified versions thereof, said modified versions being characterized in that they still exhibit essentially the same promoter function as a wildtype promoter.

As already explained above, it is possible that in said expression system the LLP gene is not expressed in addition to the gene(s) of interest (option 1), and it is also possible that the LLP gene is expressed in addition to the gene(s) of interest (option 2). In the first case (option 1), the LLP promoter only controls the expression of (a) gene(s) of interest, and in the latter case (option 2), the LLP promoter controls the expression of (a) gene(s) of interest (which are different from genes encoding LLP), and LLP.

The present invention further refers to the use of the modified eukaryotic cell, the modified polynucleotide sequence, the expression vector, the host cell, or an expression system as defined herein in a method of expressing, preferably overexpressing, gene(s) of interest.

As disclosed above, the amount of LLP protein being present in a composition comprising the protein of interest is an indicator of the purity of said composition regarding said protein of interest. Thus, the present invention also refers to a method for determining the purity of a composition comprising the expression product of a gene of interest, comprising the following steps:
  (a) expressing gene(s) of interest by using the modified eukaryotic cell and the expression vector, respectively according to the present invention, wherein
    (a1) the modified eukaryotic cell comprises a gene encoding LLP protein under control of an LLP promoter, and wherein
    (a2) the expression vector comprises one or more gene(s) of interest under control of an LLP promoter or a modified LLP promoter, wherein said gene of interest does not encode LLP,
  thereby obtaining a composition comprising the expression product of the gene(s) of interest, i.e. the protein(s) of interest, and the LLP protein;
  (b) determining the amount of the expression product of the gene(s) of interest, i.e. the amount of the protein(s) of interest, and the amount of LLP protein being present in the composition obtained in step (a), wherein the amount of LLP protein compared to the amount of expression product of the gene(s) of interest, i.e. of the protein(s) of interst, is indicative for the purity of the composition obtained in step (a); and, optionally,
  (c) subjecting the composition of step (a) to one or more downstream purification step(s), followed by step b), i.e. determining the amount of the expression product of the gene(s) of interest, i.e. the protein(s) of interest, and the amount of LLP protein being present in the composition obtained after having carried out said downstream purification step.

In order to obtain a composition that comprises LLP, in addition to the gene(s) of interest, the integration of the expression cassette of the expression vector represents a random integration into the genome of the modified eukaryotic cell.

The composition comprising the protein(s) of interest and the LLP protein can be any composition that arises in the course of the process of producing the protein(s) of interest. Accordingly, such a composition can for instance be a supernatant of the cell culture used in expressing the protein (s) of interest The present invention further refers to a method of expressing one or more gene(s) of interest in a eukaryotic cell comprising an ssn6-like related gene or an ssn6-like gene, wherein the translation of the mRNA transcript of the ssn6-like related gene or the ssn6-like gene is prevented by hybridizing a complementary sequence or a partial sequence thereof to the mRNA transcript. In a preferred embodiment, the partial sequence of the complementary sequence is a siRNA, anti-sense RNA, a ribozyme, or triplex RNA or DNA.

In a further embodiment, the present invention refers to a method of expressing one or more gene(s) of interest in a eukaryotic cell comprising an SSN6-like expression cassette or SSN6-like related expression cassette, wherein the SSN6-like protein or the SSN6-like related protein in said eukaryotic cell is modified or inhibited in its function and/or activity. Preferably, the SSN6-like protein or SSN6-like related protein of said eukaryotic cell is modified or inhibited in its function and/or activity in regulating the LLP promoter, more preferably the SSN6-like protein or SSN6-like related protein exhibits reduced SSN6-like related protein or SSN6-like protein activity and/or function, or no SSN6-like related protein or SSN6-like protein activity and/or function.

DESCRIPTION OF THE FIGURES

FIG. 1: Polynucleotide Sequences

FIG. 1 shows various polynucleotide sequences.

FIG. 1A shows the nucleotide sequence of the coding region of the ssn6-likegene of *P. Pastoris* (SEQ ID. NO: 1).

FIG. 1B shows the nucleotide sequence of the LLP promoter of *P. pastoris*, 605 bp 3' from the ATG start codon of LLP (SEQ ID NO: 2).

FIG. 1C shows the nucleotide sequence of the signal sequence of the LLP protein of *P. Pastoris* (SEQ ID NO: 3).

FIG. 1D shows the nucleotide sequence of the terminator sequence of llp gene of *P. Pastoris* (SEQ ID NO: 4).

FIG. 1E shows the nucleotide sequence of the SSN6-like promoter of *P. Pastoris*, 1000 bp 3' from the ATG start codon of SSN6-like (SEQ ID NO: 5).

FIG. 1F shows the nucleotide sequence of the terminator sequence of ssn6-like gene of *P. Pastoris* (SEQ ID NO: 6).

FIG. 1G shows the nucleotide sequence of the SSN6-like modified DNA of *P. Pastoris* (from the ATG start to the TAA stop codon) as present in *P. Pastoris* strain SSS1. This results in a ssn6-like coding region with an internal insertation of a heterologous nucleotide sequence, which disrupts the coding sequence of ssn6-like coding sequence (SEQ ID NO: 7).

FIG. 1H shows the nucleotide sequence of the Kozak start sequence (SEQ ID NO: 11).

FIG. 1I shows the nucleotide sequence of the LLP promoter, 1000 bp 3' from the ATG start codon of LLP (SEQ ID NO: 12).

FIG. 1J shows the amino acid sequence of the SSN6-like protein (SEQ ID NO: 13)

FIG. 1K shows MFalpha pre-pro signal sequence: FIG. 1K(A) shows said signal sequence without EAEA repeat (SEQ ID NO: 14), and FIG. 1K(B) shows said signal sequence with EAEA repeat (SEQ ID NO: 21).

FIG. 1L shows the codon optimized DNA sequence of encoding a single chain antibody fragment DLX521 (SEQ ID NO: 15).

FIG. 1M shows the coding region of the DNA sequence of the llp-gene including the signal sequence (SEQ ID NO: 16).

FIG. 1N shows the codon optimized nucleotide sequence of the human Growth Hormone (hGH) as used in the examples of this application (SEQ ID NO: 17)

FIG. 1O shows the nucleotide sequence of the human serum albumin (HSA) as used in the examples of this application (SEQ ID NO: 18).

FIG. 1P shows the nucleotide sequence of the penicillin V amidase (PVA) as used in the examples of this application (SEQ ID NO: 19).

FIG. 1Q shows the nucleotide sequence of the vector pGAPk used for generating the SSS1 yeast cell line (plasmid without a GOI and with a Geneticin resistance marker) (SEQ ID NO: 20)

FIG. 1R shows the sequence of a pLLP vector containing a Geneticin resistance marker (pLLPk) corresponding to SEQ ID NO: 22.

FIG. 1S shows SEQ ID NO: 23, which is part of the nuceleotide sequence of chromosome 1 of the genomic sequence of yeast strain YJK_PVA_021 after random integration of a PVA- and a Zeocin-expression cassette into the coding region of ssn6-like (reverse-complement sequence of ssn6-like) at position 807,480 of chromosome 1 of the reference strain *Pichia pastoris* CBS 7435. The ssn6-likesequenceisunderlined, the start codon is shown in bold and double-underlined (ATG→reverse-complement→CAT). Shown is the interrupted ssn6-like coding sequence including 10 nucleotides flanking 5' and 3' to the ssn6-like coding sequence. The sequence shown is part of the Illumina-sequenced genome of strain YJK_PVA_021 (SEQ ID NOs: 67-115) and the sequence of SEQ ID NO: 23 is part of the genomic sequence SEQ ID NO: 103 obtained by Illumina Inc. Sequences of oligo2395 (reverse-complement sequence of oligo2395) and oligo2398 are labeled in grey.

FIG. 1T shows the LLP signal sequence fused to the 3' end of HSA coding sequence replacing the native HSA-signal sequence resulting in the sequence according to SEQ ID NO: 121.

FIG. 1U shows SEQ ID NO: 129, which is the shortened LLP-promoter sequence delta29 corresponding to a 576 bases length of the shortened LLP-promoter.

FIG. 1V shows SEQ ID NO: 130, which is the shortened LLP-promoter sequence delta93 corresponding to a 512 bases length of the shortened LLP-promoter.

FIG. 1W shows SEQ ID NO: 131, which is the shortened LLP-promoter sequence delta133 corresponding to a 472 bases length of the shortened LLP-promoter.

FIG. 1X shows SEQ ID NO: 132, which is the shortened LLP-promoter sequence delta201 corresponding to a 404 bases length of the shortened LLP-promoter.

FIG. 1Y shows SEQ ID NO: 133, which is the shortened LLP-promoter sequence delta233 corresponding to a 372 bases length of the shortened LLP-promoter.

FIG. 1Z shows SEQ ID NO: 134, which is the shortened LLP-promoter sequence delta300 corresponding to a 305 bases length of the shortened LLP-promoter.

FIG. 2: Amino Acid Sequences

FIG. 2 shows various amino acid sequences.

FIG. 2A shows the amino acid sequence of the SSN6-like protein of *P. Pastoris* (SEQ ID NO: 8)

FIG. 2B shows the amino acid sequence of the SSN6-like modified protein of *P. Pastoris* YJK_PVA_021 (SEQ ID NO: 9). The underlined 7 amino acids represent heterologous, non-SSN6-like amino acids originationg from the vector used to inactivate the SSN6-like protein.

FIG. 2C shows the amino acid sequence of the LLP protein including LLP signal sequence (SEQ ID NO: 10).

FIG. 2D shows the amino acid sequence of the LLP signal sequence of *p. pastoris* (SEQ ID NO: 140).

FIG. 3: Mechanism of Super-Secretor *Pichia Pastoris* (SSS1)

wt=wild-type, ssn6-like=ssn6-like gene, LLP=LLP coding sequence, Pl=LLP-promoter, LLP-prot.=LLP-protein, Pg=GAP-promoter, AR=antibiotic resistance, GOI=coding sequence of gene of interest, GOI-prot.=gene of interest protein

FIG. 3A

The wt-strain (wild-type strain, NRRL Y-11430) contains an intact ssn6-like gene which according to our interpretation suppresses the promoter (Pl) of the lectine like protein (LLP). The ssn6-like gene is on the reverse strand of chromosome 1 (coding sequence is from 806379-808244)

and the LLP gene is on the forward strand of chromosome 1 (coding sequence is from 2492530 to 2493945).

FIG. 3B

An expression construct with a radomly integrated Pg/AR sequence into the coding sequence of ssn6-like gene of strain NRRL Y-11430 was obtained. The resulting strain contains a disrupted ssn6-like gene (inact. ssn6-like). According to our interpretation, disruption of the ssn6-like resulting in inact. ssn6-like removes the suppressing effect of ssn6-like on the Pl-promoter, threby activating of the Pl-promoter finally resulting in high expression of LLP-protein or of other GOIs (Gene Of Interest) under control of a LLP-promoter.

FIG. 3C

A gene of interest (GOI) can be introduced into the yeast strain of Fig. B by either homologous recombination thereby replacing the coding region of the LLP-gene by the coding sequence of the GOI (FIG. 3C,=Option 1), and resulting in expression of the GOI (GOI-protein), whereas no LLP-protein is produced.

FIG. 3D

Alternatively a gene of interest (GOI) fused to the LLP-promoter (Pl, GOI) can be introduced into the yeast strain of Fig. B by random recombination leaving the LLP intact and inserting the GOI under control of the LLP-promoter (Pl) into a random position of the yeast genome. This results in concomit expression of the GOI (GOI-prot.) and of LLP (LLP-prot.).

Figure 4:
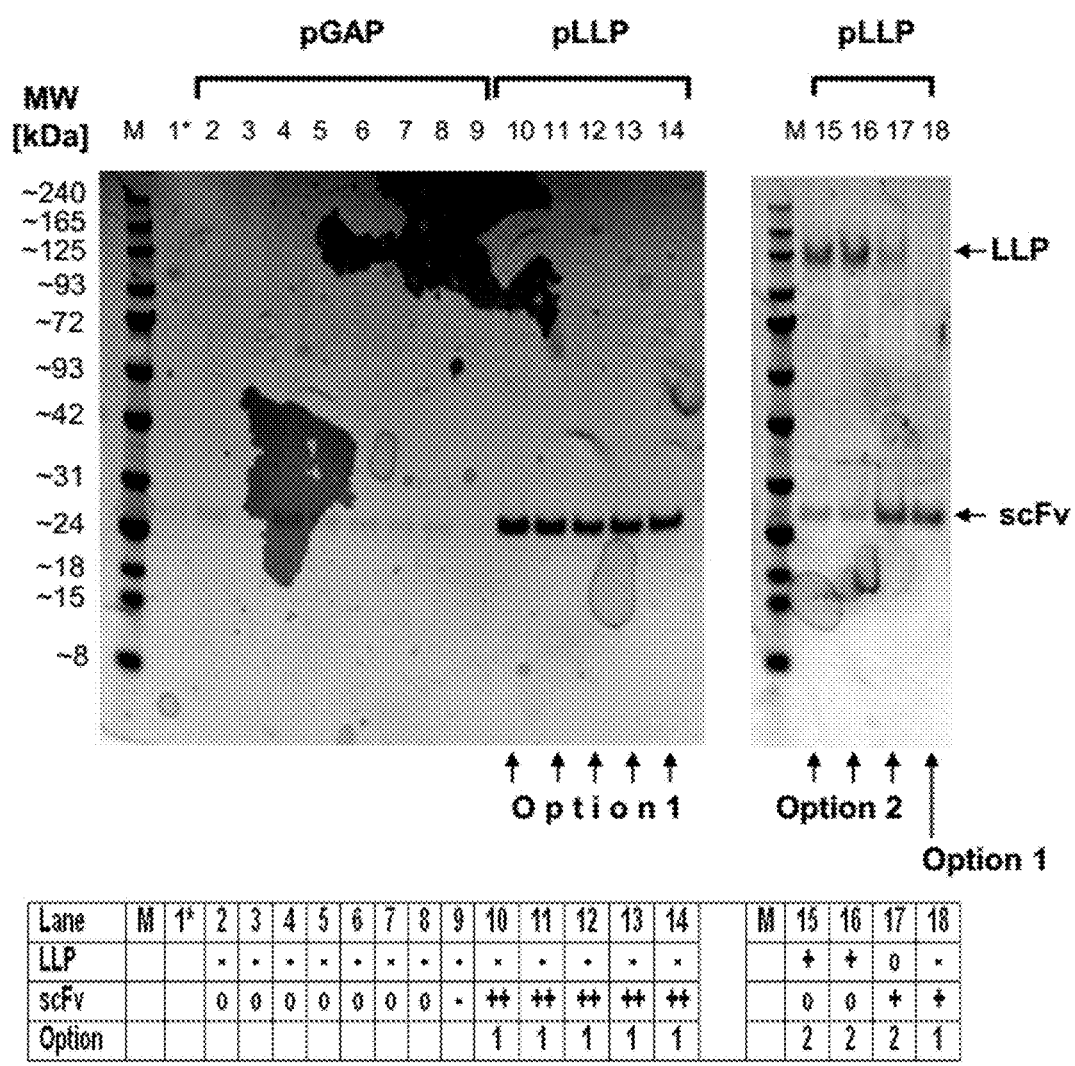

FIG. 4: SDS-PAGE Analysis

A codon optimized (done by DNA2.0 Inc., Menelo Park, USA) DNA sequence encoding the model protein DLX521 (an scFv=single chain variable Fragment of an antibody) was inserted into a plasmid with the GAP-promoter (pGAP=pJ905 from DNA2.0 Inc.) between restriction sites EcoRl and Notl, and a plasmid with the LLP-promoter (pLLP) between restriction sites EcoRV and Notl. The pGAP plasmid was linearized with Swal and transformed in NRRL Y-11430 and the pLLP plasmid was linearized with Avrll and transformed in SSS1. For the pGAP plasmid, transformants were PCR screened and 8 clones with a positive PCR signal were randomly picked and used for glycerol stock preparation. For the pLLP plasmid, transformants were PCR screened and 9 clones with a positive PCR signal were randomly picked and used for glycerol stock preparation. The glycerol stocks of the 8 pGAP and 9 pLLP strains were subjected to expression studies at microtiter plate scale (25° C., 350 rpm, 70 h). The OD (optical density) at 600 nm was comparable at harvest (OD was determined at harvest to check for biomass variability). Subsequently, 15 µL of the samples (supernatant mixed with NuPAGE® LDS sample buffer incl. 2-mercaptoethanol according to manufacturers (Invitrogen/Life Technologies) instructions) were loaded onto the gel.

The SDS-polyacrylamide gel (SDS-PAGE) system used was the Novex NuPAGE® Bis-Tris 4-12% grandient gel (Invitrogen/Life Technologies) using the MES-buffer system (Invitrogen/Life Technologieis), The protein molecular weight marker (M) used was from AppliChem GmbH, Darmstadt, Germany. The used Protein Marker VI, prestained (AppliChem), shows the indicated approximate molecular weights in kilo Dalton (kDa) of the marker proteins if separated in a 10% SDS polyacrylamide gel (SDS-PAGE) using Bis-Tris 10% MES buffer according the manufacturer AppliChem. Loading volume was 15 µl yeast culture supernatand/lane. All pGAP- and pLLP-strains were pre-tested by PCR for scFv. Only scFv-positive strains were subsequently tested for expression of scFv protein. The table below the SDS PAGE gel lists the protein bands at the molecular weight positions of LLP and scFV, the intensity of the protein band (++ strong band, + clear band, o faint band, – no band) as well as the Option according to FIG. 1 to which this yeast clone belongs (Option 1: only GOI is expressed, no LLP; Option 2: GOI and LLP are expressed)

M: Protein Marker VI prestained (AppliChem)

Lane 1 scFv control strain that did not grow very well in deep well plates

Lanes 2-9: strain YJK_PVA_021, expressing low amounts of PVA under control of the GAP-promoter (faint band of scFV protein can be seen in lanes 2-9)

Lanes 10-18: strain PP_ESBA521_010 expressing scFv protein under control of the LLP-promoter.

Lanes 10 to 14: strong protein band at the molecular weight of scFv (see←scFv) ("←" indicates the protein band corresponding to the scFv protein) no protein band at the molecular weight of LLP (see←LLP), example of Option 1 (only expresion of GOI)

Lanes 15 and 16: strong protein band at molecular weight of LLP (see←LLP) ("←" indicates the protein band corresponding to the LLP protein) and clear band of scFv at molecular weight of scFv (see←scFv), example of Option 2 (parallel expression of GOI and of LLP)

Lane 17: clear protein band at molecular weight of LLP (see←LLP) and strong protein band of scFv at molecular weight of scFv (see←scFv), example of Option 2

Lane 18: no protein band at molecular weight of LLP (see←LLP) and strong protein band of scFv at molecular weight of scFv (see←scFv), example of Option 1

The high molecular weight protein band in the gel at the position of about the molecular weight marker 125 kDa represents a dimer of the LLP-protein. The identity of the LLP-protein was proven by the following experiments and evidences. First the LLP-band was cut out of the gel and the C-terminal amino acid sequence was determined by peptide sequencing using standard methods know in the art. Furthermore the LLP-gel band was analyzed by mass spectrometey using standard methods known in the art. Both methods proved that this protein band in the gel indeed is LLP-protein. Furthermore LLP was treted with an enzyme removing glyco-strctures from proteins, namely PNGase F. Treatment of LLP with PNGase F lowered the molecular weight of the LLP-dimer from about 125 kDa to about 110 kDa. Furthermore it is known from the literatrue (IUBMB Live, 2009, 61:252-60), that lectins can form very stable multimers such as dimers. Therefore we conclude the high molecular LLP-protein band in our SDS-PAGE gels is a stable LLP-protein dimer.

Figure 5:
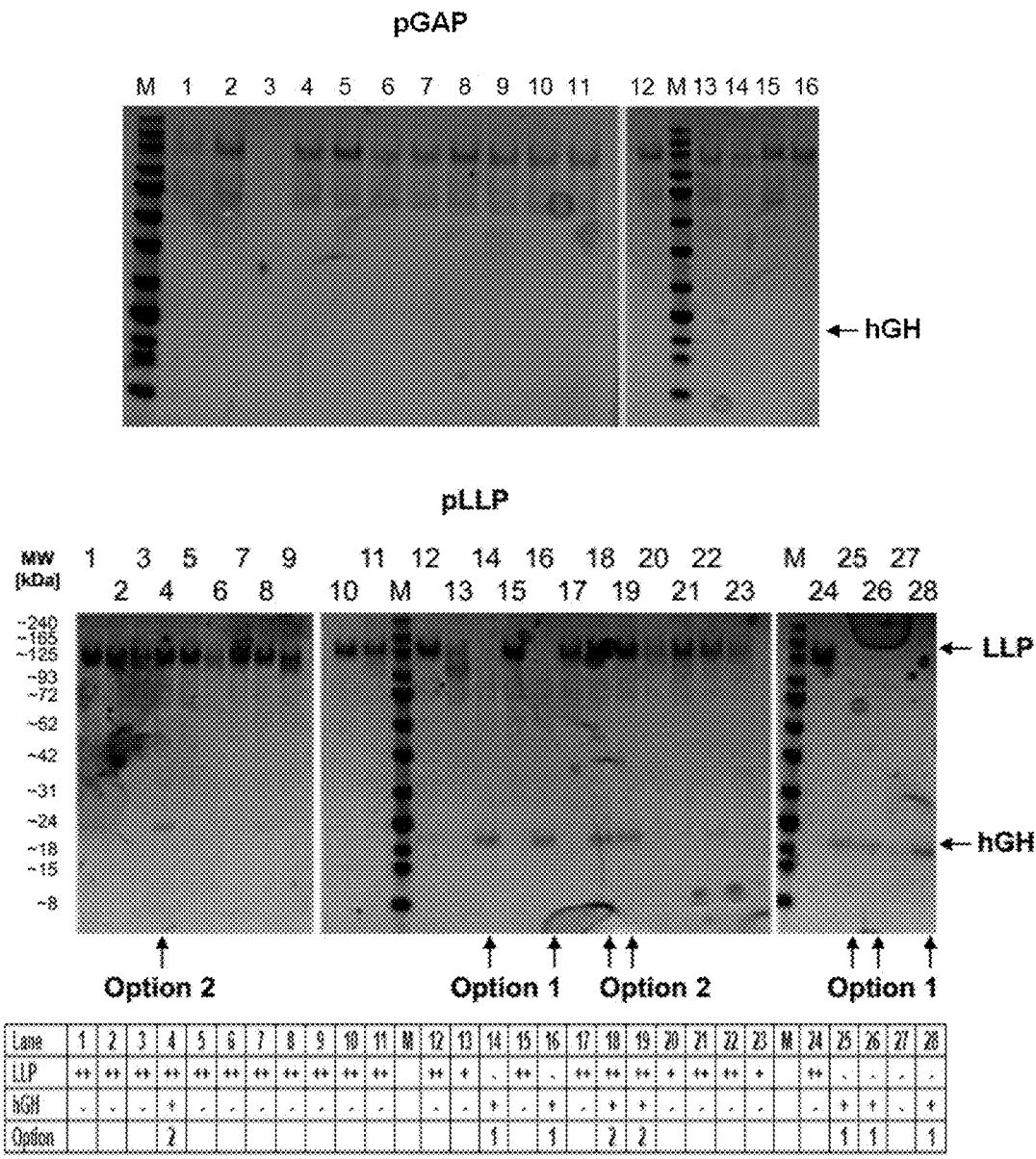
Figure 5:
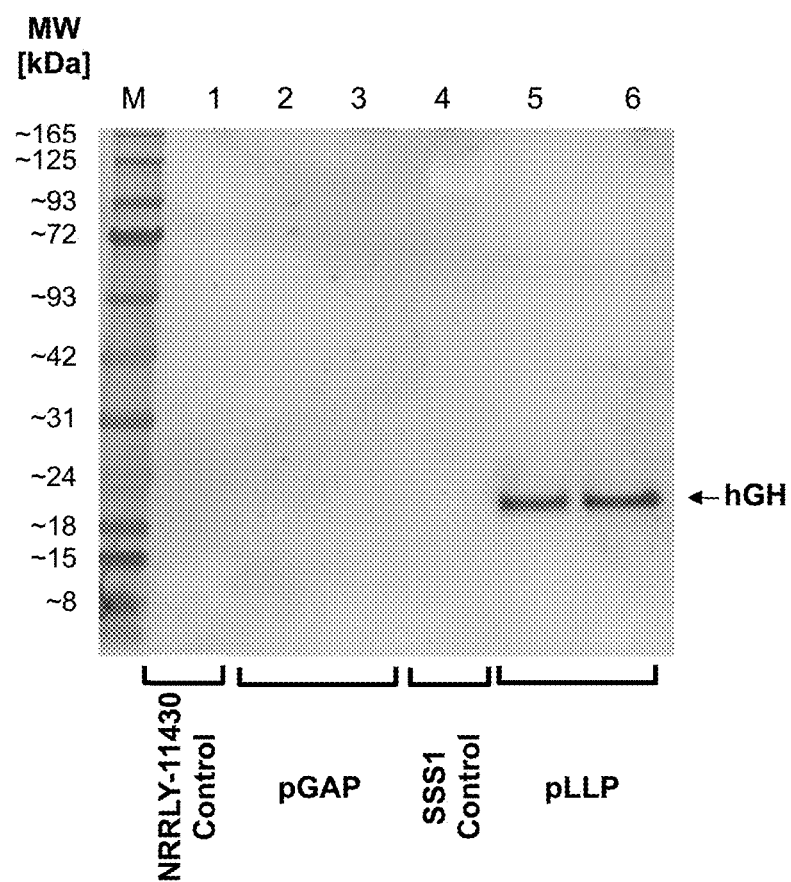

FIG. 5A: SDS PAGE Analysis

A codon optimized DNA sequence (SEQ ID NO: 17) encoding the model protein hGH was inserted into a plasmid with the GAP-promoter (pGAP) and one plasmid with the LLP-promoter (pLLP). The pGAP plasmid was transformed in NRRL Y-11430 and the pLLP plasmid in SSS1. For pGAP, 16 transformants were randomly picked and subjected to expression studies at microtiter plate scale (25° C., 350 rpm, 70 h). For pLLP, 28 transformants were randomly picked and subjected to expression studies at microtiter plate scale (25° C., 350 rpm, 70 h). The OD at 600 nm was comparable at harvest (OD was determined at harvest to check for biomass variability). Subsequently, 15 µL of the samples (supernatant mixed with NuPAGE® LDS sample buffer incl. 2-mercaptoethanol) were loaded onto the gel.

M: Protein Marker VI 10-245 from AppliChem.

pGAP: a protein band corresponding to hGH was detected by visual inspection of SDS-PAGE gels in 0/16 randomly picked clones (without prior PCR screening)

pLLP: a protein band corresponding to hGH was detected by visual inspection of SDS-PAGE gels in 8/28 randomly picked clones (without prior PCR screening)

This result indicates that the pLLP system is superior to the pGAP system.

FIG. 5B: hGH Western Blot 15, 20 or 30 µl supernatant samples of deep well plate cultures of *Pichia pastoris* cells transformed as described under FIG. 5A were directly loaded on SDS-PAGE gels (Novex NuPage 4-12% Bis-Tris Gels from Invitrogen with MES-running buffer). The proteins were then transferred to a PVDF membrane. After transfer and blocking, the membrane was incubated with a solution containing anti-hGH antibody (Zymed Cat.Nr. 18-0090, dilution: 1:1000) for 2 h. After washing the membrane, a secondary antibody coupled with alkaline phosphatase (anti-rabbit IgG alkaline-phosphatase conjugate, Sigma Cat. No. A3687, dilution: 1:16.000) was added for 1 h. After washing the membrane, NBT/BCIP (nitro-blue tetrazolium chloride/5-bromo-4-chloro-3-indolylphosphate toluidine salt) was added to detect hGH.

Figure 6:
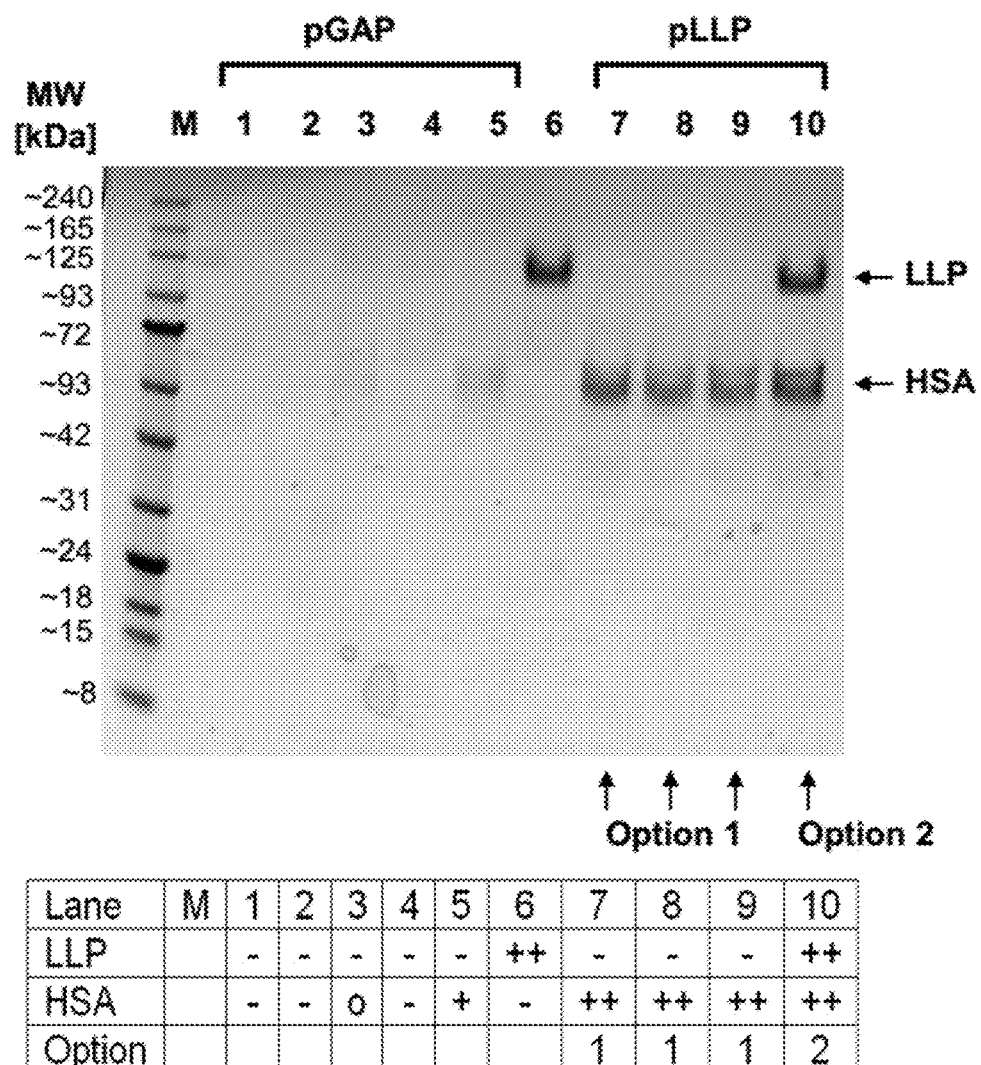

M: Protein Marker VI;
NRRL Y-11430 Control: wild type strain without hGH;
SSS1 Control: supersecretor strain without hGH;
pGAP: expression of hGH under control of GAP-promotor;
pLLP: expression of hGH under control of the LLP-promoter FIG. 6: SDS PAGE Analysis Lane 6 contains a sample of SSS1-cells not tranfected with a pLLP construct (negative control).

SDS-PAGE analysis. A codon optimized DNA sequence encoding the model protein HSA was inserted into on plasmid with the GAP-promoter (pGAP) and one plasmid with the LLP-promoter (pLLP). The pGAP plasmid was transformed in NRRL Y-11430 and the pLLP plasmid in SSS1. Colony PCR was applied to screen for transformants which were then subjected to expression studies at microtiter plate scale (25° C., 350 rpm, 70 h). The OD at 600 nm was comparable at harvest (OD was determined at harvest to check for biomass variability). Subsequently, 15 µL of the samples (supernatant mixed with NuPAGE® LDS sample buffer incl. 2-mercaptoethanol) were loaded onto the gel.

M: Protein Marker VI 10-245 from AppliChem.
pGAP: a faint protein band corresponding to HSA was detected by visual inspection of SDS-PAGE gels in 2/5 selected clones (lanes 3 and 5) (with prior PCR screening)
pLLP: a protein band corresponding to HSA was detected by visual inspection of SDS-PAGE gels in 4/4 selected clones (with prior PCR screening)

This result indicates that the pLLP system is superior to the pGAP system.

FIG. 7 Comparison of pGAP Expression System with pLLP Expression System

This result indicates that the pLLP system is superior to the pGAP system.

7A:

*Pichia pastoris* strains transformed with HSA either under control of the GAP promoter (pGAP =*P. pastoris* glyceraldehyde-3-phosphate dehydrogenase promotor) or under control of the LLP promoter (pLLP=*P. pastoris* Lectin Like Protein promotor) were cultured in a 5 liter fermenter for 144 h at 25° C., pH 6.0 and 30% oxygen, using glycerol in batch growth phase and using constant glucose feed in main growth stage. Culture supernatant was analyzed for HSA employing a Human Serum Albumin ELISA (Enzyme Linked Immuno Sorbent Assay) kit from Cygnus Technologies (Cat. Nr. F055) according to the manufacturer's instructions. Mixtures of transformed yeast strains (pGAP) and mixtures of transformed yeast strains (pLLP) were tested in order to account for expression differences in individual strains, e.g. to determine the average expression rate of pGAP- and of pLLP-strains.

7B:

PVA enzyme assay. A codon optimized DNA sequence encoding PVA (*Pleurotus ostreatus*-Penicillin V Amidase) was inserted into a plasmid with the GAP-promoter (pGAP) and into a plasmid with the LLP-promoter (pLLP). The pGAP plasmid was transformed in NRRL Y-11430 and the pLLP plasmid in SSS1 yeast cells. For each plasmid, 16 transformants were randomly picked and subjected to expression studies at microtiter plate scale (25° C., 350 rpm, 70 h). The PVA titer (g/kg phenoxy actetic acid) and OD at 600 nm were determined at harvest and used for normalization (g/kg phenoxy normalized). The diagram shows the mean value±SEM (standard error of the mean) of PVA activity as measured by PVA-mediated-conversion of phenoxymethylpenicillin into phenoxy acetic acid g/kg. The highest individual value in each group is labeled with an asterix (*). For expression purpose one would usually choose those strains which do express the highest amount of PVA-activity (labeled with * in the diagram). In this case the best strain expressing PVA under control of the pLLP expressed about 2.9-fold more PVA-activity as compared to the best pGAP strain (pGAP: n=13, max. value was 0.17 g/kg, pLLP: n=15, max. value was 0.49 g/kg), The pGAP vector from DNA2.0 Inc. and the pGAP vector from Sandoz are almost identical. All Vector elements such as promoters, terminators, resistance-marker, pUC ori, etc. are the same in both vectors. Only minor differences regarding the used restriction enzyme sites and short nucleotide sequences which connect some of these elements within the vectors and are slightly different between both vectors.

FIG. 8: Expression of Gene of Interest (GOI) in Fermentor Yeast Cultures

8A

A codon optimized DNA sequence encoding the enzyme PVA (Penicillin V Amidase) was inserted into a plasmid under the control of the GAP-promoter (pGAP). The pGAP plasmid was transformed in NRRL Y-11430 yeast cells (*Pichia pastoris*), and cells were grown in a fermentor under standard conditions using standard media and culturing conditions as know in the art. The pGAP vector integrated randomly into the SSN6-gene, thereby activating the LLP-promoter. The superantant of the fermentation culture was subsequently treated with the enzyme PNGase F (Peptide N-Glycosidase F; cleaves asparagine-linked high mannose as well as hybrid complex oligosaccharides from glycoproteins; New England Biolabs, Catalogue Number P0704S). Samples of the untreated cell culture supernatand (lane 1) and of PNGase F-treated cell culture supernatand (lane 2) were separated in SDS-PAGE. Lane 1 shows the glycosylated LLP-dimer as a very strong band at about 125 kDa, whereas the PVA-band is somewhat diffuse at around 72 kDa, probably because individual molecules of PVA are glycosylated to a different extend. Lane 3 shows at about 36 kDa the protein band of the added PNGase F, at about 110 kDa the very strong band of the deglycosylated LLP-dimer (←LLP de-glyc.) and at about 52 kDa a now very clear, distinct band representing declycosylated PVA (←PVA de-glyc.).

8B

A codon optimized DNA sequence encoding a single chain antibody fragment (scFv), in this case the scFv named DLX521, was inserted into a plasmid under control of the LLP-promoter (pLLP). The pLLP plasmid containing a Geneticin resistance was randomly transformed into YJK_PVA_021(the already PVA-transformed yeast cells of FIG. 8A), and cells were grown in a fermentor under standard conditions using standard media and culturing conditions as know in the art. Supernatant of the fermentation was diluted 20-fold and 15 µl were loaded onto SDS-PAGE in the presence of 2-mercaptoethanol. A very strong protein band at the molecular weight position of the scFv is visible in the gel in lane 1. In addition a minor band at the position of the LLP-dimer is seen at about 125 kDa and a strong protein band of PVA is seen at about 72 kDa. No PNGase was added so all proteins are glycosylated. 20-fold dilution of the cell culture supernatand was done in order to depict the very high expression rate of the scFv relative to the LLP. This yeast strain is an example of the "Option 2" as depicted in FIG. 3D, except that 2 GOI are expressed (PVA and DLX521). PVA is under control of the GAP promoter and randomly integrated by chance into the ssn6-like gene.

This is an example showing, that besides the LLP promoter also other promotors, such as the GAP promoter, can be used in conjuction with the expression system of the invention.

8C

This scheme shows the expression construct used in FIG. 8A. A codon optimized DNA sequence encoding the enzyme PVA under control of the GAP-promoter was inserted into a plasmid (pGAP), This pGAP plasmid was transformed in NRRL Y-11430 yeast cells (*Pichia pastoris*), and cells were grown in a fermentor under standard conditions using standard media and culturing. OD600 measurements were used to adjust cell densities. The pGAP vector integrated randomly into the ssn6 gene, thereby activating the LLP-promoter and resulting in an expression of LLP protein.

This expression construct is a proof-of-principle, again showing that interrupting the ssn6 gene results in an improved expression of the gene being under control of the LLP promoter, in this case in an improved expression of the LLP protein, in addition to the expression of the PVA protein.

FIG. 9:

A:

Partial aligment of 39 different protein sequences showing sequence homology to *P. pastoris* SSN6-like protein (CCA36593.1) (SEQ ID NO: 8)

B:

*P. pastoris* SSN6-like consensus sequence 1 (SEQ ID NO: 63)

C:

*P. pastoris* SSN6-like consensus sequence 2 (SEQ ID NO: 64)

Figure 10:
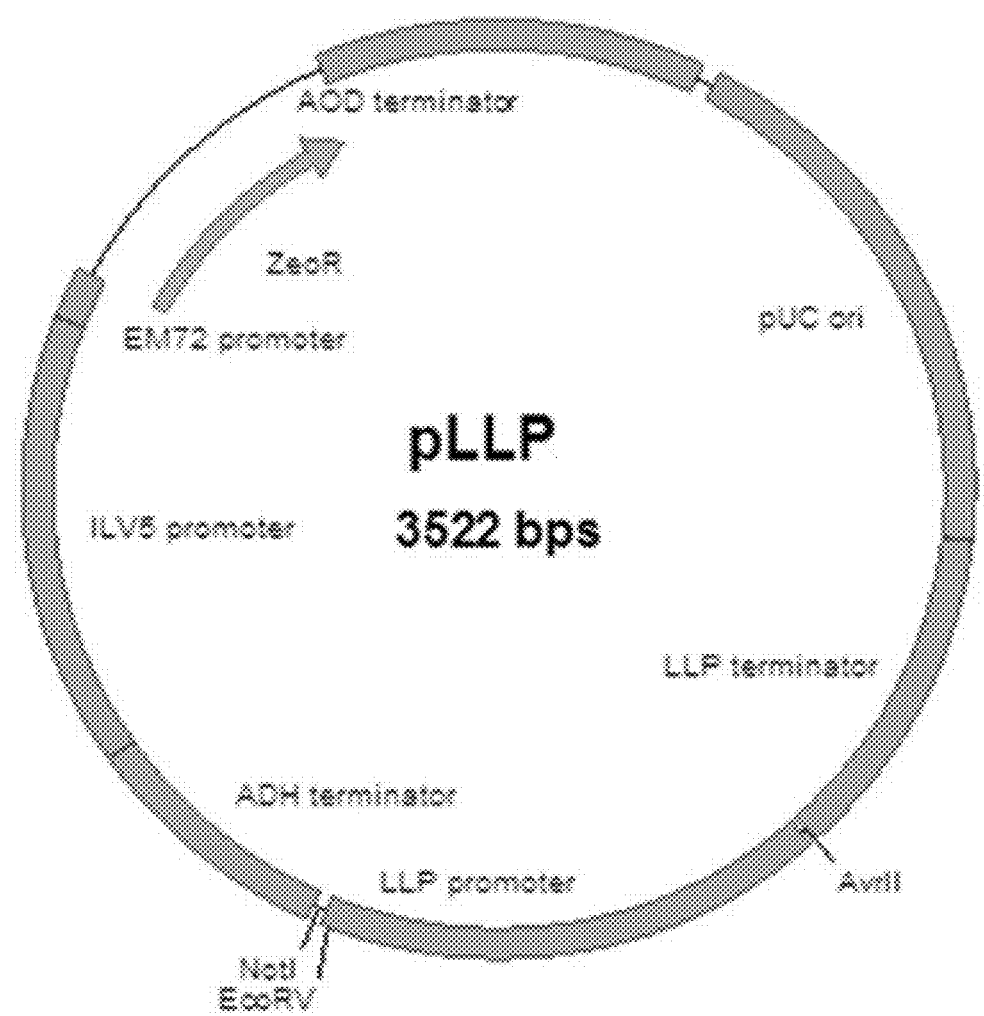

FIG. 10: Expression Vector pLLP

This figure shows the expression vector pLLP without inserted GOI (FIG. 10A), and its full length sequence (FIG. 10B) (SEQ ID NO: 65).

Expression vector (without inserted GOI): The gene of interest (GOI) can be inserted into this vector using the restriction endonuclease cleavage sites NotI and/or EcoRV, resulting in the GOI being under control of the LLP promoter and the ADH terminator. In order to insert the expression vector into the yeast genome, the vector can be linearized by cleaving with the restriction endonuclease AvrII, which restriction site is located between the LLP promoter and the LLP terminator sequence. The resulting linearized vector contains at its 5'-end the LLP promoter and at its 3'-end the LLP terminator. If inserted into the yeast genome by homologous recombination via the LLP promoter- and the LLP terminator-sequences, this homologous recombination removes the native LLP-coding sequence from the yeast genome. At the same time the GOI under control of the LLP promoter and the ADH terminator as well as a Zeocin expression cassette and all other parts of the pLLP vector are inserted into the yeast genome.

Figure 11:
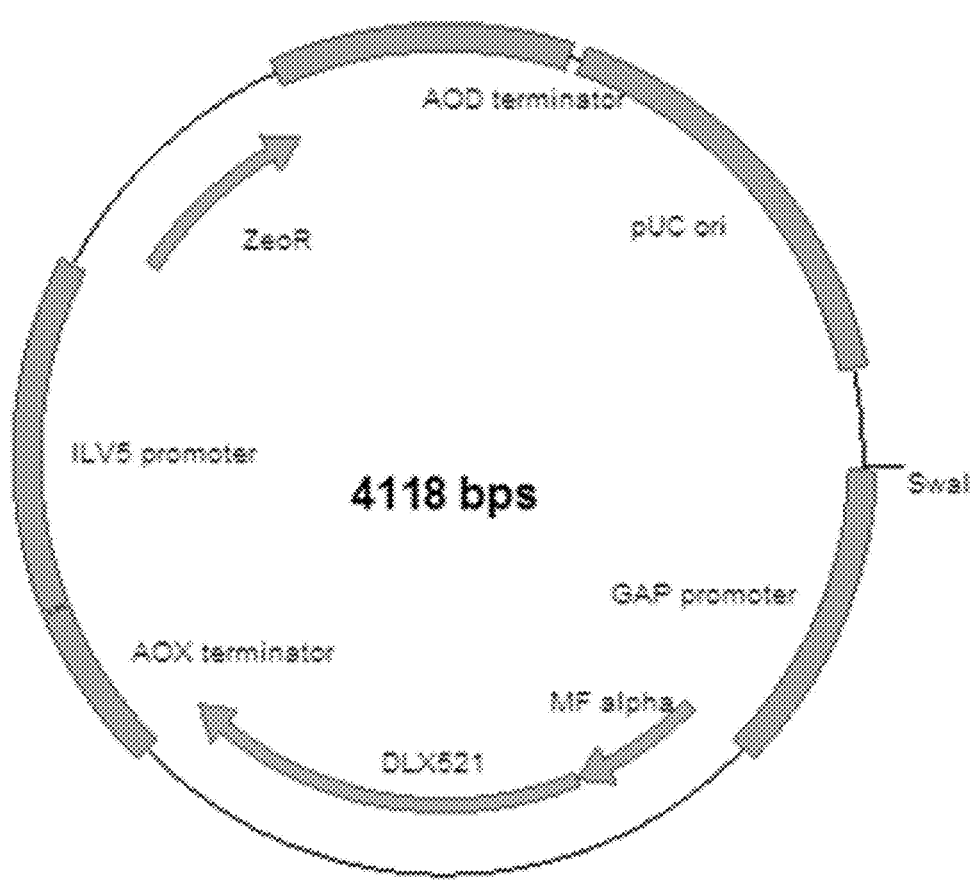

FIG. 11: Expression Vector pGAP with DLX521 as GOI

This figure shows the expression vector pGAP with DLX521 as GOI (FIG. 11A), and its full length sequence (FIG. 11B) (SEQ ID NO: 66).

Linearization of the vector has been carried out with SwaI.

FIG. 12: Expression of HSA Using LLP-Signal Sequence

This figure shows the expression of human serum albumin (HSA) utilizing the secreation signal sequence of LLP. The LLP-signal sequence was fused N-terminally to the coding sequence of HSA (llps-HSA), transformed into yeast cells. 10 randomly picked clones were grown in deep well plates and the supernatant checked for HSA expression (FIG. 12A). One clone was expressed also in a 1 liter fermenter for 48, 72 and 96 hours (FIG. 12B). Expression was shown by SDS-PAGE followed by Coomassie blue staining.

FIG. 13A-D: Analysis of the Functionality of LLP-Promoter Fragments (Truncation Analysis)

The LLP-promoter was successively shortened by cloning of PCR-generated LLP-promoter fragments into YJK_PVA_021 yeast strain. 11 randomly picked clones for each LLP-promoter length were picked and grown in deep well plates and the supernatant analyzed by SDS-PAGE followed by Coomassie blue staining. The lengths of the tested LLP-promoter fragments were as follows: Fig. A: 576 bp, Fig. B: 512 bp, Fig. C: 472 bp, and Fig. D: 372 bp. Each figure shows two representative lines, with "Option 1" denoting that only scFv is expressed, and with "Option 2" denoting that scFv and LLP is expressed.

FIG. 14: Sequences *S. Cerevisae* ssn6 and TUP1 (Complete Coding Region)

This figure shows the respective complete coding region of the following:
A. Ssn6 nucleic acid, of *S. cerevisiae* (SEQ ID NO: 135);
B: SSN6 Protein, of *S. cerevisiae* (SEQ ID NO: 137);
C: Tup-1 nucleic acid of *S. cerevisiae* (SEQ ID NO: 136);
D: Tup-1 protein of *S. cerevisiae* (SEQ ID NO: 138).

METHODS

1. Assessing the amount of a candidate ssn6-like related gene

The level of expression of a candidate ssn6-like related gene can be measured for example by measuring the level of mRNA of said ssn6-like related gene by northern blotting or by quantitative Polymerase Chain Reaction (qPCR) or reverse transcriptase qPCR, or measuring the activity of the promoter of said ssn6-like related gene for example by using luciferase reporter gene assays or by using ssn6-like related promoter-green fluorescent protein (GFP) constructs, etc. All these methods are well known to a person skilled in the art and represent routine work. A textbook comprising protocols for routine methods is for instance Sambrook et al., "Molecular Cloning: A Laboratory Manual", 4$^{th}$ Edition, Cold Spring Harbor Laboratory Press, (2012), referred to herein as Sambrook et al.

2. Assessing whether a candidate ssn6-like related gene resembles the ssn6-like gene as defined herein with respect to function, activity and sequence 2.1 Measuring the amount of LLP protein expressed in cell culture:

The amount of a protein (or its expression level) can be determined according to any suitable method that is known to a person skilled in the art, for instance by measuring the amount of LLP protein in the supernatant of a cell culture by ELISA, by western blotting, or SDS PAGE (sodium dodecyl sulfate polyacrylamide gel electrophoresis) analysis of LLP protein.

In the present invention, the amount of LLP protein in the supernatant has been measured by carrying out a qualitative SDS PAGE analysis (Novex NuPage 4-12% Bis-Tris Gels with MES running buffer, from Invitrogen).

Alternatively the level of LLP protein can be determined indirectly by measuring LLP-mRNA using the same methods as described above in paragraph 1 "Assessing the amount of a candidate ssn6-like related gene".

2.2 Measuring the Amount of a Gene of Interest (GOI) Expressed Under Control of the LLP-Promoter in Cell Culture The same methods for measuring the amount of LLP-protein, as described above under 2.1, can also be used for measuring GOI-protein expressed under control of a LLP-promoter according to the invention.

2.3 Measuring Activity and Function of a Protein

In order to measure the function and activity of SSN6-like protein or SSN6-like related protein, any suitable protocol that is known to a skilled person can be used. Especially any method suitable to measure the functioning of the LLP-promotor can be use to measure the function and activity of SSN6-like protein or SSN6-like related protein, such as the methods mentioned under 2.1 and 2.2 above.

Once an SSN6-like protein or a SSN6-like related protein has been identified, its LLP-promoter-suppressing activity can be inhibited by inactivating the corresponding ssn6-like gene or ssn6-like related gene by methods described elsewhere in this application. Once this blockage has been performed the functioning (meaning the reduced amount of, or the complete lack of) the corresponding SSN6-like protein or mRNA or SSN6-like related protein or mRNA can be measured. Suitable methods are described elsewhere in this application.

PVA enzyme assay: an aliquot of the supernatant was mixed with the substrate Phenoxymethylpenicillin-Kalium and incubated at 22° C. The presence of active PVA enzyme will result in cleavage of the substrate in a titer-dependent manner. The reaction was stopped after 60 min by addition of ice-cold methanol. The amount of the cleavage product phenoxy acetic acid was determined by quantitatve HPLC.

3. Comparison of Different Expression Systems

In order to compare the protein expression of different expression systems, any suitable method that is known to a person skilled in the art can be carried out. In the present invention, the following protocol has been applied for this purpose:

The supernatants obtained from the pLLP expression system and from the pGAP system (same volume) were directly loaded on SDS-PAGE gels for relative comparisons of the pLLP vs. pGAP system.

4. Identification of Regulatory DNA Sequences

There are various tools available to predict regulatory DNA sequences, reviewed for example by Wassermann et al., Nature Reviews Genetics 5, 276-287. There are also tools for the prediction the total length of a promotor sequence, as well as tools predicting distinct positions within such a promoter, which supposedly bind to certain transcription factors, etc. One of these online tools is available from the University of Copenhagen, Bioinformatics Center. We used the JASPAR development server, Version 5.0_ALPHA. Settings of this online tool were: JASPAR CORE fungi, all JASPAR matrix models were choosen (we searched for all transcription recognition sites listed for fungi in the JASPER CORE fungi database), profile score threshold was set to 95%. Our input sequence was the LLP-promoter sequence SEQ ID NO: 12. This anlaysis resulted in 63 predicted binding sites for transcription factors within the tested sequence as shown in the table below.

More details on transcripton factor binding site prediction can be found in Nat Rev Genet. 2004:4, 276-87.

| Model name | Score | Start | End | Strand | predicted site sequence |
|---|---|---|---|---|---|
| SKO1 | 14.890 | 274 | 281 | 1 | ACGTAATG |
| ABF1 | 13.893 | 204 | 219 | -1 | CCGTAAAAAGCGATAC (SEQ ID NO: 116) |
| CST6 | 13.595 | 271 | 279 | 1 | ATGACGTAA |
| SUM1 | 11.962 | 346 | 354 | 1 | ATAATTTTT |
| SPT23 | 11.708 | 750 | 757 | -1 | AAAATCAA |
| SPT23 | 11.708 | 516 | 523 | 1 | AAAATCAA |
| YOX1 | 11.696 | 638 | 645 | -1 | TTAATTAT |
| RFX1 | 11.668 | 39 | 46 | -1 | CGTTGCTA |
| STE12 | 11.624 | 917 | 923 | -1 | TGAAACG |
| YHP1 | 11.563 | 499 | 504 | 1 | TAATTG |
| AFT2 | 11.464 | 69 | 76 | -1 | CACACCCT |
| TEA1 | 11.362 | 265 | 272 | 1 | GCGGACAT |
| YML081W | 11.251 | 72 | 80 | -1 | ACCCCACAC |
| ARR1 | 11.154 | 684 | 691 | -1 | ATTTGAAT |
| TOS8 | 11.143 | 380 | 387 | 1 | GTGTCAAA |
| MBP1::SWI6 | 10.880 | 717 | 723 | 1 | TCGCGTT |
| PHD1 | 10.721 | 104 | 113 | -1 | ACCTGCATCA (SEQ ID NO: 117) |
| YPR022C | 10.671 | 73 | 79 | -1 | CCCCACA |
| YGR067C | 10.573 | 67 | 80 | -1 | ACCCCACACCCTAC (SEQ ID NO: 118) |
| ACE2 | 10.293 | 333 | 339 | 1 | CCCAGCA |
| ADR1 | 10.260 | 74 | 80 | -1 | ACCCCAC |
| MIG3 | 10.179 | 73 | 79 | -1 | CCCCACA |
| STB5 | 10.040 | 835 | 842 | -1 | CGGTATTA |
| MIG2 | 10.037 | 73 | 79 | -1 | CCCCACA |
| MIG1 | 9.822 | 74 | 80 | -1 | ACCCCAC |
| YAP5 | 9.428 | 704 | 709 | -1 | AAGCAT |
| YAP5 | 9.428 | 698 | 703 | 1 | AAGCAT |
| YAP5 | 9.428 | 456 | 461 | 1 | AAGCAT |

| Model name | Score | Start | End | Strand | predicted site sequence |
|---|---|---|---|---|---|
| SIG1 | 9.387 | 222 | 226 | -1 | ATATA |
| ARR1 | 9.314 | 106 | 113 | -1 | ACCTGCAT |
| MOT3 | 9.052 | 296 | 301 | 1 | AAGGTA |
| YAP5 | 8.787 | 259 | 264 | 1 | AAACAT |
| HAP2 | 8.684 | 424 | 428 | 1 | TTGGT |
| HAP2 | 8.684 | 159 | 163 | 1 | TTGGT |
| SKN7 | 8.580 | 401 | 406 | -1 | GGCCAT |
| HAP2 | 8.495 | 665 | 669 | -1 | TTGGC |
| HAP2 | 8.495 | 622 | 626 | 1 | TTGGC |
| HAP2 | 8.495 | 404 | 408 | -1 | TTGGC |
| PHO2 | 8.463 | 436 | 441 | -1 | ATAATA |
| GLN3 | 8.378 | 570 | 574 | 1 | GATAA |
| GLN3 | 8.378 | 6 | 10 | 1 | GATAA |
| MBP1 | 8.257 | 716 | 722 | -1 | ACGCGAT |
| PHO2 | 8.131 | 119 | 124 | 1 | ATATTA |
| PHO2 | 8.131 | 90 | 95 | -1 | ATATTA |
| SKN7 | 8.026 | 403 | 408 | 1 | GGCCAA |
| ARG80 | 7.974 | 956 | 961 | -1 | TGACAC |
| ARG80 | 7.974 | 380 | 385 | -1 | TGACAC |
| YAP5 | 7.933 | 185 | 190 | 1 | AGACAT |
| FZF1 | 7.932 | 551 | 556 | -1 | CTATCA |
| PHO2 | 7.806 | 488 | 493 | 1 | TTATTA |
| PHO2 | 7.806 | 435 | 440 | 1 | TTATTA |
| PHO2 | 7.733 | 638 | 643 | 1 | ATAATT |
| PHO2 | 7.733 | 346 | 351 | 1 | ATAATT |
| PHO2 | 7.733 | 51 | 56 | 1 | ATAATT |
| PHO2 | 7.408 | 640 | 645 | -1 | TTAATT |
| PHO2 | 7.402 | 587 | 592 | -1 | ATATTT |
| GLN3 | 7.272 | 552 | 556 | 1 | GATAG |
| GLN3 | 7.272 | 28 | 32 | -1 | GATAG |
| GLN3 | 7.272 | 2 | 6 | 1 | GATAG |
| HAP2 | 7.252 | 592 | 596 | -1 | TTGGA |
| HAP2 | 7.252 | 529 | 533 | 1 | TTGGA |
| HAP2 | 7.252 | 453 | 457 | -1 | TTGGA |
| HAP2 | 7.252 | 196 | 200 | -1 | TTGGA |

5. Transformation and Cultivation of Strains

Expression constructs were linearized by digestion with suitable restriction enzyme and transformed in Pichia strains by electroporation. The transformants were subseuqently plated on agar plates containing Zeocin (final concentration: 100 mg/L) and/or Geneticin (final concentration: 300 mg/L).

Single colonies or glycerol stocks were subjected to expression studies in 48-well plates using a starch/amylase based cell culture medium. OD (Optical Densitiy) at 600 nm at harvest was around 10, 6. Testing of Promoter Activity Promoter activity can be measured by any suitable method that is known to a person skilled in the art. An example of such a method is the use of qPCR or reporter gene assays (e.g. Luciferase, Green Fluorescent Protein (GFP) etc.), both of which are standard methods that are known to a person skilled in the art. For example the most suitable part of the LLP-promoter for high level expression of a GOI can be determined by successively shortened versions of the LLP-promoter sequence according to SEQ ID NO. 12, by inserting such shortened LLP-promoter sequences together with a Kozak sequence and a model protein sequence such as DLX521 (scFv), hGH, HSA, PVA, etc. and together with a signal sequence such as the MF-alpha pre-pro signal sequence with or without EAEA repeat, the natural signal sequence of said model protein, etc. into a pLLP vector carrying a resistance-marker such as Geneticin, Zeocin, etc. and transfecting such pLLP vetor into a suitable yeast cell such as for example YJK_PVA_021-cells, SSS1-cells, NRRL Y-11430-cells, etc. Individual clones or pooled clones of such transformed yeast cells then can be grown under standard growth conditions in deep well plated, shaker flasks, fermetors, etc. and the amount of expression of said model protein being measured using methods such as SDS-PAGE, ELISA, or protein-activity assays such as the PVA-assay described elsewhere in this application, etc. Shortened versions of the promoter could represent parts of the promoter sequence disclosed in SEQ ID NO: 12, for example a LLP-promoter having a length of 1000, 775, 675, 605, 576, 512, 472, 415, 404, 372, 305, 285, 235, 165, 100 nucleotides, etc. counted in each case from the 3'-end of SEQ ID NO: 12.

7. Assessing Degree of Identity of Nucleotide Sequences or Amino Acid Sequences

"Sequence identity" or "% identity" refers to the percentage of residue matches between at least two polypeptide or polynucleotide sequences aligned using a standardized algorithm. Such an algorithm may insert, in a standardized and reproducible way, gaps in the sequences being compared in order to optimize alignment between two or more sequences, and therefore achieve a more meaningful comparison of the sequences. For purposes of the present invention, the sequence identity between two amino acid or nucleotide sequences is determined using the NCBI BLAST program version 2.2.29 (Jan. 06, 2014) (Altschul et al., Nucleic Acids Res. (1997) 25:3389-3402). Sequence identity of two amino acid sequences can be determined with blastp set at the following parameters: Matrix: BLOSUM62, Word Size: 3; Expect value: 10; Gap cost: Existence=11, Extension=1; Filter=low complexity activated; Filter String: L; Compositional adjustments: Conditional compositional score matrix adjustment. For purposes of the present invention, the sequence identity between two nucleotide sequences is determined using the NCBI BLAST program version 2.2.29 (Jan. 06, 2014) with blastn set at the following exemplary parameters: Word Size: 11; Expect value: 10; Gap costs: Existence=5, Extension=2; Filter=low complexity activated; Match/Mismatch Scores: 2,-3; Filter String: L; m.

8. Generation of the Super-Secretor Strain (SSS1)

An expression cassette encoding the enzyme PVA (Penicillin V Amidase) under the control of the GAP promoter and another expression cassette coding for Zeocin was transformed into the *P. pastoris* strain NRRL Y-11430 (see table below). Clones secreting high levels of active PVA were screened by the following enzyme assay:

The cleavage of the PVA substrate penicillin V to the products 6-APA (6-Aminopenicillanic acid) and phenoxyacetic acid was determined by quantifying the phenoxyacetic acid amount by HPLC, One clone showing high PVA titers was identified and named YJK_PVA_021. Surprisingly, this clone not only secreted high amounts of PVA but also the LLP protein at even higher levels. Thus, YJK_PVA_021 was further characterized by whole genome sequencing done by the company Illumina Inc., San Diego, Calif., USA, After de-novo assembly of the genome done by Illumina Inc. (see SEQ ID NOs: 67-115, showing the results of genomic sequencing), the localization of the sequence of the PVA expression construct was identified to be in SEQ ID NO: 103 and the adjacent genomic sequences were compared to the reference strain (*P. Pastoris* CBS 7435, gi|328351301|emb|FR839629.1|) for identification of the insertion site. A single copy of the expression cassette encoding PVA was found to be integrated randomly at position 807,480 of chromosome 1 of the reference strain Pichia pastoris CBS 7435. This position lies within the ssn6-like gene sequence resulting in disruption of the ssn6-like gene leading to a C-terminal truncated protein (see FIG. 2B, see SEQ ID NO: 9) and to a 3'-truncated coding region of the ssn6-like gene, respectively (for details see FIG. 1S, see SEQ ID NO: 23. No further obvious deviations from the reference sequence were found. Thus, this single random integration event resulted in high level secretion of LLP. The PVA expression cassette was removed from YJK_PVA_021 resulting in clone SSS1 (see also FIG. 3).

The vector pGAPk was PCR-amplified (linearized by PCR) using oligo2395 (TCCTCGTCCAATCAGGTAG; SEQ ID NO: 119) and oligo2398 (AGTGGTACCTGCAGCTAAG; SEQ ID NO: 120) and the PCR-product was transformed into yeast strain YJK_PVA_021. Homologous recombination replaced the pGAP-PVA expression vector containing the Zeocin-resistance marker with the empty vector sequence of pGAPk (empty expression cassette and Geneticin-resistance marker), Clones with Geneticin-resistance and without PVA activity were screened. PVA was measured as indicated above. One strain which does not express PVA but expresses high amounts of LLP was denoted SSS1 and used for subsequent expression studies of different GOIs.

9. Characterization of the LLP Signal Sequence

The secreted LLP protein was N-terminally sequenced by Edman degradation to identify the LLP signal sequence cleavage site (Seq. ID NO. 3, FIG. 1C). In order to proof the general functionality of the LLP signal sequence, resulting in the secretion of heterologous proteins fused to the LLP signal sequence, the following experiments were performed:

The LLP signal sequence was fused to the 3' end of HSA coding sequence replacing the native HSA-signal sequence resulting in the sequence according to SEQ. ID NO: 121, (FIG. 1T) and cloned into the pLLP plasmid via EcoRV and NotI restriction enzyme sites. The HSA coding sequence was codon optimized (done by DNA2.0 Inc., Menelo Park, USA) and a silent point mutation was inserted into the LLP-signal sequence at position 45 exchanging G for a C, which does not change the amino acid sequence of the LLP-signal peptide, but which deletes the restriction enzyme site PstI from the LLP-signal sequence. The resulting plasmid was transformed into SSS1 yest strain. 10 clones were randomly picked and subjected to cultivation in deep well plates. 15-20 µl/lane supernatant of deep well plate cultures were directly loaded on SDS-PAGE gels (Novex NuPage 4-12% Bis-Tris Gels from Invitrogen with MES-running buffer). FIG. 12A shows the results of this experiment: Lanes 3 and 7 represent clones bearing no HSA insert, lanes 2, 4, 8 and 10 represent clones according to option 1 (only HSA expressed), and lanes 1, 5, 6 and 9 represent clones according to option 2 (HSA expressed in parallel to LLP). FIG. 12B shows the result of a 1 liter fermenter expression using the same clone used in lane 2 of the gel in FIG. 12A. A sample from the fermenter supernatant was collected after 48, 72 and 96 hours and 15 µl of each sample subjected to SDS-PAGE, followed by Coomassie blue staining using the "SimplyBlue SafeStain" system from Life Technologies according to the manufacturer's instruction.

10. Characterization of the ssn6-like/LLP-Promoter Expression System

The table below shows the basic characteristics of the expression constructs/vectors and the yeast cells used in order to evaluate the functioning of the expresson system for various classes of proteins/genes of interest (GOIs), namely hormones, antibodies, enzymes and structural proteins. The expression results of GOI depicted in the figures were generated with the expression contructs/vetors/host strain combinations listed in the table below. Comparison of the expression of a GOI using a standard GAP-promoter or the LLP-promoter was done using SDS-PAGE, ELISA and/or enzymatic activity assays, as described in the figures.

| Protein name | Protein class | Codon usage for GOI | Signal sequence | GOI inserted in vector between | Plasmid (linearized with) | Resistance marker | Host strain | Comments |
|---|---|---|---|---|---|---|---|---|
| hGH | Hormone | codon optimized for *Pichia pastoris* | *S. cerevisiae* MF-alpha (without EAEA repeat) | EcoRV and NotI | pLLP (AvrII) | Zeocin | SSS1 | pLLP from Sandoz |
|  |  |  |  | EcoRI and NotI | pGAP (SwaI) | Zeocin | NRRL Y-11430 | pGAP from DNA2.0 (pJ905) |
| DLX521 | Antibody (fragment scFv) | codon optimized for *Pichia pastoris* | *S. cerevisiae* MF-alpha (without EAEA repeat) | EcoRV and NotI | pLLP (AvrII) | Zeocin | SSS1 | pLLP from Sandoz |
|  |  |  |  | EcoRI and NotI | pGAP (SwaI) | Zeocin | NRRL Y-11430 | pGAP from DNA2.0 (pJ905) |
|  |  |  |  | EcoRV and NotI | pLLP (AvrII) | Geneticin | YJK_PVA_021 | pLLP from Sandoz |

-continued

| Protein name | Protein class | Codon usage for GOI | Signal sequence | GOI inserted in vector between | Plasmid (linearized with) | Resistance marker | Host strain | Comments |
|---|---|---|---|---|---|---|---|---|
| PVA | Enzyme | codon optimized for *Pichia pastoris* | *S. cerevisiae* MF-alpha (with EAEA repeat) | EcoRV and NotI | pLLP (AvrII) | Zeocin | SSS1 | pLLP from Sandoz |
|  |  |  |  | EcoRI and NotI | pGAP (BglII*) | Zeocin | NRRL Y-11430 | pGAP from Sandoz |
| HSA | Structural protein | codon optimized for *Pichia pastoris* | Human HSA pre-pro signal sequence | EcoRV and NotI | pLLP (AvrII) | Zeocin | SSS1 | pLLP from Sandoz |
|  |  |  |  | EcoRI and NotI I | pGAP (SwaI) | Zeocin | NRRL Y-11430 | pGAP from DNA2.0 (pJ905) |
|  |  |  | *Pichia pastoris* LLP-signal sequence**, *** | EcoRV and NotI | pLLP (AvrII) | Zeocin | SSS1 | pLLP from Sandoz |

*This plasmid was also linearized by PCR as described elsewhere in this application (see paragraph 8. "Generation of the super secretor strain (SSS1)").
**HSA coding sequence was independently codon optimized resulting in identical amino acid sequences but in slightly different nucleotide sequences as compared to the HSA-sequence one row above
***P. pastoris signal sequence contains a silent point mutation at position 45 changing G to C in order to delete a restriction enzyme site 11. Identification of ssn6-Like Consensus Sequences The ssn6-like sequence of *Pichia pastoris* strain NRRL Y-11430 was used for a BLAST-search of similar sequences. BLAST parameters were "automatically adjust paramters for short input sequences", Expect threshold: 10, Word size: 3, Max matches in a querry range: 0, Matrix: BLOSUM62, Gap Costs: Existence: Extension:1, Compositional adjustments: "Conditional compositional score matrix adjustment. The top 39 sequences originate from the following organisms (also see FIG. 9A):

*Komagataella pastoris* CBS 7435 (Synonym/other names: *Pichia pastoris, Pichia pastoris* CBS 7435), *Komagataella pastoris* GS115 (Synonym/other names: *Pichia pastoris, Pichia pastoris* GS115), *Scheffersomyces stipitis* CBS 6054 (Synonym/other names: *Pichia stipitis, Pichia stipitis* CBS 6054), *Millerozyma farinosa* CBS 7064 (other name: *Pichia farinosa* CBS 7064), *Candida parapsilosis, Candida orthopsilosis* Co 90-125, *Debaryomyces hansenii* CBS767, *Spathaspora passalidarum* NRRL Y-27907, *Candida albicans, Candida albicans* SC5314, *Candida maltosa* Xu316, *Candida tropicalis* MYA-3404 (other name: *Candida tropicalis* T1), *Lodderomyces elongisporus* NRRL YB-4239 (other name: *Saccharomyces elongisporus*), *Clavispora lusitaniae* ATCC 4272 (genebank anamorph: *Candida lusitaniae* ATCC 42720), *Meyerozyma guilliermondii* ATCC 6260 (genebank anamorph: *Pichia guilliermondii* ATCC 6260), *Wickerhamomyces ciferrii, Ogataea parapolymorpha* DL-1 (synonym and other names: *Hansenula polymorpha, Hansenula polymorpha* DL-1, *Ogataea angusta* DL-1, *Ogataea parapolymorpha* ATCC 26012, *Ogataea parapolymorpha* DL-1, *Pichia angusta* DL-1), *Cyberlindnera fabianii* (synonyms and other names: *Hansenula fabianii, Pichia fabianii*, . . . ), *Kuraishia capsulata* CBS 1993, *Dictyostelium discoideum* AX4 (belongs to social amoebae), *Tetrapisispora phaffii* CBS 4417 (synonym: *Fabospora phaffii, Dictyostelium purpureum* (belongs to social amoebae), *Pseudozyma flocculosa* PF-1, *Malassezia globosa* CBS 7966, *Botryobasidium botryosum* FD-172 SS1 (basidiomycete), *Naumovozyma dairenensis* CBS 421 (synonyme; *Saccharomyces dairenensis*), *Tetrapisispora blattae* CBS 6284, *Mucor circinelloides f. circinelloides* 1006PhL (Early diverging fungal lineage), *Malassezia sympodialis* ATCC 42132, *Kazachstania naganishii* CBS 8797 (*Saccharomyces naganishii*), *Saccharomyces cerevisiae* YJM789, *Saccharomyces cerevisiae* FostersB, *Saccharomyces cerevisiae, Saccharomyces cerevisiae* S288c, *Ustilago hordei* (Corn smut fungus, basidiomycete), *Meyerozyma guilliermondii* ATCC 6260 (synonym/other names: *Candida guilliermondii, Pichia guilliermondii* ATCC 6260), *Ustilago maydis* 521, (Corn smut fungus, basidiomycete).

Figure 9A:
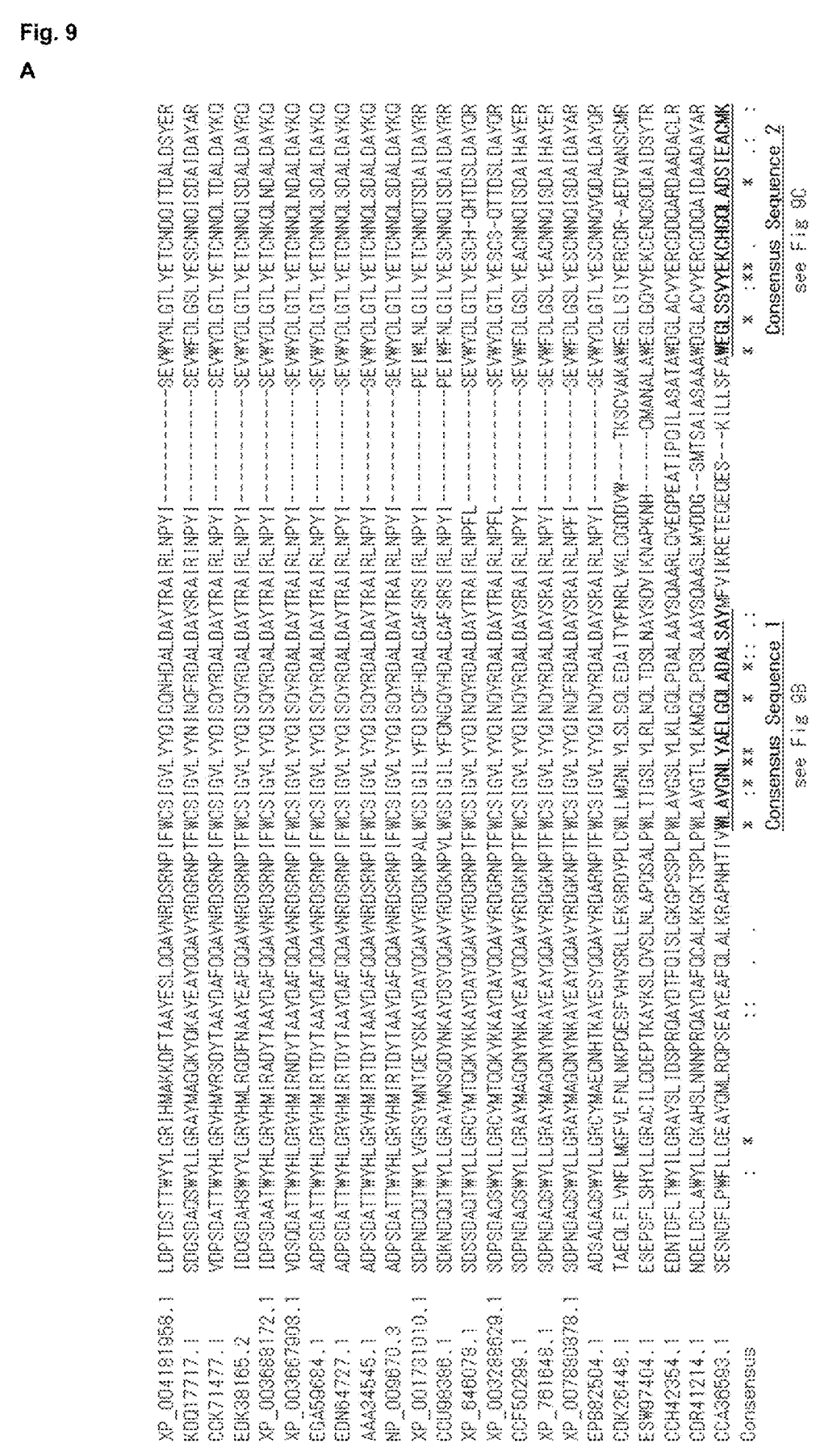
Figure 9:
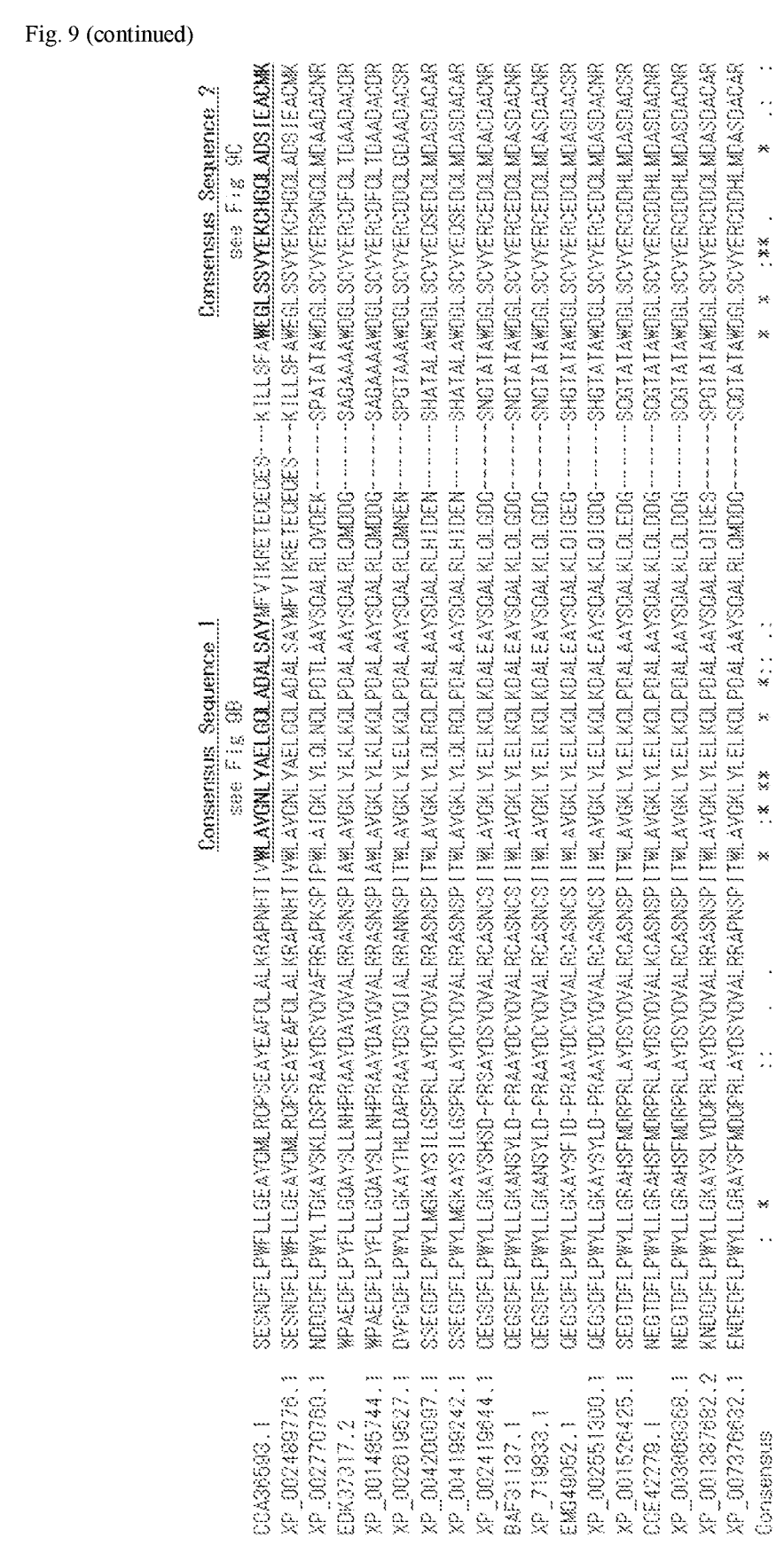

The top 39 identified amino acid sequences were aligned to the ssn6-like-amino acid sequence (=identical to CCA36593.1) revealing significant similarities (see FIGS. 9B and 9C). The alignment was done using the online tool Clustal Omega provided by the EMBL-EBI which is described by Sievers et al., Molecular Systems Biology 7, article number: 539, Valentin et al., Nucleic acids research, 2010, 38, Suppl, W695-9, and by McWilliam et al., Nucleic acids research, 2013, July; 41 (Web Server issue): W597-600. Clustal Omega uses the HHalign algorithm and its default settings as its core alignment engine. The algorithm is described in Söding, J. (2005) 'Protein homology detection by HMM-HMM comparison'. Bioinformatics 21, 951-960. The default transition matrix is Gonnet, gap opening penalty is 6 bits, gap extension is 1 bit. The symbols used for the consensus sequence at the bottom of the alignment are as follows. An "*" (asterisk) indicates amino acid positions which have a single, fully conserved residue across all 40 aligned sequences. A ":" (colon) indicates conservation between groups of amino acids of strongly similar properties—scoring>0.5 in the Gonnet PAM 250 matrix. A "." (period) indicates conservation between groups of amino acids of weakly similar properties—scoring≥0.5 in the Gonnet PAM 250 matrix. Sequence CCA36593.1 corresponds to the *Pichia pastoris* SSN6 sequence identified in this application. FIG. 9A shows only that part of the alignment with the highest similarity between all 40 sequences. FIG. 9B shows the consensus sequence corresponding to Pichia pastoris SSN6-like (CCA36593.1) amino acids 352 to 372. FIG. 9C shows the consensus sequence corresponding to Pichia pastoris SSN6-like (CCA36593.1) amino acids 394 to 417.

Amino acids which are identical in all 40 sequences are written in white with black background-labelling. The consensus sequence shows either individual amino acids which are identical in all 40 sequences or shows a group of amino acids in brackets "( )" and each of the amino acids in such a set of brackets can be chosen alternatively for that position in the consensus sequence. A "-" (dash) indicates that the amino acid at this position may also be omitted from the consensus sequence, which is for example one possibility for positions 406 and 407 of the consensus sequence depicted in FIG. 9C. For example the starting amino acid at position 352 of the consensus sequence in FIG. 9B is "W", meaning that the consensus sequence at this position contains a Tryptophan, position 353 of the consensus sequence in FIG. 9B is written as "(CGL)" meaning that at this position of the consensus sequence can either be located Cysteine, Glycine or Leucine, position 354 is labelled "(SLTA)" meaning that at this position there can either be located Serine, Leucine, Threonine or Alanine, etc. The same nomenclature is used for the second consensus sequence depicted in FIG. 9C. Consensus sequences can be shorter or longer as the two exemplary consensus sequences shown in FIGS. 9B and 9C. Consensus sequences can be deduced from the sequence alignment of FIG. 9A or can be deduced from other parts of the sequence alignment prepared from the 40 above mentioned sequences using the sequence alignment method as described above. Preferably the consensus sequence contains at least 24 amino acids, preferably 23, 22, 21, 20, 19, 18, 17 amino acids, more preferably at least 16, 15, 14, 13, 12, 11, or 10 amino acids, most preferably at least 9, 8, 7, 6, 5 or 4 amino acids. Preferably a SSN6-like protein contains at least one or two consensus sequences, more preferably both consensus sequences shown in FIG. 9B and FIG. 9C, more preferably at least one consensus sequence, most preferably a consensus sequence selected from the sequences shown in FIGS. 9B and 9C.

12. Characterizatin of the Functionality of the LLP-Promoter

The plasmid pLLPk containing DLX521 with MFalpha signal sequence was used as PCR-template in combination with the following PCR-primers to generate shortened/truncated versions of the LLP-promoter (Δ-fragment).

Used reverse primer:

| Primer name | Sequence (5' to 3' end) | Δ-fragment | SEQ ID NO.: |
|---|---|---|---|
| 2892 | TGTCGAACCACCAC TAC | used for all fragments see FIG. 13 A to FIG. 13 D | 122 |

Used forward primer:

| Primer name | Sequence (5' to 3' end) | Δ-fragment | Length of Promoter fragment | SEQ ID NO.: |
|---|---|---|---|---|
| Yo_218 | TATACCTAGGTGGTGGAACT TTATTATTCTTTC | Δ29 | 576 | 123 |
| Yo_219 | TATACCTAGGTATTAGCTGG TAATTGAGCG | Δ93 | 512 | 124 |
| Yo_220 | TATACCTAGGTTGGAGGGT ATGGTCAGAG | Δ133 | 472 | 125 |
| Yo_221 | TATACCTAGGTTTCATTCCA TCTTGCCATC | Δ201 | 404 | 126 |
| Yo_222 | TATACCTAGGCTTACATCAA TAATTAAAAC | Δ233 | 372 | 127 |
| Yo_223 | TATACCTAGGGCAAGCATAT GCTTAAAAGG | Δ300 | 305 | 128 |

The resulting PCR products were ligated in via SpeI and AvrII restriction enzyme sites into the vector pLLPk_containing DLX521. The correct sequences of the resulting plasmids were confirmed by DNA sequencing. The plasmids were linearized with AvrII and transformed in strain YJK_PVA_021. 11 clones per plasmid were randomly picked and subjected to cultivations in deep well plates using a synthetic medium. At harvest, 15 -30 μl supernatant samples were direclty loaded on SDS-PAGE gels (Novex NuPage 4-12% Bis-Tris Gels from Invitrogen with MES-running buffer) to analyze expression of scFv by staining the gels (Simply Blue Safe Stain). The OD600, meaning the yeast cell numbers per ml culture medium at harvest, was comparable for all clones analyzed.

M=Protein Marker VI.

Results are shown in FIG. 13A to FIG. 13D.

13. Examples of ssn6-Like Mutants

The yeast strain contains the modified ssn6-like gene coding for amino acids 1 to 367 and in addition seven amino acids (EWYLQLR; SEQ ID NO: 139) originating from the vector inserted into the ssn6-like gene in order to disrupt the ssn6-like gene. Alternatively, modified versions of ssn6-like might contain a modified ssn6-like gene coding for the following regions of amino acids of SSN6-like protein, to the effect that the modified SSN6-like protein is not able to exert its wildtype function and/or wildtype activity:

Modified versions of SSN6-like protein comprising amino acids 1 to 44, 1 to 77, 1 to 100, 1 to 122, 1 to 155, 1 to 189, 1 to 235, 1 to 275, 1 to 315, 1 to 348, 1 to 400, 1 to 450, 1 to 500, 1 to 550, 1 to 600, 1 to 650, 1 to 367, 1 to 400, 1 to 450, 1 to 500, 1 to 550, 1 to 600, 1 to 650, and/or 1 to 700 of SSN6-like protein according to SEQ ID NO. 9.

In another alternative version the modified versions of ssn6-like might contain the region of the ssn6-like gene coding for blocks of SSN6-like amino acids according to SEQ ID NO. 9, namely amino acids 1 to 44, 45 to 77, 78 to100, 101 to 122, 123 to 155, 156 to189, 190 to 235, 236 to 275, 276 to 315, 316 to 348, 348 to 367, 368 to 400, 401 to 450, 451 to 500, 501 to 550, 551 to 600, 601 to 650, 651 to 700, and/or 701 to 736. Each of these blocks of amino acids might be combined with one or more other blocks of amino acids, preferably in the same order as they occur in SEQ ID NO. 9, wherein none, one or more amino acid block(s) is/are lacking in between two amino acid blocks.

SEQUENCE LISTING (140 sequences)

SEQ ID NO: 1 - DNA, 1869 bp, Pichia pastoris
atgaacgaaccttcacagcctccgccagtgacactggaagtgaggcatgatcccgtaccaacgtctcaagctgactcccagcaacggaaagtggtatatgataaacaactcgagtttcgcaagatagctgtctccacttggctagcgctcggatccatggctcacgaagtccacttgtaccagctggcaattgattcgttcgattttgccctccaaaatgatccattcaacgagaaggctctttgtggactcgcagctgcattgagggctatggatctggtcaaggaccaaacagacggtaccgcagcggccctggatgttatcaacgaccttttatcacgctcatcagagctttacaaagatccatctatctggagagaagctgccgaatgctatctactcttaaacaacacaacgaatgccatggaggccctacaaagatgtattcaattaactcccaacaactctgcattatggttacttaaaggacaaacattgatggccgcaggttccaaacatgaggccgtcgatgcactgaacacagccttggtgaaactccccaatgacgttgcagactatacaaaagaagagattgacgtggcccgttccacccactcagaatttgcctccgttcttgctgcggagggcaacatcgaagctgccagggatgagttggaggccactttggctcttccgcctccctcttcttcccgcttcacagagtattcctctctttggtgcgccctcattagtgctaatgagcgccttggagatatggccaaggcagtgcgcgtctgtgaggaggcatctggactgttaggattcgagccatgcatatatatatgccacgcatacttgttgctactaccgaacagtcacgtatttaacccacagtctgcttgtgtcctgcttcggcaagttgttaattcggaaagcaacgactttctaccatggtttttacttggtgaggcttatcaaatgctgcgccaaccaagcgaggcctacgaagcattccagttggccttgaaaagggctccaaaccacacaattgtatggcttgcagtgggaaacctttatgccgaactgggccagctggctgatgcccttagcgcgtatatgtttgtcatcaaacgtgaaacagaacaagaacaagagagcaagattttgctctcatttgcttgggagggtctttcatcggtgtacgaaaagtgtcatggtcagttggctgactctatagaggcctgtatgaagtcaagcagctatgcaagccaagcgggtgatagctctcgggcaaatttcttgaactcgcgattggaaactttacgaagagtggtatctggagagattccgctttctgattacagaccaagcacatgttgtcaatctccgttatatttactgcgagatcttacttcactgagtatatctgaaagagaaaatttggccaatgcttcgttagatgacatcgcatccgctccagaaatcaagagtagcagcaagaagcgaactgacacttcgagaccaatgcctccctacccgtctcactccgcaaataactataacctaccatccgaagattcacagccacagcgacagaacttaccagttcactcactccctaacgttccattagcacagcaacagcgtgtgcatgctccggcaaacaagaacttgtccccaagcgccgatcagagattctcaattgcaacccatcctcctgttgccccccccacaaatttcccctcgtcctgcttcaccacagttacaacaacaacagcaacaacagcagcaacagtttcaaccacaaaactatcagcactatgcgccttcaccaatgtacccaccttcccaacaatccccattccctga

SEQ ID NO: 2 - DNA, 605 bp, Pichia pastoris
acaaaatggccaagctgggaaacgggatttggtggaactttattattctttctacgatccaagcattatgttgtggaacaaagcgaatactcttattagctggtaattgagcgagttgaaaaaatcaagtctattggagggtatggtcagagtactgatagagatccctgttaagataatcgatctttttcaaatatccaatttcattccatcttgccatcgggtcttggcttcttacatcaataattaaaactacttactctattagtgccaaaaatggtaaaccgtattcaaattgctgcaagcatatgcttaaaaggatcgcgttgcgagcttcttttgagattcgcaagcttgattttatgctcttgtgggaagaaaagcaacccactgaattccagatttgttgtgttttcatgcatggacgacatactttgagtaataccgttactgagattttaccgaattcgcattgcgttgaggcgtgaagtttcttaatgctgtgccatatggttaagttgcgtttcaagatggtccacaagtatttttgtatttaagcagtgtcaattcaagcctaactgctcataaaaactacacggtttgct

SEQ ID NO: 3 - DNA, 75 bp, Pichia pastoris
atgtttgagaagagtaaatttgtggtttcgtttctgcttttactgcagctattttgtgtccttggtgtacatgga

SEQ ID NO: 4 - DNA, 250 bp, Pichia pastoris
acggtcttggagtcatcaggctctgactgggcagctgctgcaactggaacttcccaagcctcccaccaaacagcaggtgtagccgaaagtattcacgtgtcccagaatgaggcccacagtacatctgtcaccgtttctcaacccccttcaacggtttctttgcaaattggagaagcaaataccctgaaatggtcagctttctttggagtagtagttccgctgctcaacgtactcttcgtttaaaagccct

SEQ ID NO: 5 - DNA, 1000 bp, Pichia pastoris
ggaatggaagggtgcagcctctcatttctgttgtgccctttcaaggcgtgtttaccattttcggctgatgggagtggactaaaaggaaattaccctattgacacaatccgactttcgtggatcttgttttagtaaacccatttttgggttgcttttgaacaaaaaaaaagcacaagtctgcatattactaagaattaccatggtaacatattgcacttgcatgcgcagaatgcattaacaacaagcagctcagaaaggctgaaattgaggatacgcgcttcattaaaaaatgctgcgtttgaaaatgtgtgcaacaactttgcatcagcacagaaaacacgacgcagtagtcctagtagggtgatatttggccgccatcttgctctggagtgtcgagttaattattttgccccttgatttcaaaacgttactttgtttcctttttttctagttcaccttttgtacgggttagtaactttgcatatctgattgttacaaaagtggatggcaatgcaagctggatgcgcatgaacagtgttccaggcactaattttaacgtgatgtgtctcttctcgaagatgcattattttatacacagcatcttggttgcattacattatgtatgcacctatcatgtatatatgtacgcccgtaagtaatcgtaggtctaataagcaaacgtatgcagaggttgtaaatttttgaaacgctcagtcggagcatcatttccaaggctaagttgtgttcttcttcttctttcctccctacactcccaaaaattccttgccacttcagatttcttttgtgaaaactttcaatactcagaacactcccctccagactatagagttccactctccccctcctctattcaatttcaactctcttgttgtcaagagatccagtgttagattgttgccacaaggaaagagaaacaaggaaacattccatttcatccattctcgtatcaactggcaccccacgatatttaccactactt

SEQ ID NO: 6 - DNA, 500 bp, Pichia pastoris
acaccagaaaagtttgacttctttcaatcaaatgccgcctattcctccaccacctcctcctcctcaacatcagcaacaccctcagcagatgcacattgtacagcaacaacatgaacagcagcatcatcagcagcagcatctgcacccgcaacatttgatgcctctccctccgttacatcaaggcccacctattcctaagatagagtctccttcatatcggaatcaacagtcattcatggttggggtgccctattcgggggtcggtcctgatggaagaccaatatacgaaccgtctcaattctatgggtcacatcctccggcacgctttgtggttaacgaatagatattataatatgcttatttagtgatcatagcaacgaatatataatcataacagcccaactaaacgttcaacgagcgtttccacatcctgtgcagcctcttgggcgtgcaacagcacttcttcatggctggcatggcctttgctgtcaggtgtttga

SEQ ID NO: 7 - DNA, 1125 bp, Pichia pastoris
atgaacgaaccttcacagcctccgccagtgacactggaagtgaggcatgatcccgtaccaacgtctcaagctgactcccagcaacggaaagtggtatatgataaacaactcgagtttcgcaagatagctgtctccacttggctagcgctcggatccatggctcacgaagtccacttgtaccagctggcaattgattcgttcgattttgccctccaaaatgatccattcaacgagaaggctctttgtggactcgcagctgcattgagggctatggatctggtcaaggaccaaacagacggtaccgcagcggccctggatgttatcaacgaccttttatcacgctcatcagagctttacaaagatccatctatctggagagaagctgccgaatgctatctactcttaaacaacacaacgaatgccatggaggccctacaaagatgtattcaattaactcccaacaactctgcattatggttacttaaaggacaaacattgatggccgcaggttccaaacatgaggccgtcgatgcactgaacacagccttggtgaaactccccaatgacgttgcagactatacaaaagaagagattgacgtggcccgttccacccactcagaatttgcctccgttcttgctgcggagggcaacatcgaagctgccagggatgagttggaggccactttggctcttccgcctccctcttcttcccgcttcacagagtattcctctctttggtgcgccctcattagtgctaatgagcgccttggagatatggccaaggcagtgcgcgtctgtgaggaggcatctggactgttaggattcgagccatgcatatatatatgccacgcatacttgttgctactaccgaacagtcacgtatttaacccacagtctgcttgtgtcctgcttcggcaagttgttaattcggaaagcaacgactttctaccatggtttttacttggtgaggcttatcaaatgctgcgccaaccaagcgaggcctacgaagcattccagttggccttgaaaagggctccaaaccacacaattgtatggcttgcagtgggaaacctttatgccgaactgggccagctggctgatgagtggtacctgcagctaaggtaa

SEQ ID NO: 8 - protein, 622 aa, Pichia pastoris
MNEPSQPPPVTLEVRHDPVPTSQADSQQRKVVYDKQLEFRKIAVSTWLALGSMAHEVHLYQLAIDSFDFALQNDPFNEKALCGLAAALRAMDLVKDQTDGTAAALDVINDLLSRSSELYKDPSIWREAAECYLLLNNTTNAMEALQRCIQLTPNNSALWLLKGQTLMAAGSKHEAVDALNTALVKLPNDVADYTKEEIDVARSTHSEFASVLAAEGNIEAARDELEATLALPPPSSSRFTEYSSLWCALISANERLGDMAKAVRVCEEASGLLGFEPCIYICHAYLLLLPNSHVFNPQSACVLLRQVVNSESNDFLPWFLLGEAYQMLRQPSEAYEAFQLALKRAPNHTIVWLAVGNLYAELGQLADALSAYMFVIKRETEQEQESKILLSFAWEGLSSVYEKCHGQLADSIEACMKSSSYASQAGDSSRANFLNSRLETLRRVVSGEIPLSDYRPSTCCQSPLYLLRDLTSLSISERENLANASLDDIASAPEIKSSSKKRTDTSRPMPPYPSHSANNYNLPSEDSQPQRQNLPVHSLPNVPLAQQQRVHAPANKNLSPSADQRFSIATHPPVAPPTNFPSSCFTTVTTTTATTAATVSTTKLSALCAFTNVPTFPTIPIP

SEQ ID NO: 9 - protein, 374 aa, Pichia pastoris
MNEPSQPPPVTLEVRHDPVPTSQADSQQRKVVYDKQLEFRKIAVSTWLALGSMAHEVHLYQLAIDSFDFALQNDPFNEKALCGLAAALRAMDLVKDQTDGTAAALDVINDLLSRSSELYKDPSIWREAAECYLLLNNTTNAMEALQRCIQLTPNNSALWLLKGQTLMAAGSKHEAVDALNTALVKLPNDVADYTKEEIDVARSTHSEFASVLAAEGNIEAARDELEATLALPPPSSSRFTEYSSLWCALISANERLGDMAKAVRVCEEASGLLGFEPCIYICHAYLLLLPNSHVFNPQSACVLLRQVVNSESNDFLPWFLLGEAYQMLRQPSEAYEAFQLALKRAPNHTIVWLAVGNLYAELGQLADEWYLQLR

SEQ ID NO: 10 - protein, 471 aa, Pichia pastoris
MFEKSKFVVSFLLLLQLFCVLGVHGQESGNGTTSDTAYACDIGATPFDGFNATIYQYQASDDNSIQDPVFMSTGYLQRNQLHSTTGVTNPGFNIFTAGVATTTLYGIPNVNYQNMLLELKGYFRADASGNYGLSLRNIDDSAILFFGRETAFECCNENLIPLDEAPTDYSLFTIKEGEASTNPDSYTYTQYLEAGRYYPVRTFFANIRTRAVFNFTMTLPDGSELTDFQNYIFQFGALNQQQCQAEIVTRENYTTTTEPWTGTFEATTTVIPSGTEPGTVIVQTPYSTIDSTSTWTGTFTTFTTDADGSTIAVVPSSTIDDHFASTETVLTDTAISTTVITVTSCGTSKCTKTTALTGVTQRTLTIDDRTTVVTTYCPLPTDVATIKTASVSGSEVVQTIYTAKHSQAVSYVHPSTVTITREVCDAQTCTQATIVTGEILQTTVVDSGSTTVVPKYVPVETHEPTFELSTL

SEQ ID NO: 11 - DNA, 15 bp, Artificial Sequence
  Kozak sequence
gatatcaaaacgatg

SEQ ID NO: 12 - DNA, 1000 bp, Pichia pastoris
agatagataactacaatttatgaggccctatcgtgaaatagcaacgtagaataatttcctggcagagtagggtgtggggtcagtagaagtaatatccagaagctgatgcaggttattgatattaccacaagattctagcttcaaatgcacagttcggattggtgatccgaagatgctaaaaaaaagacatcaaactccaaaccgtatcgctttttacggcgtatattgttgcacgaaagcgaactataatcatgcagaaaacatgcggacatgacgtaatgtatgcgtttagggaaaggtactgcgtatttcaaacgcatacttagatcgtgcccagcaacccacataattttttcttcaaggtctggacatactggttgtgtcaaaatagggcaacaaaatggccaagctgggaaacgggatttggtggaactttattattctttctacgatccaagcattatgttgtggaacaaagcgaatactcttattagctggtaattgagcgagttgaaaaaatcaagtctattggagggtatggtcagagtactgatagagatccctgttaagataatcgatctttttcaaatatccaatttcattccatcttgccatcgggtcttggcttcttacatcaataattaaaactacttactctattagtgccaaaaatggtaaaccgtattcaaattgctgcaagcatatgcttaaaaggatcgcgttgcgagcttcttttgagattcgcaagcttgattttatgctcttgtgggaagaaaagcaacccactgaattccagatttgttgtgttttcatgcatggacgacatactttgagtaataccgttactgagattttaccgaattcgcattgcgttgaggcgtgaagtttcttaatgctgtgccatatggttaagttgcgtttcaagatggtccacaagtatttttgtatttaagcagtgtcaattcaagcctaactgctcataaaaactacacggtttgct

SEQ ID NO: 13 - protein, 622 aa, Pichia pastoris; identical to SEQ ID NO: 8

SEQ ID NO: 14 - DNA, 255 bp, Artificial Sequence
  MFalpha pre-pro signal sequence without EAEA repeat
atgcgtttcccatcgattttcacagctgttctgtttgcagcttcatctgctttagctgcacctgttaacacaactacagaggacgaaacggcccagatcccagctgaggcagtcattggttattccgatttggaaggtgatttcgatgtcgctgtgttaccattcagtaattccacaaataacggtttgctgttcattaacaccactatagcaagcatcgctgcaaaagaggaaggtgtttccctagaaaagagg

SEQ ID NO: 15 - DNA, 765 bp, Artificial Sequence
  codon optimized DNA sequence of encoding a single chain antibody fragment DLX521
gcccagtccgttttgactcaacccccttccgtatccgcagctccaggccaaaaagtaacgatctcttgttcaggttccactagtaacataggtgacaattatgtgtcatggtaccaacagttgcccggaactgcccctcaactgctgatctacgacaataccaagaggccgtcaggtatcccagacagattttccggttctaagagcggcacatcggctacactaggtatcacgggacttcaaaccggcgacgaggcagattactactgcgcaacttgggataatgataagtggggagttgtttttggaggtggtactaaactcgaagtcttgggtggtggaggaggatcaggaggaggaggttctggaggaggtggttcatctggcggtggatctgaagtgcagcttgtggagagtggtggtggtttggttcaaccaggaggtagcttgagactgtcatgtgccgccagcggttttactttctcctcctatgcaatgtcttgggtcagacaagcacctggtaagggtttggaatgggtatcagctatttcgggtagtggtggttcgacatattatgctgactccgttaaaggtcgttttactatttctagagacaattccaaaaataccttatatcttcaaatgaactcccttagagctgaggatactgctgtttactactgtgctcgtgatgcttggttggatgtgttgtctgacggctttgactactggggacaaggtactttggtcacagtgagcagctga

SEQ ID NO: 16 - DNA, 1416 bp, Pichia pastoris
atgtttgagaagagtaaatttgtggtttcgtttctgcttttactgcagctattttgtgtccttggtgtacatggacaagaaagtggtaacggtaccactagtgacactgcctacgcatgcgacatcggtgcaacaccttttgacggattcaatgctactatttatcagtaccaggcaagtgatgacaattcaatacaggacccggtttttatgagcactgggtacttgcaacgtaaccagttgcatagtacaactggagtgactaatccggggttcaacatcttcactgcaggcgttgccaccacaacactttatgggataccaaacgtcaactaccaaaatatgcttttagaattgaaaggctatttcagagctgacgcctctggaaattatggactatcactaaggaacatcgatgatagtgcgattcttttctttgggagggagactgcgtttgaatgttgcaatgaaaatttgattcccttggacgaagccccaactgattactcactttttaccattaaagaaggggaagcttcaacaaaccccgactcttatacgtacactcaatacttggaggctgggagatactatcccgtaagaactttctttgccaacataagaacgcgtgccgtgttcaactttacgatgacactgccagacgggagtgaactaacagattttcaaaactacatttttcaatttggagctcttaaccaacaacaatgccaagcagaaatagttaccagggaaaattacacaaccaccaccgaaccatggactggtacctttgaagccacgaccacggtgattccaagtggcactgagccaggtaccgtgattgtccagactccttattctactatcgactccacatctacttggaccggtactttcaccactttcaccaccgatgctgatggaagcaccatcgccgttgtgccatcgtcgactattgatgatcactttgcgtcgactgaaactgttttgacagacactgctatttcaactactgttattaccgtgaccagttgtggtaccagtaagtgtaccaagactacagcactaacaggggtgactcagcgaactctcacaatcgatgatagaactactgtcgtgacgacttactgtcctttgccaactgacgttgccactataaaaacagcaagtgttagcggaagtgaggttgtgcaaacaatctacactgcgaaacacagccaggccgtttcttatgttcatccatcaactgttacaatcacaagagaggtatgtgatgcccaaacttgcacgcaggctactattgtgactggagaaattctgcaaactactgttgtggactctggttctacaactgttgttccaaagtatgttccggtggagacgcatgaaccaacatttgaattgagtactctttaa

SEQ ID NO: 17 - DNA, 576 bp, Artificial Sequence
  codon-optimized nucleotide sequence of the human Growth Hormone (hGH)
tttccaaccatcccgctgtccagattgtttgacaatgccatgttgagagcccatcgtttgcatcagctcgcatttgatacgtaccaggaatttgaggaggcttacattccaaaagagcaaaagtatagctttctacagaatcctcagacttcgctgtgtttctctgaatctatccctacacccagtaatagagaagagactcaacaaaagtctaacttggaattgttgagaatatcactgctgttgattcaatcttggcttgaacctgtgcaattcttgagatctgtctttgctaattcacttgtgtatggagcttccgactcaaatgtatacgacctcttaaaagaccttgaagagggcatccaaactttgatgggacgacttgaagatggatcccccaggaccggtcaaatcttcaagcaaacttacagcaagttcgacacaaactcccacaatgatgatgccttattgaaaaactacggattgctatattgttttcgtaaagatatggacaaagtagagacttttctgagaattgttcaatgtagaagtgttgagggttcatgcggtttctaa

SEQ ID NO: 18 - DNA, 1830 bp, Artificial Sequence
  codon optimized nucleotide sequence of the human serum albumin (HSA) incl. the HSA signal sequence as used in the examples of this application
atgaaatgggtgacttttatctccctactgttccttttctcctccgcatactcaagaggtgtttttagaagagatgcccataagagtgaggttgcacacagatttaaggatttgggagaagagaatttcaaggctctggtgttgatagctttcgctcaatacttacaacagtgtccatttgaagatcatgtcaaattggtcaatgaagtaacggagttcgctaaaacatgcgtcgctgacgaatcagctgaaaattgtgataagtcgttacataccttgttcggtgacaaattgtgcacggttgcaacattgcgagaaacatatggcgaaatggcagattgttgcgctaagcaagagcctgaaaggaacgagtgtttcttacagcataaggatgataatccaaacctacctagattggtcagaccagaagttgacgttatgtgtaccgcttttcacgataacgaagagacattcttgaaaaagtacctgtacgaaatcgcaagacgtcatccatacttctatgccccagagctgttgtttttcgcaaaaagatataaggccgcatttactgaatgctgtcaagctgctgataaggctgcttgccttctccctaaactggatgagttgcgtgatgaaggaaaagcaagttcggccaagcaaagactgaagtgtgctagcttacaaaagtttggtgaacgtgcgttcaaggcttgggctgtggcaagattatctcaaagatttcctaaggcagaattcgccgaagtgtcgaaacttgtaaccgaccttactaaagtgcacaccgagtgctgtcatggagatctactcgaatgcgcagacgacagagctgacctggctaagtacatttgtgagaaccaagatagcatttcttccaaattgaaggaatgttgtgaaaaacccttgcttgagaaatctcactgtatcgctgaagttgaaaatgacgagatgcccgccgaccttccaagtttagcagctgactttgttgaatctaaagacgtgtgtaaaaactatgcagaggctaaggacgtctttttgggtatgtttctgtacgagtatgctcgtagacatccagattactccgttgttctgctgttgaggcttgccaagacttacgagacaactttggagaaatgttgtgccgcagcagaccctcacgagtgttatgcaaaagtgtttgatgaattcaagccattggttgaggaaccacagaatctgattaaacaaaactgtgaattgtttgaacaactaggtgagtataagttccagaacgctctgctggttcgttatactaaaaaggttcctcaggtttcaactcctacattggtagaggtcagcagaaatttgggaaaggttggttcaaaatgttgtaaacatcccgaggctaaaaggatgccgtgtgctgaggattacttgtctgtcgtattgaatcagttatgtgtgttacacgaaaagacaccagtctctgatcgtgtgacgaaatgctgcacagagtcactcgttaatcgtagaccttgtttctccgctttggaggtggacgagacttacgtacctaaagagttcaatgctgaaacttttacttttcacgctgacatttgtactctttccgaaaaagagaggcaaatcaaaaagcaaactgctttggttgaattagttaagcataagccaaaagctactaaggagcaacttaaagcagtaatggacgatttcgctgcattcgttgaaaagtgctgtaaagccgacgataaagagacatgttttgcagaggaaggtaaaaagttggtcgctgcctcccaggccgcactaggtttgtaa

SEQ ID NO: 19 - DNA, 1536 bp, Artificial Sequence
  codon-optimized nucleotide sequence of the penicillin V amidase (PVA) as used in the examples of this application
gctagaactaccgagccaatcattgacttaggatacgctagatacagaggttcaatcaacgacactacctctgtcacttcatacctgggtatcagatttgctgaacctccagttgaggacttgagatggagagccccacaacctgctaagagacttcctggtgttcaaaacgccactattgttcctccattgtgtccacaaggtttcatcaacatcttgattccaggaggtattccacctccagacttgaccaacgtttctgaagactgcttgttcttgtccgtttttgcacctagaaagttgccacctaagcgtaaggaattgccagtgattgtttggattcatggtggaggatacatcgtctcctctgcagctactttcgacggaactaacttggttagagagtctaacgactctgtcattgtggtgactatccagtacagactgggaattttcggattcatggctggtaagaagttgaaggataacggagacttgaatgctggattgcttgaccaagagttggctttgaagtgggttcaacagcacattaacaagttcggtggtgaccctaagcaagtgaccatttggggtcaatcagctggaggtggttctgtgttgcaacaggtcattgctcacaacggacaaactaacccaccattgttcagagctgctatgtcttcctctacctaccttccttctcaacaccatttcgacgatcctgttccagaaggtatctactctaccgttgtctcaactgctggttgtgctgatgctactgatcctcttacttgcttgagagcttctaacacctccatcttacaagctgctaacgacaaggcatgtagatccgcattctacggtacttccgttgttgttcctgttgttgatggtgagttcatcacccaaagaccatctgaagctcttagacaaagacgtgtcaacggtaacgctttgttggctatctctaataccaacgaaggtgacatcttcgttgaccaatctaaggctgacactgttactgctgctcagttcgttagagacttgtaccctagattgaacggtgctcaagttgctgaggttgttcgtctgtactctggtttaggtgctccaatccaacaggctgactctatcatgggagatactctgttccaatgtccaaccatttggttctctcaagccttcagacaatctttcaagggtgaatacgctgttcttcctgcattccacggttctgacatttcccagtacttcccatcttttgctcctagattcttcgacgatcctgctttcacttcctctttcactcagtccttcttggacttcgctttgtctcgtaactctgatcctaacgcaaagtttgacgacggtaacttgactcctagatggaacagatacacctcttgctcaaagttcgagatggtgttcaaccgtactgatggtgaagagttggacattagaccagcttctactggtgctggtttgttggagagatgtgcattctgggaatctgtctccgaattgactgctcaataa

SEQ ID NO: 20 - DNA, 3538 bp, Artificial Sequence
  vector pGAPk used for generating the SSS1 yeast cell line (plasmid without a GOI and with a Geneticin resistance marker)
agatccaattcccgctttgactgcctgaaatctccatcgcctacaatgatgacatttggatttggttgactcatgttggtattgtgaaatagacgcagatcgggaacactgaaaaatacacagttattattcagatcttttttgtagaaatgtcttggtgtcctcgtccaatcaggtagccatctctgaaatatctggctccgttgcaactccgaacgacctgctggcaacgtaaaattctccggggtaaaacttaaatgtggagtaatggaaccagaaacgtctcttcccttctctctccttccaccgcccgttaccgtccctaggaaattttactctgctggagagcttcttctacggcccccttgcagcaatgctcttcccagcattacgttgcgggtaaaacggaggtcgtgtacccgacctagcagcccagggatggaaaagtcccggccgtcgctggcaataatagcgggcggacgcatgtcatgagattattggaaaccaccagaatcgaatataaaaggcgaacacctttcccaattttggtttctcctgacccaaagactttaaatttaatttatttgtccctatttcaatcaattgaacaactatcaaaacacagaattcactagtggcgcgccgcggccgctcaagaggatgtcagaatgccatttgcctgagagatgcaggcttcatttttgatacttttttatttgtaacctatatagtataggattttttttgtcattttgtttcttctcgtacgagcttgctcctgatcagcctatctcgcagcagatgaatatcttgtggtaggggtttgggaaaatcattcgagtttgatgtttttcttggtatttcccactcctcttcagagtacagaagattaagtgagaccttcgtttgtgcggatccttcagtaatgtcttgtttcttttgttgcagtggtgagccattttgacttcgtgaaagtttctttagaatagttgtttccagaggccaaacattccacccgtagtaaagtgcaagcgtaggaagaccaagactggcataaatcaggtataagtgtcgagcactggcaggtgatcttctgaaagtttctactagcagataagatccagtagtcatgcatatggcaacaatgtaccgtgtggatctaagaacgcgtcctactaaccttcgcattcgttggtccagtttgttgttatcgatcaacgtgacaaggttgtcgattccgcgtaagcatgcatacccaaggacgcctgttgcaattccaagtgagccagttccaacaatctttgtaatattagagcacttcattgtgttgcgcttgaaagtaaaatgcgaacaaattaagagataatctcgaaaccgcgacttcaaacgccaatatgatgtgcggcacacaataagcgttcatatccgctgggtgactttctcgctttaaaaaattatccgaaaaaattttctagagtgttgacactttatacttccggctcgtataatacgacaaggtgtaaggaggactaaaccatgggtaaggaaaagactcacgtttcgaggccgcgattaaattccaacatggatgctgatttatatgggtataaatgggctcgcgataatgtcgggcaatcaggtgcgacaatctatcgattgtatgggaagcccgatgcgccagagttgtttctgaaacatggcaaaggtagcgttgccaatgatgttacagatgagatggtcagactaaactggctgacggaatttatgcctcttccgaccatcaagcattttatccgtactcctgatgatgcatggttactcaccactgcgatccccggcaaaacagcattccaggtattagaagaatatcctgattcaggtgaaaatattgttgatgcgctggcagtgttcctgcgccggttgcattcgattcctgtttgtaattgtccttttaacagcgatcgcgtatttcgtctcgctcaggcgcaatcacgaatgaataacggtttggttgatgcgagtgattttgatgacgagcgtaatggctggcctgttgaacaagtctggaaagaaatgcataagcttttgccattctcaccggattcagtcgtcactcatggtgatttctcacttgataaccttatttttgacgaggggaaattaataggttgtattgatgttggacgagtcggaatcgcagaccgataccaggatcttgccatcctatggaactgcctcggtgagttttctccttcattacagaaacggctttttcaaaaatatggtattgataatcctgatatgaataaattgcagtttcatttgatgctcgatgagtttttctaacctctaggacaccttacgattatttagagagtatttattagttttattgtatgtatacggatgttttattatctatttatgcccttatattctgtaactatccaaaagtcctatcttatcaagccagcaatctatgtccgcgaacgtcaactaaaaataagctttttatgctcttctctctttttttcccttcggtataattataccttgcatccacagattctcctgccaaattttgcataatcctttacaacatggctatatgggagcacttagcgccctccaaaacccatattgcctacgcatgtataggtgttttttccacaatattttctctgtgctctctttttattaaagagaagctctatatcggagaagcttctgtggccgttatattcggccttatcgtgggaccacattgcctgaattggtttgccccggaagattggggaaacttggatctgattaccttagctgcaggtaccactgagcgtcagaccccgtagaaaagatcaaaggatcttcttgagatcctttttttctgcgcgtaatctgctgcttgcaaacaaaaaaaccaccgctaccagcggtggtttgtttgccggatcaagagctaccaactctttttccgaaggtaactggcttcagcagagcgcagataccaaatactgttcttctagtgtagccgtagttaggccaccacttcaagaactctgtagcaccgcctacatacctcgctctgctaatcctgttaccagtggctgctgccagtggcgataagtcgtgtcttaccgggttggactcaagacgatagttaccggataaggcgcagcggtcgggctgaacggggggttcgtgcacacagcccagcttggagcgaacgacctacaccgaactgagatacctacagcgtgagctatgagaaagcgccacgcttcccgaagggagaaaggcggacaggtatccggtaagcggcagggtcggaacaggagagcgcacgagggagcttccagggggaaacgcctggtatctttatagtcctgtcgggtttcgccacctctgacttgagcgtcgatttttgtgatgctcgtcaggggggcggagcctatggaaaaacgccagcaacgcggcctttttacggttcctggccttttgctggccttttgctcacatgttctttcctgcggtaccc

SEQ ID NO: 21 - DNA, 267 bp, Artificial Sequence
  MFalpha pre-pro signal sequence with the EAEA repeat
atgagattcccatctattttcaccgctgtcttgttcgctgcctcctctgcattggctgcccctgttaacactaccactgaagacgagactgctcaaattccagctgaagcagttatcggttactctgaccttgagggtgatttcgacgtcgctgttttgcctttctctaactccactaacaacggtttgttgttcattaacaccactatcgcttccattgctgctaaggaagagggtgtctctctcgagaagagagaggccgaagct

SEQ ID NO: 22 - DNA, 4974 bp, Artificial Sequence
  pLLP vector containing a Geneticine resistance marker (pLLPk)
aaattttgcataatcctttacaacatggctatatgggagcacttagcgccctccaaaacccatattgcctacgcatgtataggtgttttttccacaatattttctctgtgctctctttttattaaagagaagctctatatcggagaagcttctgtggccgttatattcggccttatcgtgggaccacattgcctgaattggtttgccccggaagattggggaaacttggatctgattaccttagctgcaggtaccactgagcgtcagaccccgtagaaaagatcaaaggatcttcttgagatcctttttttctgcgcgtaatctgctgcttgcaaacaaaaaaaccaccgctaccagcggtggtttgtttgccggatcaagagctaccaactctttttccgaaggtaactggcttcagcagagcgcagataccaaatactgttcttctagtgtagccgtagttaggccaccacttcaagaactctgtagcaccgcctacatacctcgctctgctaatcctgttaccagtggctgctgccagtggcgataagtcgtgtcttaccgggttggactcaagacgatagttaccggataaggcgcagcggtcgggctgaacggggggttcgtgcacacagcccagcttggagcgaacgacctacaccgaactgagatacctacagcgtgagctatgagaaagcgccacgcttcccgaagggagaaaggcggacaggtatccggtaagcggcagggtcggaacaggagagcgcacgagggagcttccagggggaaacgcctggtatctttatagtcctgtcgggtttcgccacctctgacttgagcgtcgatttttgtgatgctcgtcaggggggcggagcctatggaaaaacgccagcaacgcggcctttttacggttcctggccttttgctggccttttgctcacatgttctttcctgcggtacccagatccaattcccgctttgactgcctgaaatctccatcgcctacaatgatgacatttggatttggttgactcatgttggtattgtgaaatagacgcagatcgggaacactgaaaaatacacagttattattcatttaaatcacggtcttggagtcatcaggctctgactgggcagctgctgcaactggaacttcccaagcctcccaccaaacagcaggtgtagccgaaagtattcacgtgtcccagaatgaggcccacagtacatctgtcaccgtttctcaacccccttcaacggtttctttgcaaattggagaagcaaataccctgaaatggtcagctttctttggagtagtagttccgctgctcaacgtactcttcgtttaaaagccctcctaggacaaaatggccaagctgggaaacgggatttggtggaactttattattctttctacgatccaagcattatgttgtggaacaaagcgaatactcttattagctggtaattgagcgagttgaaaaaatcaagtctattggagggtatggtcagagtactgatagagatccctgttaagataatcgatctttttcaaatatccaatttcattccatcttgccatcgggtcttggcttcttacatcaataattaaaactacttactctattagtgccaaaaatggtaaaccgtattcaaattgctgcaagcatatgcttaaaaggatcgcgttgcgagcttcttttgagattcgcaagcttgattttatgctcttgtgggaagaaaagcaacccactgaattccagatttgttgtgttttcatgcatggacgacatactttgagtaataccgttactgagattttaccgaattcgcattgcgttgaggcgtgaagtttcttaatgctgtgccatatggttaagttgcgtttcaagatggtccacaagtatttttgtatttaagcagtgtcaattcaagcctaactgctcataaaaactacacggtttgctgatatcaaaacgatgcgtttcccatcgattttcacagctgttctgtttgcagcttcatctgctttagctgcacctgttaacacaactacagaggacgaaacggcccagatcccagctgaggcagtcattggttattccgatttggaaggtgatttcgatgtcgctgtgttaccattcagtaattccacaaataacggtttgctgttcattaacaccactatagcaagcatcgctgcaaaagaggaaggtgtttccctagaaaagagggcccagtccgttttgactcaacccccttccgtatccgcagctccaggccaaaaagtaacgatctcttgttcaggttccactagtaacataggtgacaattatgtgtcatggtaccaacagttgcccggaactgcccctcaactgctgatctacgacaataccaagaggccgtcaggtatcccagacagattttccggttctaagagcggcacatcggctacactaggtatcacgggacttcaaaccggcgacgaggcagattactactgcgcaacttgggataatgataagtggggagttgtttttggaggtggtactaaactcgaagtcttgggtggtggaggaggatcaggaggaggaggttctggaggaggtggttcatctggcggtggatctgaagtgcagcttgtggagagtggtggtggtttggttcaaccaggaggtagcttgagactgtcatgtgccgccagcggttttactttctcctcctatgcaatgtcttgggtcagacaagcacctggtaagggtttggaatgggtatcagctatttcgggtagtggtggttcgacatattatgctgactccgttaaaggtcgttttactatttctagagacaattccaaaaataccttatatcttcaaatgaactcccttagagctgaggatactgctgtttactactgtgctcgtgatgcttggttggatgtgttgtctgacggctttgactactggggacaaggtactttggtcacagtgagcagctgataagggcggccgcagcgaatttcttatgatttatgatttttattattaaataagttataaaaaaaataagtgtatacaaattttaaagtgactcttaggttttaaaacgaaaattcttattcttgagtaactctttcctgtaggtcaggttgctttctcaggtatagcatgaggtcgctcttattgaccacacctctaccggcatgccgagcaaatgcctgcaaatcgctccccatttcacccaattgtagatatgctaactccagcaatgagttgatgaatctcggtgtgtattttatgtcctcagaggacaaggatccttcagtaatgtcttgtttcttttgttgcagtggtgagccattttgacttcgtgaaagtttctttagaatagttgtttccagaggccaaacattccacccgtagtaaagtgcaagcgtaggaagaccaagactggcataaatcaggtataagtgtcgagcactggcaggtgatcttctgaaagtttctactagcagataagatccagtagtcatgcatatggcaacaatgtaccgtgtggatctaagaacgcgtcctactaaccttcgcattcgttggtccagtttgttgttatcgatcaacgtgacaaggttgtcgattccgcgtaagcatgcatacccaaggacgcctgttgcaattccaagtgagccagttccaacaatctttgtaatattagagcacttcattgtgttgcgcttgaaagtaaaatgcgaacaaattaagagataatctcgaaaccgcgacttcaaacgccaatatgatgtgcggcacacaataagcgttcatatccgctgggtgactttctcgctttaaaaaattatccgaaaaaattttctagagtgttgacactttatacttccggctcgtataatacgacaaggtgtaaggaggactaaaccatgggtaaggaaaagactcacgtttcgaggccgcgattaaattccaacatggatgctgatttatatgggtataaatgggctcgcgataatgtcgggcaatcaggtgcgacaatctatcgattgtatgggaagcccgatgcgccagagttgtttctgaaacatggcaaaggtagcgttgccaatgatgttacagatgagatggtcagactaaactggctgacggaatttatgcctcttccgaccatcaagcattttatccgtactcctgatgatgcatggttactcaccactgcgatccccggcaaaacagcattccaggtattagaagaatatcctgattcaggtgaaaatattgttgatgcgctggcagtgttcctgcgccggttgcattcgattcctgtttgtaattgtccttttaacagcgatcgcgtatttcgtctcgctcaggcgcaatcacgaatgaataacggtttggttgatgcgagtgattttgatgacgagcgtaatggctggcctgttgaacaagtctggaaagaaatgcataagcttttgccattctcaccggattcagtcgtcactcatggtgatttctcacttgataaccttatttttgacgaggggaaattaataggttgtattgatgttggacgagtcggaatcgcagaccgataccaggatcttgccatcctatggaactgcctcggtgagttttctccttcattacagaaacggctttttcaaaaatatggtattgataatcctgatatgaataaattgcagtttcatttgatgctcgatgagtttttctaacctctaggacaccttacgattatttagagagtatttattagttttattgtatgtatacggatgttttattatctatttatgcccttatattctgtaactatccaaaagtcctatcttatcaagccagcaatctatgtccgcgaacgtcaactaaaaataagctttttatgctcttctctctttttttcccttcggtataattataccttgcatccacagattctcctgcc

SEQ ID NO: 23 - DNA, 5920 bp, Artificial Sequence
  Part of the nuceleotide sequence of chromosome 1 of the genomic sequence of yeast strain YJK_PVA_021 after random integration of a PVA- and a Zeocin-expression cassette into the coding region of ssn6-like of P. pastoris
tttctggtgttcagggaatggggattgttgggaaggtgggtacattggtgaaggcgcatagtgctgatagttttgtggttgaaactgttgctgctgttgttgctgttgttgttgtaactgtggtgaagcaggacgaggggaaatttgtgggggggcaacaggaggatgggttgcaattgagaatctctgatcggcgcttggggacaagttcttgtttgccggagcatgcacacgctgttgctgtgctaatggaacgttagggagtgagtgaactggtaagttctgtcgctgtggctgtgaatcttcggatggtaggttatagttatttgcggagtgagacgggtagggaggcattggtctcgaagtgtcagttcgcttcttgctgctactcttgatttctggagcggatgcgatgtcatctaacgaagcattggccaaattttctctttcagatatactcagtgaagtaagatctcgcagtaaatataacggagattgacaacatgtgcttggtctgtaatcagaaagcggaatctctccagataccactcttcgtaaagtttccaatcgcgagttcaagaaatttgcccgagagctatcacccgcttggcttgcatagctgcttgacttcatacaggcctctatagagtcagccaactgaccatgacacttttcgtacaccgatgaaagaccctcccaagcaaatgagagcaaaatcttgctctcttgttcttgttctgtttcacgtttgatgacaaacatatacgcgctaaggtcctcgtccaatcaggtagccatctctgaaatatctggctccgttgcaactccgaacgacctgctggcaacgtaaaattctccggggtaaaacttaaatgtggagtaatggaaccagaaacgtctcttcccttctctctccttccaccgcccgttaccgtccctaggaaattttactctgctggagagcttcttctacggcccccttgcagcaatgctcttcccagcattacgttgcgggtaaaacggaggtcgtgtacccgacctagcagcccagggatggaaaagtcccggccgtcgctggcaataatagcgggcggacgcatgtcatgagattattggaaaccaccagaatcgaatataaaaggcgaacacctttcccaattttggtttctcctgacccaaagactttaaatttaatttatttgtccctatttcaatcaattgaacaactatcaaaacacagaattccgaaacgatgagattcccatctattttcaccgctgtcttgttcgctgcctcctctgcattggctgcccctgttaacactaccactgaagacgagactgctcaaattccagctgaagcagttatcggttactctgaccttgagggtgatttcgacgtcgctgttttgcctttctctaactccactaacaacggtttgttgttcattaacaccactatcgcttccattgctgctaaggaagagggtgtctctctcgagaagagagaggccgaagctgctagaactaccgagccaatcattgacttaggatacgctagatacagaggttcaatcaacgacactacctctgtcacttcatacctgggtatcagatttgctgaacctccagttgaggacttgagatggagagccccacaacctgctaagagacttcctggtgttcaaaacgccactattgttcctccattgtgtccacaaggtttcatcaacatcttgattccaggaggtattccacctccagacttgaccaacgtttctgaagactgcttgttcttgtccgtttttgcacctagaaagttgccacctaagcgtaaggaattgccagtgattgtttggattcatggtggaggatacatcgtctcctctgcagctactttcgacggaactaacttggttagagagtctaacgactctgtcattgtggtgactatccagtacagactgggaattttcggattcatggctggtaagaagttgaaggataacggagacttgaatgctggattgcttgaccaagagttggctttgaagtgggttcaacagcacattaacaagttcggtggtgaccctaagcaagtgaccatttggggtcaatcagctggaggtggttctgtgttgcaacaggtcattgctcacaacggacaaactaacccaccattgttcagagctgctatgtcttcctctacctaccttccttctcaacaccatttcgacgatcctgttccagaaggtatctactctaccgttgtctcaactgctggttgtgctgatgctactgatcctcttacttgcttgagagcttctaacacctccatcttacaagctgctaacgacaaggcatgtagatccgcattctacggtacttccgttgttgttcctgttgttgatggtgagttcatcacccaaagaccatctgaagctcttagacaaagacgtgtcaacggtaacgctttgttggctatctctaataccaacgaaggtgacatcttcgttgaccaatctaaggctgacactgttactgctgctcagttcgttagagacttgtaccctagattgaacggtgctcaagttgctgaggttgttcgtctgtactctggtttaggtgctccaatccaacaggctgactctatcatgggagatactctgttccaatgtccaaccatttggttctctcaagccttcagacaatctttcaagggtgaatacgctgttcttcctgcattccacggttctgacatttcccagtacttcccatcttttgctcctagattcttcgacgatcctgctttcacttcctctttcactcagtccttcttggacttcgctttgtctcgtaactctgatcctaacgcaaagtttgacgacggtaacttgactcctagatggaacagatacacctcttgctcaaagttcgagatggtgttcaaccgtactgatggtgaagagttggacattagaccagcttctactggtgctggtttgttggagagatgtgcattctgggaatctgtctccgaattgactgctcaataagcggccgctcaagaggatgtcagaatgccatttgcctgagagatgcaggcttcatttttgatacttttttatttgtaacctatatagtataggattttttttgtcattttgtttcttctcgtacgagcttgctcctgatcagcctatctcgcagcagatgaatatcttgtggtaggggtttgggaaaatcattcgagtttgatgtttttcttggtatttcccactcctcttcagagtacagaagattaagtgagaccttcgtttgtgcggatccttcagtaatgtcttgtttcttttgttgcagtggtgagccattttgacttcgtgaaagtttctttagaatagttgtttccagaggccaaacattccacccgtagtaaagtgcaagcgtaggaagaccaagactggcataaatcaggtataagtgtcgagcactggcaggtgatcttctgaaagtttctactagcagataagatccagtagtcatgcatatggcaacaatgtaccgtgtggatctaagaacgcgtcctactaaccttcgcattcgttggtccagtttgttgttatcgatcaacgtgacaaggttgtcgattccgcgtaagcatgcatacccaaggacgcctgttgcaattccaagtgagccagttccaacaatctttgtaatattagagcacttcattgtgttgcgcttgaaagtaaaatgcgaacaaattaagagataatctcgaaaccgcgacttcaaacgccaatatgatgtgcggcacacaataagcgttcatatccgctgggtgactttctcgctttaaaaaattatccgaaaaaattttctagagtgttgttactttatacttccggctcgtataatacgacaaggtgtaaggaggactaaaccatggctaaactcacctctgctgttccagtcctgactgctcgtgatgttgctggtgctgttgagttctggactgatagactcggtttctcccgtgacttcgtagaggacgactttgccggtgttgtacgtgacgacgttaccctgttcatctccgcagttcaggaccaggttgtgccagacaacactctggcatgggtatgggttcgtggtctggacgaactgtacgctgagtggtctgaggtcgtgtctaccaacttccgtgatgcatctggtccagctatgaccgagatcggtgaacagccctggggtcgtgagtttgcactgcgtgatccagctggtaactgcgtgcatttcgtcgcagaagagcaggactaacaattgacaccttacgattatttagagagtatttattagttttattgtatgtatacggatgttttattatctatttatgcccttatattctgtaactatccaaaagtcctatcttatcaagccagcaatctatgtccgcgaacgtcaactaaaaataagctttttatgctcttctctctttttttcccttcggtataattataccttgcatccacagattctcctgccaaattttgcataatcctttacaacatggctatatgggagcacttagcgccctccaaaacccatattgcctacgcatgtataggtgttttttccacaatattttctctgtgctctctttttattaaagagaagctctatatcggagaagcttctgtggccgttatattcggccttatcgtgggaccacattgcctgaattggtttgccccggaagattggggaaacttggatctgattaccttagctgcaggtaccactcatcagccagctggcccagttcggcataaaggtttcccactgcaagccatacaattgtgtggtttggagcccttttcaaggccaactggaatgcttcgtaggcctcgcttggttggcgcagcatttgataagcctcaccaagtaaaaaccatggtagaaagtcgttgctttccgaattaacaacttgccgaagcaggacacaagcagactgtgggttaaatacgtgactgttcggtagtagcaacaagtatgcgtggcatatatatatgcatggctcgaatcctaacagtccagatgcctcctcacagacgcgcactgccttggccatatctccaaggcgctcattagcactaatgagggcgcaccaaagagaggaatactctgtgaagcgggaagaagagggaggcggaagagccaaagtggcctccaactcatccctggcagcttcgatgttgccctccgcagcaagaacggaggcaaattctgagtgggtggaacgggccacgtcaatctcttcttttgtatagtctgcaacgtcattggggagtttcaccaaggctgtgttcagtgcatcgacggcctcatgtttggaacctgcggccatcaatgtttgtcctttaagtaaccataatgcagagttgttgggagttaattgaatacatctttgtagggcctccatggcattcgttgtgttgtttaagagtagatagcattcggcagcttctctccagatagatggatctttgtaaagctctgatgagcgtgataaaaggtcgttgataacatccagggccgctgcggtaccgtctgtttggtccttgaccagatccatagccctcaatgcagctgcgagtccacaaagagccttctcgttgaatggatcattttggagggcaaaatcgaacgaatcaattgccagctggtacaagtggacttcgtgagccatggatccgagcgctagccaagtggagacagctatcttgcgaaactcgagttgtttatcatataccactttccgttgctgggagtcagcttgagacgttggtacgggatcatgcctcacttccagtgtcactggcggaggctgtgaaggttcgttcataagtagtggt

SEQ ID NO: 24 - protein, 689 aa, Tetrapisispora blattae CBS 6284
MFPQNNQYITHQPLLNQNAQLNQNAQLNQLTSTYSQAYHASTLQYNNNNNNNNNNNNNNNNRDILPRLNDGPIKSQFPNQDILHLANEHSQVNSSQLNQLHSNQLSASQFHPNQLHINQPNFIQTPENSLPQSQSLPQPKLQLQSQQQTKQQLQYLDPVSHSISETWLAIGTLAETIGDADRAAMAYDTTLNYNEYSTKALTSLASLYRARDMFHKASQLYERALAIDPSLSDIWATLGHCYLMLDDLQKAYNAYQQALNNLSDPNVPKLWHGIGILYDRYGSLDFAEEAFKKVLDLDPNFEKANEIYFRLGIIYKHKGRWNEAIESLNCILKRPPPPLTESDIWFQIGNILENKFDWNGAKDAYEHVSKNNNSNPKLLKQLGCLYSMENVEFYNLDIAMGHLVKSLELDPTDSTTWYYLGRIHMAKKDFTAAYESLQQAVNRDSRNPIFWCSIGVLYYQIGQNHDALDAYTRAIRLNPYISEVWYNLGTLYETCNDQITDALDSYERALSLDPENPVIQGRLNALKIQDKKSEYDPNNVVPSKNLHPSSLSNLNNPQPIVDISTMARPVLQVNTQGTVDNTIMKRESEKDFFHSSDPNMSSSNTPLNNISQSGMPNTKLEAADITKDKPSNSLLPKKRSFADSTTTLVDSSFSSAEIMPLKSIVAKIAFKTSHFNIGNILNKIISCKS

SEQ ID NO: 25 - protein, 1393 aa, Botryobasidium botryosum FD-172 SS1
MHPGPLPRSHSHPRQPALPPPHHAAPAPHAPPPSQPAPQLVSPSVSTASGPLPPRAGPPPLLEPLQKLAKANEETWLLVGSIAEQMSDFERALTAYDHALRHNPESVPALLRVANLARGRDDFIKAIDHWQRVLAIQPDNGEIWSALGHCYLMQDDLQKAYAAYQQALYYLPNPKDPKLWYGIGILYDRYGSLEHAEEAFSSVLRMDPEFEKADEIYFRLGIIYKQQQKYAESLDCFDRILRNPPNPLANLDIWFQIGHVYEQQKDYPQAKSAYERVLAESPNHAKVLQQLGWLYHQPGSNFTNQETAIQYLTKSLESDGSDAQSWYLLGRAYMAGQKYQKAYEAYQQAVYRDGRNPTFWCSIGVLYYNINQFRDALDAYSRAIRINPYISEVWFDLGSLYESCNNQISDAIDAYARAADLDPTNPVIKERLTLLQGIKDNGGSAPAAPGPQDVHPTAYATAHGPPSVMSGHPGGMGLRSGIPGRPDSRGPHAEHSPINGRDLPAPTRGSVEPPFRAFDGPEPFRGGPPPPLNLDDNAARRGQHAPLAPMDVNRQPPGQFPHPATPRSPPGQGSSRQHLHHPQPQNQPHIQSIAQLQSAPSGPLPLGQALPSMVHTPFEAPRESMSPAMGPMGGPPGGMPGIGSMGGGPMPGMSSMGGSNGGVKRWRSPTPPSYAGSYGTRTPGFAHTPQQAQATVQQQQQQQQQIPGQGHPSYGAYPGSVGGTPGERGERERERERVERAERERERERERERVERERERERGMMGGEPSWERRGGEPREREREREREQRERERERERERDRDREMRDARSVHRDQSPHVMAMTMAPPVHSANLNGHPNGNGNGARYNPASDSFEGRPTVSPRVSHSDRDRERERERERMNERERERISERDRERERERERRPMVEGRSPFQTPQPQPYWDTKPAPPAPSSSRTASQSSSEAPPPKRYDPRFDSESAPLPPPPGPPARREMWDREPVAHPAPHTPQPHSVVQTAPPAPPPPPPHPSSQMQAQVQSQSQAQVQSMHVDHPDRGFSATPDAPYRRGGGGPGGNGERWRESESPRPGSARPAAENREKRKRGTGGAGGRENVVEKEGNGKVGKEKKERKATVSKKPKDDGVSGPGSVLTAGNAGGPSGKDEAMGKKHSISSASSASPNGHHGTFKMVSQRAKMSPEMTRPASSAPHEPTPRRLVDEDYDDAADALMDLASNNNNSSNNTMSFAGGKVGGGMSSISNLITPHESAAGAAGAPSQQRSRTPRSASSAHSGSRGSPQTRESPAGRPTPPSPAHENNISQARFENSFNAYPPPSSSARAPGPSSPTSTLKRARSGSLRDDDTKKRFRAEAEQRRTTSPRDSKDTRDARDARESREVVKPAQAKPASPPVAAAVSTGPDGC

SEQ ID NO: 26 - protein, 973 aa, Kazachstania naganishii CBS 8797
MNTTPNTVGAGTAKSSSSKLHRINGESPRTAQNDGSIVIANGAENAAAAAAAAAAQQDPLTQSTAETWLSIASLAETVGDADRAALAYDATLQYNPSSTKALTSLAHLYRSRDMFQRAAELYERALQVNPELSDVWATLGHCYLMLDDLQRAYNAYQQALYHLSNPNVPKLWHGIGILYDRYGSLDYAEEAFAKVLELDPHFEKANEIYFRLGIIYKHQNKWQQALECFRYILQQPPSPLQEWDIWFQLGSVLESMGDWANARDAYENVLVQNEHHAKVLQQLGCLYGMNNVQFYDPQKALNYLLKSLEVDPSDATTWYHLGRVHMVRSDYTAAYDAFQQAVNRDSRNPIFWCSIGVLYYQISQYRDALDAYTRAIRLNPYISEVWYDLGTLYETCNNQLTDALDAYKQAARLDPENIHIRKRLDALTQQLSHPGGQPVQPSQQQQQLPPPPPQTMQHPGIITTTSSEQQAPPVMLQPTLQTTDHTNPLNVRPPVATMYATGPLSQSGAAAVQLQPMPQGLVPQQYEATQQILPQQLASMQHAQVQAQHQQLVQQQAEQQQQQQQQQQAQQQQQAQQQQQHAQQQAQQHAQQQHIMQQQQVQAQAQAQAHALAQAQAQAQAQAPMRLLNNDGANSNITNSGTATLQPILNQPQMLPSGSTVTNQPPSLNSITSVLGNTANSDTASLPKPPIEAHEPEGARKRSVSGNIQTLVNAAVSSADATEREEEHDFNEPQTKKVKTEETSAPTVGEPTVVHNVSDTVHEQEPPSGPLTKEKTPVSSPAVAPAVDNAAPAAKELTPPVSKTATEPTGANTTVVREEPTETSAGPAPVTPSVPAAPITSALTEPTTAAVPTVANPVDEEKKEVAPSTAAELTASASPHTAPALSLSSKVAPEQSKESTAEDPNDSAATEAGQTTIDEKPEEDIVIKPSAEAIEKLKEEAKLREEEKRSKAMVLALTTDLREPMTRQMKARN

SEQ ID NO: 27 - protein, 502 aa, Meyerozyma guilliermondii ATCC 6260
MATLPVMPKQNGIVPRETPSMLEETTTSTWLAIGSLAESLGDYERALASYDSALRHSPNNLEALIGLANIYRSRDVFFKAAELYEQALNYSPENGETWGLLGHCYLMLDDLQRAYAAYQRALYYLDNPNVPKLWHGIGILYDRYGSLEYAEEAFVRVLELDPKFDKSNEIYFRLGIIYKHQGKLQSALECFQYILASPPQPLTQPDVWFQIGSVLEQQKDWNGAKEAYERVLQVNPQHAKVLQQLGCLYSQAEPAKPDQNQPFQQDLTQALKYLSSSLEIDQSDAHSWYYLGRVHMLRGDFNAAYEAFQQAVNRDSRNPTFWCSIGVLYYQISQYRDALDAYTRAIRLNPYISEVWYDLGTLYETCNNQISDALDAYRQAERLDPGNPHIKARLDQLIKYQQEGNTHPPQPPPVSQQPRLPQGMVLESTVPTPPLGGNGANNAPGAPGPPGAAPVGLPPAPHGQPGQPPMPAPGPLSFSQQNQPPPPGIKKPKTTTKREFGR

SEQ ID NO: 28 - protein, 1043 aa, Tetrapisispora phaffii CBS 4417
MNSATAQPAQPLVNAVNMQQQQQQQQKLGQPNSQENIQIQQVQHPPLDPLTQSTAETWLSIASLAETVGDTDRAAMAYDTTLQYNPASTKALTSLAHLYRSRDMFQRAAELYERALSVNPELSDVWATLGHCYLMLDDLQRAYNSYQQALYYLSNPNVPKLWHGIGILYDRYGSLEYAEEAFAKVLELDPNFDKANEIYFRLGIIYKHQGKWTQALECFRYILPQPPSPLQEWDIWFQLGSVLESMGEWQGAKEAYENVLVQNEHHAKVLQQLGCLYGMNNTQFYDPQKALNLLLKSLEIDPSDAATWYHLGRVHMIRADYTAAYDAFQQAVNRDSRNPIFWCSIGVLYYQISQYRDALDAYTRAIRLNPYISEVWYDLGTLYETCNKQLNDALDAYKQAARLDPDNVHIRERLESLAQQLQNPNNAQQQAGQHPGAPGQTNDIANAPVMLQPTLQSNDRVNPLNVRPLSLQQQQQGVYGQVLEQHTEQAYAQPLVDVNGELQGLPIQQVQQMNLQQMQQQQQQQQQQQQQQQQQQQQQQQQQQQQQQQQQQAQQAQQAQQAQQAQQAQQAQQAQQAQQAQQAQQAQQAQQAQQAQQAQQAQQAQRAQLHQLPPAPVLQQEQANAPPVALGSTMVPPLQTTQIAPISIPTSVPGASESVTAPSIPPISMVDHEKMPAPQLQPIQASTIQQPTEPVKTETENDSDGSSNKRTVDDGINTLVNAAVSSESAKTSTEKSEEPSQKKLKRSSPVTVPAEPYSFTRCHRTTVEELPIEPKPVIEATVLPLAIESAVPVAETVAPVGAATPVVDAAAPFVASETPVVESATPIVESATPAAEASAPITETAAPTVTSVTPVAESTATVNESTYTATETVVTSNADSSVTTSIQEKKVDESISQAVQEETKLAEEGKTESVDSNTVPDSNTDDIPATIEVTKAEPETKSSENIKETPVHAETSTTSPVAPASEIAVTSEGEKKKDEEAKVASEPTIKPTAEALEKLEEEAKLREEDNLEKEVASEQKPTKESFPKENAVREVEEDENYDE

SEQ ID NO: 29 - protein, 1007 aa, Naumovozyma dairenensis CBS 421
MTATSQNQLQQGKTQQPSPPQLQQPTQQQQQQAQVQAQGQAQAIIQQQQQQPLDPVAQATAETWLSIASLAETVGDADRAAMAYDATLQYNPQSTKALTSLAHLYRSRDMFQRAAELYERALQYNPDLSDVWATLGHCYLMLDDLTRAYNSYQQALYHLTNPNVPKLWHGIGILYDRYGSLDYAEEAFAKVLELDPHFEKANEIYFRLGIIYKHQGKWNQALECFRYILNQPPAPLQEWDIWFQLGSVLESMGEWTGAKEAYEHVLLQNEHHAKVLQQLGCLYGMNNVSFYDPQKALGYLLKSLEVDSQDATTWYHLGRVHMIRNDYTAAYDAFQQAVNRDSRNPIFWCSIGVLYYQISQYRDALDAYTRAIRLNPYISEVWYDLGTLYETCNNQLNDALDAYKQAARLDPENIHIRKRLESLNQQLSNPNQQQQQQQQQQQQQITNNNNNGMIQTQNPPAVGNNPMITNNGENTTINNPNPPVMLQPSLQQNDQSNPLNVRPQSTAMYPTNPLAEQQQQALQQQQQALQQQALQPGTQQYLNQLQQTQSYSPNTAMLGPQQLQTQVPAQQQQQAQQQEQPQLQNENKPAVTGPPLLSQSAILQREQQQQQQQQQQQQQQQQQQQQEQIQEAQQQAQAQAQQQAQAQAQAEAQAQAQAQAHAEQQAQQQKQIQEQVEQHQQYQQQLQETQATKPLQPPSTTTTTTTKENVLPQKRSADGNIQTLVNAAVSSSSEPASSIPIPAQPPASAIATTTIPQIYNTQPTIPPTEDKTIVSQKQPVIISETREEPQSKKSKLNETVSSSTTNMAEKEVTPPPNVIPQPSLNEQPTIRTESPVSHSETKPVAEIQENGTDNNKVIPEVEEAKLIANPTQTQPIVTTSDQSVVNDSTTATTAPSAPPASVIENNKEEVKTPGATDNGSTTVEDNESNIVIKPTAEALEKVQEETRIREEEERERLEGAMKTNDDNNSSAIGAGLNHTSANANNEVKQPLRETVVRQVEEDENYDE

SEQ ID NO: 30 - protein, 803 aa, Saccharomyces cerevisiae FostersB
MEQPAQQQQQQQQQQQQQQQQAAVPQQPLDPLTQSTAETWLSIASLAETLGDGDRAAMAYDATLQFNPSSAKALTSLAHLYRSRDMFQRAAELYERALLVNPELSDVWATLGHCYLMLDDLQRAYNAYQQALYHLSNPNVPKLWHGIGILYDRYGSLDYAEEAFAKVLELDPHFEKANEIYFRLGIIYKHQGKWSQALECFRYILPQPPAPLQEWDIWFQLGSVLESMGEWQGAKEAYEHVLAQNQHHAKVLQQLGCLYGMSNVQFYDPQKALDYLLKSLEADPSDATTWYHLGRVHMIRTDYTAAYDAFQQAVNRDSRNPIFWCSIGVLYYQISQYRDALDAYTRAIRLNPYISEVWYDLGTLYETCNNQLSDALDAYKQAARLDVNNVHIRERLEALTKQLENPGNINKSNGAPTNASPAPPPVILQPTLQPNDQGNPLNTRISAQSANATASMVQQQHPAQQTPINSSATMYSNGASPQLQAQAQAQAQAQAQAQAQAQAQAQAQAQAQAQAQAQAQAQAQAQAQAQAQAQAQAQAQAQAQAQAQAQQQQQQQQQQQQQQQQQQQQQQQQQQQQQQQQQQQQQLQPLPRQQQQQKGVSVQMLNPQQGQPYITQPTVIQAHQLQPFSTQAMEHPQSSQLPPQQQQLQSVQHPQQLQGQPQAQAPQPLIQHNVEQNVLPQKRYMEGAIHTLVDAAVSSSTHTENNTKSPRQPTHAIPTQAPATGITNAEPQVKKQKLNSPNSNINKLVNTATSIEENAKSEVSNQSPAVVESNTNNTSQEEKPVKANSIPSVIGAQEPPQES

SEQ ID NO: 31 - protein, 979 aa, Saccharomyces cerevisiae YJM789
MNPGGEQTIMEQPAQQQQQQQQQQQRQQQQAAVPQQPLDPLTQSTAETWLSIASLAETLGDGDRAAMAYDATLQFNPSSAKALTSLAHLYRSKDMFQRAAELYERALLVNPELSDVWATLGHCYLMLDDLQRAYNAYQQALYHLSNPNVPKLWHGIGILYDRYGSLDYAEEAFAKVLELDPHFEKANEIYFRLGIIYKHQGKWSQALECFRYILPQPPAPLQEWDIWFQLGSVLESMGEWQGAKEAYEHVLAQNQHHAKVLQQLGCLYGMSNVQFYDPQKALDYLLKSLEADPSDATTWYHLGRVHMIRTDYTAAYDAFQQAVNRDSRNPIFWCSIGVLYYQISQYRDALDAYTRAIRLNPYISEVWYDLGTLYETCNNQLSDALDAYKQAARLDVNNVHIRERLEALTKQLENPGNINKSNGAPTNASPAPPPVILQPTLQPNDQGNPLNTRISAQSANATASMAQQQHPAQQTPINSSATMYSNGASPQLQAQAQAQAQAQAQAQAQAQAQAQAQAQAQAQAQAQAQAQAQAQAQAQAQAQAQAQAQAHAHAQAQAQAQAQAQAQAQAQAQQQQQQQQQQQQQQQQQQQQQQQQQQQQLQPLPRQQLQQKGVSVQMLNPQQGQPYITQPTVIQAHQLQPFSTQAMEHPQSSQLPPQQQQLQSVQHPQQLQGQPQAQAPQPLIQHNVEQNVLPQKRYMEGAIHTLVDAAVSSSTHTENNTKSPRQPTHAIPTQAPATGITNAEPQVKKQKLNSPNSNINKLVNTATSIEENAKSEVSNQSPAVVESNTNSTSQEEKPVKANSIPSVIGAQEPPQEASLAEEATKAASVSPSTKPLSTEPESSSVQPTVSSESSTTKANDQSTAETIELSTATVPAEASPVEDEVRQHSKEANGTTEASAPSTEEAEPAASRDAEKQQDETAATTITVIKPTLEPMETVKEEAKMREEEQTSQEKSPQENTLPRENVVRQVEEDENYDD

SEQ ID NO: 32 - protein, 966 aa, Saccharomyces cerevisiae
MNPGGEQTIMEQPAQQQQQQQQQQQQQQQQAAVPQQPLDPLTQSTAETWLSIASLAETLGDGDRAAMAYDATLQFNPSSAKALTSLAHLYRSRDMFQRAAELYERALLVNPELSDVWATLGHCYLMLDDLQRAYNAYQQALYHLSNPNVPKLWHGIGILYDRYGSLDYAEEAFAKVLELDPHFEKANEIYFRLGIIYKHQGKWSQALECFRYILPQPPAPLQEWDIWFQLGSVLESMGEWQGAKEAYEHVLAQNQHHAKVLQQLGCLYGMSNVQFYDPQKALDYLLKSLEADPSDATTWYHLGRVHMIRTDYTAAYDAFQQAVNRDSRNPIFWCSIGVLYYQISQYRDALDAYTRAIRLNPYISEVWYDLGTLYETCNNQLSDALDAYKQAARLDVNNVHIRERLEALTKQLENPGNINKSNGAPTNASPAPPPVILQPTLQPNDQGNPLNTRISAQSANATASMVQQQHPAQQTPINSSATMYSNGASPQLQAQAQAQAQAQAQAQAQAQAQAQAQAQAQAQAQAQAQAQAQAQAHAQAQAQAQAKAQAQAQAQAQQQQQQQQQQQQQQQQQQQQQQQQQQQQQQQLQPLPRQQLQQKGVSVQMLNPQQGQPYITQPTVIQAHQLQPFSTQAMEHPQSSQLPPQQQQLQSVQHPQQLQGQPQAQAPQPLIQHNVEQNVLPQKRYMEGAIHTLVDAAVSSSTHTENNTKSPRQPTHAIPTQAPATGITNAEPQVKKQKLNSPNSNINKLVNTATSIEENAKSEVSNQSPAVVESNTNNTSQEEKPVKANSIPSVIGAQEPPQEASPAEEATKAASVSPSTKPLNTEPESSSVQPTVSSESSTTKANDQSTAETIELSTATVPAEASPVEDEVRQHSKEENGTTEASAPSTEEAEPAASRDAEKQQDETAATTITVIKPTLETMETVKEEAKMREEEQTSQEKSPQENTLPRENVVRQVEEDENYDD

SEQ ID NO: 33 - protein, 966 aa, Saccharomyces cerevisiae S288c
MNPGGEQTIMEQPAQQQQQQQQQQQQQQQQAAVPQQPLDPLTQSTAETWLSIASLAETLGDGDRAAMAYDATLQFNPSSAKALTSLAHLYRSRDMFQRAAELYERALLVNPELSDVWATLGHCYLMLDDLQRAYNAYQQALYHLSNPNVPKLWHGIGILYDRYGSLDYAEEAFAKVLELDPHFEKANEIYFRLGIIYKHQGKWSQALECFRYILPQPPAPLQEWDIWFQLGSVLESMGEWQGAKEAYEHVLAQNQHHAKVLQQLGCLYGMSNVQFYDPQKALDYLLKSLEADPSDATTWYHLGRVHMIRTDYTAAYDAFQQAVNRDSRNPIFWCSIGVLYYQISQYRDALDAYTRAIRLNPYISEVWYDLGTLYETCNNQLSDALDAYKQAARLDVNNVHIRERLEALTKQLENPGNINKSNGAPTNASPAPPPVILQPTLQPNDQGNPLNTRISAQSANATASMVQQQHPAQQTPINSSATMYSNGASPQLQAQAQAQAQAQAQAQAQAQAQAQAQAQAQAQAQAQAQAQAQAQAHAQAQAQAQAQAQAQAQAQAQQQQQQQQQQQQQQQQQQQQQQQQQQQQQQQLQPLPRQQLQQKGVSVQMLNPQQGQPYITQPTVIQAHQLQPFSTQAMEHPQSSQLPPQQQQLQSVQHPQQLQGQPQAQAPQPLIQHNVEQNVLPQKRYMEGAIHTLVDAAVSSSTHTENNTKSPRQPTHAIPTQAPATGITNAEPQVKKQKLNSPNSNINKLVNTATSIEENAKSEVSNQSPAVVESNTNNTSQEEKPVKANSIPSVIGAQEPPQEASPAEEATKAASVSPSTKPLNTEPESSSVQPTVSSESSTTKANDQSTAETIELSTATVPAEASPVEDEVRQHSKEENGTTEASAPSTEEAEPAASRDAEKQQDETAATTITVIKPTLETMETVKEEAKMREEEQTSQEKSPQENTLPRENVVRQVEEDENYDD

SEQ ID NO: 34 - protein, 804 aa, Malassezia globosa CBS 7966
MPATVPAATPSSTLVANSSESVPMVGSKNSSVVYLDVRKSPAQKSSEVSRRSPRLTQGMGMASAANTEATPPVLPPNADRVVATLMKLSAANEQTWLAIGSAAETMGDMARALGAYESALLHNPYSIPALSATASVYRSMDHFDLAVEYFQRVLDIDNENGEVWGAMGHCYLMMDELEKAYAAYHRALCYLPNPKEPKLWYGIGILYDRYGSLEHAEETFSSVVRTNPDYEKANEIYFRLGIIYKQQGQYESSLECFQYILNNPPRPLTGMDIWFQIGHVHEQQGAYDLAKEAYEHVLSENTDHAKVLQQLGALYMQPDSGFQNEEKALELLHLSLDSDPNDQQTWYLVGRSYMNTQEYSKAYDAYQQAVYRDGKNPALWCSIGILYFQISQFHDALGAFSRSIRLNPYIPEIWLNLGILYETCNNQTSDAIDAYRRTLELEPENTIIQQRLQLLQNAEPLGKAVPNIPLPKDIPFAAYATVGPVAPSTPPPNVAEADETTWSATADPIPVRDIPVEDERKHALESSTRHAYESHPRMHHASLSSYGGGTYSDYARHAATVHPSRMYSAPSEWDRQYAVPYADERIATYSTRLPSSKYPYDGRAMRYELNYQNGRSYHLPAASTPPLSRRVGAGGTGPVSPGREHDRMDMEQDNLIRRKRDIPNLRSSLPSRLPSTTESWAGETASEQHYPLDRGIEPPARNSFRTSGGREVDEDYDEGAASALMGLAGAAASAYEATSWARSRPEAVVGTVSRSPPLSVKRGGETDRPALEAKRRRNDEPPFVDERLDMPDPRSVHRSVSREQ

SEQ ID NO: 35 - protein, 782 aa, Malassezia sympodialis ATCC 42132
MESSDLGSNAPLHSYPSATVSGPPNASLSAATEARLTPVAEPIPVPVNGGTLPMIRSPDQGKEALRRSPRIPSGMIMAPESGAPPMLSPSSDRVMVTLNKLSIANEQTWIAIGTTAETMSDPTRALAAYDSALLHNPYSIPALSAMASVYRSMEHFDLAVEYIQRVLDIDRENGEVWGAMGHCYLMMDELEKAYAAYQQALCHLPNAKEPKLWYGIGILYDRCGNLEHAEETFSNVVRMNPDYEKANEIYFRLGIIYKQQGRYDSSLECFRYILHNPPKPLTEMDIWFQIGHVYEQRQDYDLAKEAYERVLRENTNHGKVLQQLGALYLQPASGLFDQDKAIQLLHQSLDSDKNDQQTWYLLGRAYMNSQDYNKAYDSYQQAVYRDGKNPVLWGSIGILYFQNGQYHDALGAFSRSIRLNPYIPEIWFNLGILYESCNNQISDAIDAYRRTLELEPEHSEVQQRLSLLQSAEPLGKAVPNIPLPKDLPFSAFSSCTLPPPEGSPVMGEAEDGGWSGESTVHHAKEADVPSTDEEHKLVSEVSPRKMNFFEESSSKNSMPHLQYTKAHIDSIRDLPSSRAYPPSSEWGRRPYRDESPGRYPSRHHPMHIPVDSRGDRADPSYFSGGPRASYSVPSGSMHLAHRDAMPTDIEHERVRVDKELHLRRKRDMNNLRRPVSTLRSNRSDSVPANEYAPERDDVSGSAMRSSMPVSSSREIDEDYDTGAASALMGLAGAAASAYEANNFSRTRSDMTTSPKSKRPLDSEHVPMEAKRPRADEPVTNGG

SEQ ID NO: 36 - protein, 1390 aa, Dictyostelium discoideum AX4
MNVQQTQQQQAMAAQQQSMVAQQQQQIAQQQSAIAQQQIAQQQQIAQQQQIAQQQQQHQQHQQHQQQHQQQQQHQQQHQQQQHIQQQQQPQQQQPQQQQSQQQQQQHQQQQQPQQQQPPQQQQQQPPQQQQQPQQQQQQQQQQQQQPQQQQQQQQQDQLSGVTGKIRDLNESIWIHLGGYAESIGEQDKALASYENALRHNPFSIKALTQIASLFRIKEQYSKAAEYFQRIVTIESKNGEVWGALGHCYLMMDDLQKAYTAYQQALYHLPNPKDPNLWYGIGILYDRYGSYDHAEEAFTAVLKMDNKFEKSTEIYFRLGVLYKHQGKYDQSLEYFQHLVKNPPLPLTTSDIWFQIGHVYELQKEYHKSKDAYEKVLKDNATHSKVLQQLGWLYHHNPLFTNQEYAINYLMRSIDSDSSDAQTWYLLGRCYMTQQKYKKAYDAYQQAVYRDGRNPTFWCSIGVLYYQINQYRDALDAYTRAIRLNPFLSEVWYDLGTLYESCHQHTDSLDAYQRAAELDPHNKHIQSRLATLRAQVSGKPIGKDGYDLQNGEHGEHGGKSTPMIIEPNSPGTGAMESLGKGGQNNRNGNNNGNNSFVPELAEINSHLPEDMRNNSSLPSSNELNSSLIDRKTERGRGEDMHNSHHSQYSNSMSMNNMNNNNNNMNMNNNMNNNMNNMNNNNNNMNSMNNMNNNNNNINNNMSNNNNNNHNNHQMNQYNNNNNNSNINNNNNNHHNMNDNVNSKNNDVLDRRYKGILEREKTSPNGDGRDNRDNIRDNRDNRDSRDGRDNRDGRDSRDRIQEYTREYNNNNNNNNSISSINNNNNNNNNNYNNNNNNNNNNNNNNNNNGLRATSPLPSHNDRRSYERDNKERINNNNNNNNNMNNNMNNNMNNMNNNNNNSNISRFEHQNNRTSSPFENNSNNNNNNNNNNNNNINYNNIGQRALSPQSSQHKDRREIILDEESDINERSKTRSPSIVKEAEEKRETVIVDKERSPTPIITEKPDEKQVEKVTDKESSLVEKVDKENEKESPSSSSSSKEIEKETEKEKEKEKEKEKEVEKEVEKEIENDKEKEKEKEVEKDVEENKSVEKSSEKPVEKESTTTTTNDEDEEGELSEPTTTTKKDDSSKLPTDEKKLSSVSPTTTAVEQSRDETKELEMDTKEDSEKEKKSSTTTTAAASESVKPIDEEKKSPTTTTTTTTNTTTVEPTHKDKESSKNDDTTTTTTTTTTKSAKSPNSSPTRSDEVVEPHQDASQEEINKRKLEDDITSTPSKRLKPDSTPSSATTASTPSEQPESPLKKENPVGETLSPEIKDSKSSSSSSSSSSSSTNTGSSSTNSSAKNERDRDRERERERERDREREREREREREREREKNKQPTRAPIKPSSRKLER

SEQ ID NO: 37 - protein, 812 aa, Dictyostelium purpureum
KMNVQQQQAAVVAAQQQAAQQQQAAQQQAVQQQQQQQQQQQQQQQQQQQGQGQQQGQPIDQLGNVTSKIREMNESIWIHLGTYAESINETEKALASYDNALRHNPYSIKALTQMATLYRLKEQYVKAAEFFQRVVALETKNGEVWGALGHCYLMMDDLQKAYSAYQQALYHLPNPKDPNLWYGIGILYDRYGSYDHAEEAFTAVLKMDSKFEKGSEIYFRLGVLYKHQGKYDQSLDYFQHLVKVPPTPLLSSDIWFQIGHVHELQKDYLKSKDAYERVLKDNPNHAKVLQQLGWLYHHNPQFTNQEMAISSLLKSIDSDPSDAQSWYLLGRCYMTQQKYKKAYDAYQQAVYRDGRNPTFWCSIGVLYYQINQYRDALDAYTRAIRLNPFLSEVWYDLGTLYESCSQTTDSLDAYQRAAELDPGNKHIQARLATLRAQISGKPIKDPYHENGDGDGNHLSSIITPMIIEPCSPNHTNDHLNKHNARNGNGANNGGFVELADINSHLPEEMRNNSSLPSSNELNSSLIDKKTEKNKGNNNNNSFNSNIASGSEARFNNRNNIDHQNNNQNYHSNYSNHNNNNNNPEDIHIHQLQYGMKENVNRQPEVDRRLMDREGYSNNNNNRGNNMNIHMNNNKMDLRDREIMNNNNDRFDQRERFDFINNRERNNGIMNNNNDSRFERSQSPFENNRPHPNQQQRDEEKLVMERELREREPRDKEEREQHREKERERSATPIKPIVEERERPSTPAAVVEKESPEQNKNRAVSPVSEKESNRVSQEKESNPSAEPKKEDEEPEKVEEPEKSCRKSTRKRSC

SEQ ID NO: 38 - protein, 1287 aa, Ustilago hordei
MPPSSRHSAHPCHPSHHPHAGGRDLHHAAPQAGPGNAPMHHPHSSYPQSMPPPPGLPPHAMNGVNGPPSAHARPPPRMVIADGPGGLGGPPPPPPPHIPRSSSAQSRIMETAGSAAPPAPPAPPASSSPALQKLSLANEAAWLSLGSAAETMEDYDRALSAYEAALRHNPYSVPALSAIAGVHRTLDNFEKAVDYFQRVLNIVPENGDTWGSMGHCYLMMDDLQRAYTAYQQALYHLPNPKEPKLWYGIGILYDRYGSLEHAEEAFASVVRMDPNYEKANEIYFRLGIIYKQQNKFPASLECFRYILDNPPRPLTEIDIWFQIGHVYEQQKEFNAAKEAYERVLAENPNHAKVLQQLGWLYHLSNAGFNNQERAIQFLTKSLESDPNDAQSWYLLGRAYMAGQNYNKAYEAYQQAVYRDGKNPTFWCSIGVLYYQINQYRDALDAYSRAIRLNPYISEVWFDLGSLYEACNNQISDAIHAYERAADLDPDNLQIQQRLQLLRNAEAKGGELPEAPVPQDVHPTAYANNNGIPPGPPTQIGGGPGPSYPPPLGGPQLAGTGGGRGDLSERDLPGPGHLPQSHSPPPFRAGGGPPGLVDRDSRGPAPVALAPMVSPDGLGRGGYPHSRGPSPGPPRMDPYGRRMGSPPRGSPPPPLRPDMHDRHGHGGGPHGHGGPGHGDFRGPPSLAAGAPLDHYGRPMGGPMSERERELEWEREREREQAARAGYPVSGRITPKNEPGYARSHHGSNAPSPAFGRPPVYGREEAGRDYYNNRHPSAGPGGPRGGYERGPPPPGMRHDERGPPPPHFEQHERGHPPAGSPGDGRYDGYGDGPDGPMGGAGARSQGPPGLRGPTPDWERARGGEHGPTCAHDGVEGRGAGGPGAAGASGKARRGAKAKDELESAPAPTSPAPSAAGKKGKATSSRASSPWSAKGGGAGKNGKAGAVGAAAAKKGASTPLRAREDQVDSRPGSPAGGVRGGQGVAPQRDASPASSDGSNEPLAARGPSSRMVDEDYDEGAADALMGLAGAASASASASASASALVSAAPVAAAPVAAAPVAAAPVLAAPVAVAAATPAPASASVSAWDRGNSPDKRAESSLGKRPYSAEEDKNADGKEDSYKRAKSGSAAAAGGDSEKAQSASSNGALKPESGAGAAEGEGSESSGRKVESATTAVGGRTPPAKPVATASASPKPVKNGNGLEKSRAQPMDIDPREPWPSKATEKAASLSSTAVKDSTAEAGTPATASTPAPAPATTAGKQEGAAADNADDDEEGQINEDEDSKADEGKK

SEQ ID NO: 39 - protein, 1292 aa, Ustilago maydis 521
MPPSARHSAHPSHHPHAGGRDLHHAAGGPPPQGGPGMPPGPGNGPMHHPHSSYAQSMPPPPGLPPHAMNGINGPPPSTHGGPPPRMVMADGPGGAGGPPPPPPPHIPRSSSAQSRIMEAAGGPAGPPPAGPPASTSPAVQKLSLANEAAWVSIGSAAETMEDYDRALSAYEAALRHNPYSVPALSAIAGVHRTLDNFEKAVDYFQRVLNIVPENGDTWGSMGHCYLMMDDLQRAYTAYQQALYHLPNPKEPKLWYGIGILYDRYGSLEHAEEAFASVVRMDPNYEKANEIYFRLGIIYKQQNKFPASLECFRYILDNPPRPLTEIDIWFQIGHVYEQQKEFNAAKEAYERVLAENPNHAKVLQQLGWLYHLSNAGFNNQERAIQFLTKSLESDPNDAQSWYLLGRAYMAGQNYNKAYEAYQQAVYRDGKNPTFWCSIGVLYYQINQYRDALDAYSRAIRLNPYISEVWFDLGSLYEACNNQISDAIHAYERAADLDPDNPQIQQRLQLLRNAEAKGGELPEAPVPQDVHPTAYANNNGMAPGPPTQIGGGPGPSYPPPLVGPQLAGNGGGRGDLSDRDLPGPGHLGSSHSPPPFRGPPGTDDRGARGPPHGALAPMVGGPGGPEPLGRGGFSHSRGPSPGPPRMDPYGRRLGSPPRRSPPPPLRSDVHDGHGAPPHVHGQGHGQGHGQGHGQGHGQGHGQSHGHSHGGEFRGPPPLAAAGPGGPPPPLDHYGRPMGGPMSEREREMEWEREREREREREQAARGYPASGRITPKNEPGYARSQHGGSNAPSPAFGRPPVYGRDEGRDYYNNSHPGSGPGGPRGGYERGPGAPHAPAPGMRHDERGPPPAPFEHERGPPPPHQAGDLRYDSYSDGRDGPFRGPPPGLGRPTPDWERTRAGEYGPPSLHDGAEGRNAGGSASKSRRGPKAKDELEAAPAPPSPVPSSAGKKGKTTSSRAGSPWSAKGGVAAPGKNGKASTPFGTGVGAPVAAAGVGGGVGSKKGAAISLRPQEDQPDSRPGSPQSRRDASPASSDGSNEPLAARAPSSRMVDEDYDEGAADALMGLAGAASASSASVATAAPAPVSPVATSDRASSAEKRAESSLGKRPYAEEERAVDEPEDSYKRAKSGSAAEIEADATSGGRLNGVSVSAKPEATAAEGTEQPKETRTETPPLAVAQATSPEAINGKAESESAVQPMDVDGREPSKAPSESATAMKDSPSTANPVVAAKASEPSPTAAPPATSMATSEAQPAKADSCEKNNNDEDEREEEEGQIHEDPIDAPAKRADEDGAK

SEQ ID NO: 40 - protein, 1208 aa, ;Pseudozyma flocculosa PF-1
MPPSRHSAHPAHHPHPNARGPHHGPGINGPLPPNGANSSGGGGGGGAGPNGPPMHPHSNAYGHSMPPPDLPPHAMNGAGGPPPRMMMGADGPMPPAPPPHIPRSSSAASHHMMDVGGPNGGAAGGGPAVGVSASAAVQKLTQANEQTWISIGTAAETMEDFERALSAYESALRHNPYSVPALSAIAGVHRTLDNFEKAVDYFQRVLNIVPENGDTWGSMGHCYLMMDDLQRAYTAYQQALYHLPNPKEPKLWYGIGILYDRYGSLEHAEEAFASVVRMDPNYEKANEIYFRLGIIYKQQNKFAASLECFRYILTNPPRPLTEIDIWFQIGHVYEQQKDFALAKEAYERVLAENPAHAKVLQQLGWLYHQSNAGFNNQERAIQFLTQSLESDPNDAQSWYLLGRAYMAGQNYNKAYEAYQQAVYRDGKNPTFWCSIGVLYYQINQFRDALDAYSRAIRLNPFISEVWFDLGSLYESCNNQISDAIDAYARAAELDPDNPHIQQRLVLLRNAEAKGEQVPSAPMPQDVHPTAYANNNGMPPGPPAQIGGDVGDRELPGPGHLQPQQQGHSPPFRGGPPPIPNIDERGTRGPAHTPLAPMNTGQGGPPGGPPGLGPGGEPLHRGGAYPPHPQSRGPSPAPRADMYGRRMGSPPRQTPPFGPPGAMRPDLHDGHDFRGGPHGGPPPPSGPPVDHYGRPLAGPAAEREREREREMEWERERDRERERAARQYPGSGRATPKIEPGYPRSQHGSNAPSPAFSRPGAYPREDPREYYGNGGGGYDRARMDEGRPPYEHERGYGRHHDHPMAERYEGGGGPRQHPPADLRGPTPERDRMRGEYPPSAHPAFGPAGGAGPPPPPPPASDGVGDAMAAGGRPPAKGGRRGHKFKDDGDVASGPASPAPSAAAARKKKEAGGAGGPSSRASSPWGGRPNAPASASVGADYDEGAADALMGLAGAASASASMPAPSAPQQPRESQQPSPRGHESGQAWDGPPSGRSSPRKASDSDAPYPPRARAESALGKRPYDEGESAGSLEESTKRARNGASPGGAGPGRSEDSVDAPPRPDARPSSPLKPRNGAHEAEDAEMGVKSPPPPPPTASHRAPSRSPSKDSAPSPTKAESRGTPPKPQPEADSGADESRRDMDVDEPASGGAAGPKEGAGGGDDGAAAKPAKVAEVEEGEADNEEEGQISETGDDAAASGKPKADGAGDAK

SEQ ID NO: 41 - protein, 540 aa, Mucor circinelloides f. circinelloides 1006PhL
MNTAISNSGMHSQPSSTVQKLASVNEQTWITFGNLAEMMGDHDKAINSYESALRHNPYSILALSQIASVYRAREQFERAVEYFKRVLAIQDSHGDTWAALGHCYLMSDNLQEAYQAYQQALYHLQNPKDAKLWYGIGILYDRYGSLEHAEEAFSAVMKMDPQFEKASEVYFRLGIIYKQQRKFDPSLQYFQYVLQHPPSPLTESDIWFQIGHVHEQKKEYDAAKEAYEHVLSENPDHAKVLQQLGWLYHQPDTSFTNQKLATEFLTKSISADSADAQSWYLLGRCYMAEQNHTKAYESYQQAVYRDARNPTFWCSIGVLYYQINQYRDALDAYSRAIRLNPYISEVWYDLGTLYESCNNQVQDALDAYQRAFELDPSNTHIQQRIDLLKRPVSGSAAPVPQDVTNPSQYVQHAAGSGSTLPYGQGPRQGQQKQADHRDIAERGRELPGLSGNDPRSNEAPKQVHIPDINSRRTSLSPPSAKTHMNPMLINSAAKEEPRSPKPSFVANHNTNGNEDEEMAEAGAPQKETTPYVKPEDEEMN

SEQ ID NO: 42 - protein, 573 aa, uKuraishia capsulata CBS 1993
MIVLADTWITCGRCASLMGNFEQSIKCFDLALHHQPNNFMALIGLLSGLKNLDIVQNTMENTTKAIDLISRFVSQFPELSEFPSIWKESAECFDRLNMLEQTSVSLGNAINLDPNNPDLWLLSSKNMVKTGNLTGAAQILQQTMMGLPSMNLGSKLTWELTQKCHLQFANIALLQQDLAKTAQELELALSFPNFEISQKDEYAKIWHTLIVSHIHLENPDQAWFTLARAETLIGKHYQLEILKAFRCVFERNFTAAVEILMGYTMIGHQRSNEKEEEEEDGYDEDEDQETAEQLFLVNFLMGFVLFNLNKPQESFVHVSRLLEKSRDYPLCWLLMGNLYLSLSQLEDAITVFNRLVKLQGDDVWTKSCVAKAWEGLLSIYERCDRAEDVANSCMRCYQLYSELGHHALAKFYFDRLAELATGSKLRPLDMPVLSANLLMNLLVLRPLELNTCTPLDIPPSTPPLQPQQMLSTVTSPIHQNNGGVSTPTQMPLGPVGVVPAPIPTQIQPLQVQQIQHNVSRTNSITPSIEPSPYQVYSTPMTNSYSPHIVNLPIMFNDKMMTPPPQFGAFTIKG

SEQ ID NO: 43 - protein, 570 aa, hOgataea parapolymorpha DL-1
MAYVWSNEQEQPGNTGFRSPQLPAEVQEFVHTWLACGNLALEIRHANDIAARSYHNVLKYDPANINALHGLTTATLSRPLFELDFNKVHELIEILNSAFNHFVPLRTHPELRRDLANCYFVLGDLEKARSILLTTLEISQPTASIWFTLGQTAHRMNMLPEATESFNLCLRAASTTPELVEMARKAHLELAAIANKQNKRDLAVSEFTAAVSLPPPPYDQFREYGFMWGLLALSHEKAGDLNAAVATCLKGLDTVGEDSMLLLLQAHFLLQQNSSADNLQNATNLLQRVIQIRNRESEPSFLSHYLLGRACILQDEPTKAYKSLQVSLNLAPQSALPWLTIGSLYLRLNQLTDSLNAYSQVIKNAPKNHQMANALAWEGLGQVYEKCENQSQDAIDSYTRAAECYKLCNRPEMAEKMAAFVRNLENGKHNQQSLPQDMPHWVINESLWEQVFENFETPTFTTVQLVQASSETPTAIMSNSPHGAKSGSPRSPLQADMTPVYGPQAPPAASARVNPMIPPHPRAFYISQQPIHPVISPHYRPFLRGGPVYSYPPLFTAPPPAIEAADMNYH

SEQ ID NO: 44 - protein, 839 aa, GWickerhamomyces ciferrii
MPKHVLISSTQEFQNKRRTPNTPHIPLTNGSKTNVFNGHSNDNNIAQSQANVVSASINEYELVTSQTWAQIGSCSISLGLFKIAIKAFDNSLRHLPDNVESIVGLSQALKLDQNGSGLGYKQSTELIISAIQQFRNLSNETKLWKELSISHIGLKEYEQAHQAITRASGIQPNDTELLYINAEILLKSRNYNYVKHILHTILSIYQNKATELITAFDYEIIGNTHAKLAQLFILEKNYKYAINEYRLAISSPLPSNRDKYEEYACIWINFALLKESLNEFDEAFQIINDALLHIGLIPRLMIARAYFLLLPSTKFYDPLSAISSLENAINQCRSEDGEDNTDFLTWYILGRAYSLIDSPRQAYDTFQISLGKGPSSPLPWLAVGSLYLKLGQLPDALAAYSQAARLQVEGPEATIPQILASATAWDGLACVYERCDDQARDAADACLRASACYRNANDLRASQQAEQRAHSLTAASRGEAPPPGLKGPPDTPVMLLRDLIGLSTKEINELCQENQPEAQQQQQQQQAQQAQQQAHQQQAAQQQQQQQVAQAQAMQAAQVQQQQQQQQQIQAQQQQQQQHPSAQRPHAQLSAPQPQQQITQQGPPAPQIIRSSQTTPRIETPKQFHHLPLPRQSLAGRSNTPDINDSSPRQITTPQQQQHQVQVQGHPVQQVHVGPQGQPQPLPQGQPIVQHQPGQPQTIYTPVSGATPVLQHNGSLPQPQQPPQSQQHVPQQPNPPTQGSTPAQHHPQHPPQGYLVDVNHRAGLPQYQTTSSGVVPQPTIITTGPPPPQGAVPVPGYPGLLATNNGQTQPTGQYPPPPPPGYTYVNGATTAGGNYVQWR

SEQ ID NO: 45 - protein, 600 aa, Cyberlindnera fabianii
MTKRPLSPIPNSVHKRQANGSSESSEYIAATTATWYTIGQCALTFELDHLALRAFEASLRHTPDHVDSLRCLSKVLRTTHQQQSVDVLASSFQKFPHLNNEPSLWKELAEAHISLKQYDQGHQAISRALQLRMNDPECLLIAGRCLEHLNPQHAQHTYQSILSMITQPTTHLELEIVRECHYKLGLLAAASSDWKTATYELQTAISIALQINAETELMWCTLASIRERAGDIESALQVCRDALQVVGLQRRISVMAGYLAITPNKASQTDPEYAISILSPIVMTEKNDELDCLAWYLLGKAHSLNNNPRQAYDAFQCALKKGKTSPLPWLAVGTLYLKMGQLPDSLAAYSQAASLMVDDGSMTSAIASAAAWDGLACVYERCDDQAIDAADAYARAASCYRAADDLRAATQAEQRSHSLHAAARGEAPVPALRPVPETSPILLRDTVLNVIQAEQLKPLVPQEPQPQGKQFHHLPLPKGSLATAPASRSPTEKGTPQWRPHAPLHVSPSQMSQQPPIPQQQLSTSQHHTPQQAQAQPHHPQQHPPQQPPQHTQHPHPQQQHQQQPPPAQYPLPMPQHMQPMVQQQQPMHYYAPPANVVWR

SEQ ID NO: 46 - protein, 736 aa, Komagataella pastoris GS115
MNEPSQPPPVTLEVRHDPVPTSQADSQQRKVVYDKQLEFRKIAVSTWLALGSMAHEVHLYQLAIDSFDFALQNDPFNEKALCGLAAALRAMDLVKDQTDGTAAALDVINDLLSRSSELYKDPSIWREAAECYLLLNNTTNAMEALQRCIQLTPNNSALWLLKGQTLMAAGSKHEAVDALNTALVKLPNDVADYTKEEIDVARSTHSEFASVLAAEGNIEAARDELEATLALPPPSSSRFTEYSSLWCALISANERLGDMAKAVRVCEEASGLLGFEPCIYICHAYLLLLPNSHVFNPQSACVLLRQVVNSESNDFLPWFLLGEAYQMLRQPSEAYEAFQLALKRAPNHTIVWLAVGNLYAELGQLADALSAYMFVIKRETEQEQESKILLSFAWEGLSSVYEKCHGQLADSIEACMKSSSYASQAGDSSRANFLNSRLETLRRVVSGEIPLSDYRPSTCCQSPLYLLRDLTSLSISERENLANASLDDIASAPEIKSSSKKRTDTSRPMPPYPSHSANNYNLPSEDSQPQRQNLPVHSLPNVPLAQQQRVHAPANKNLSPSADQRFSIATHPPVAPPQISPRPASPQLQQQQQQQQQQFQPQNYQHYAPSPMYPPSQQSPFPEHQKSLTSFNQMPPIPPPPPPPQHQQHPQQMHIVQQQHEQQHHQQQHLHPQHLMPLPPLHQGPPIPKIESPSYRNQQSFMVGVPYSGVGPDGRPIYEPSQFYGSHPPARFVVNE

SEQ ID NO: 47 - protein, 655 aa, Debaryomyces hansenii CBS767
MSNMKRTCGFGDVEDGRYRDSAIETWVAVGDCSLALGMMKAAKHSFEYAMKHDPSNSRALVGLAYSLRMKDGKVKDGQQTKNGSGSQEAADRLTMALEKYPHVTHTGEVMQELGECYFSMGMVEQAHSAVQRGLQADESHTGLWLLNGKVLHRAGRNAQAVDGLRRCLSLLPRSLETCTRDEINVARLAHAELAAIATTEGNSEGAVAELVAALSLPPPSLDKVDEHIALWCGLATARERANDLVGALQTCDEAERVVGNSPRILLTHAYLLLSTDDRYAHTAIDLLEMLVKSEGEHAQANDDGDFLPWYLTGKAYSKLDSPRAAYDSYQVAFRRAPKSPIPWLAIGKLYLQLNQLPDTLAAYSQALRLQVDEKSPATATAWDGLSCVYERSNGQLMDAADACNRAATCFKLMGDADSAQFFENRTRQLQMAASREGPVPPLRDAPDVPNSLLRELVVLLPSERIAFVQGTETSYTHQPPQQNVNSPPAQRQRSQTPTNGSVQTPQPRPSQPVVPQHYQVQQPYKQLHDNSPRQNLAPPHQMWSPNQQQHQQRQYTPNIPPPAMANPNQYPHYFYQQPPSNGLPPGAMPAHNQQVLQRSPLNNPQMIRNDLQQPMGPNMVPGPPPPPPPPGYAYGQYMPMQGAMNFPSPANNWSK

SEQ ID NO: 48 - protein, 682 aa, Meyerozyma guilliermondii ATCC 6260
MSYSACASETWTLCGDCASSLSLTQVAVRSYEAALAHDPSNAKALCGISAGLRLIDISRNETVRSQNAIENLTRALSAYPHLTKVADIFRHLAECYLLIGLNDQAHQSVQTALELSPESPTLWLLNAQTLIRSNARQHATSALTHCLMLLSNRNSSQDNDIETARAAHAELAAIAAADGNVDASIAELTATLALPPPPLAQTEEYIALWCALATAKERARDLEGAIQACEGAERAVGRSPRILLTHAYLLLVREEPQPDVAITLLHEVVGDVEHEKHQNENQKEQTEQTEQSGQNSQNVSENGSPHTKPLKLENWPAEDFLPYFLLGQAYSLLNHPRAAYDAYQVALRRASNSPIAWLAVGKLYLKLKQLPDALAAYSQALRLQMDDGSAGAAAAWDGLSCVYERCDFQLTDAADACDRCAACYRAIGDVDGAQFFEERAKTLIAASRKEVAVPPLRDPVNVPEFLVRDLVALLPSERISYVRGDRDYERQTEEQQQRQEEQRQIQQQQQQQQQQQQQEQQRQIQNQHLINNSHQDQSRIQQHQPQHPNLIRPENPQFAPHSPAGASAVINGSGMSGPAPGVPGRLQASPHQLPPPPHWSPSQPPGMLRGPPGMPMPPGVIQGSPGPQQQMIQGYATSPPPGPNGVPNHPPPPPPGYAYGQHMPMPTMVGMPYPQPVNGWMR

SEQ ID NO: 49 - protein, 682 aa, Meyerozyma guilliermondii ATCC 6260
MSYSACASETWTLCGDCALSLSLTQVAVRSYEAALAHDPSNAKALCGISAGLRLIDISRNETVRSQNAIENLTRALSAYPHLTKVADIFRHLAECYLLIGLNDQAHQSVQTALELSPESPTLWLLNAQTLIRSNARQHATSALTHCLMLLSNRNLSQDNDIETARAAHAELAAIAAADGNVDASIAELTATLALPPPPLAQTEEYIALWCALATAKERARDLEGAIQACEGAERAVGRLPRILLTHAYLLLVREEPQPDVAITLLHEVVGDVEHEKHQNENQKEQTEQTEQSGQNSQNVSENGSPHTKPLKLENWPAEDFLPYFLLGQAYSLLNHPRAAYDAYQVALRRASNSPIAWLAVGKLYLKLKQLPDALAAYSQALRLQMDDGSAGAAAAWDGLSCVYERCDFQLTDAADACDRCAACYRAIGDVDGAQFFEERAKTLIAALRKEVAVPPLRDPVNVPEFLVRDLVALLPSERISYVRGDRDYERQTEEQQQRQEEQRQIQQQQQQQQQQQQQEQQRQIQNQHLINNLHQDQLRIQQHQPQHPNLIRPENPQFAPHSPAGASAVINGSGMSGPAPGVPGRLQASPHQLPPPPHWSPSQPPGMLRGPPGMPMPPGVIQGSPGPQQQMIQGYATSPPPGPNGVPNHPPPPPPGYAYGQHMPMPTMVGMPYPQPVNGWMR

SEQ ID NO: 50 - protein, 638 aa, hClavispora lusitaniae ATCC 42720
MTKRSASVSPRAAKLMRTDASGGYSAQVGETWIAVGHCATSMGIVAVAVKAYEAALAHMPDSVDALVGWSHSLRMSDISANETVGSQNAIRRLAAAGERNPEVTKSAAFFRELTECYLLVGLNEQAHSSIQQAVQRQPQDAALHLLLAQTLIRAGARAQAGAALAHCLSLLPAQLAQFTKDDIETARRAHAELAAIAAADGNIELSITELRATLSLPPPPLARADEHIALWCAFATAMERANRIPEALEACERAEVAVGPSPHILITHAYLLLLDTSRANAEAALTLLSKVVAAEPPEVRAADFTPADAERAPDVPGDFLPWYLLGKAYTHLDAPRAAYDSYQIALRRANNSPITWLAVGKLYLELKQLPDALAAYSQALRLQMNENSPGTAAAWDGLSCVYERCDDQLGDAADACSRAAFCFRAIGDAKSADYFDDRAKRLQAAAEGKGPVPELVAPQGVPNYFLRDLVTLLPSERVAFVSGGTKARAPEPPAPNGRDVSAQPQAPAPALAPAPGPGAQRPPSYESRPQGERTPLAPPQPMAPPMAPHAFAHSPAPHELPGPPPHYALGQYPPHMVGMGNGVMSPPGGPQGHRSPHMPPMLNEGYPMAGSPGYLYGQYMPMHGGMMHVQPYGGTWRR

SEQ ID NO: 51 - protein, 641 aa, Millerozyma farinosa CBS 7064
MKRKGSITPDIKQKKLRGREGFDEIAVDTWIAVGNCSITLGLITAAIKSFEFALGHQPVNAEALRQLSHCLRLQDMQNNEIFGSLSAIEKLTRALEEHKELNNDSGLFKELAECYLTMGFVEEAQQAVQRSMQLDENDPSVWLLNAETLIRKNDRAQAANCLMRCLSMLPESLAQFTPENIEIARSAHAELAAISAADGNIELSIAELTVTLSLPPPPLSRIDEHFALWCALATAKERTNDIQGALRACEGAESILGDSPRILMTHAYLLLIDYSQENAEKAIKVTQKIIDAENVSESSSEGDFLPWYLMGKAYSILGSPRLAYDCYQVALRRASNSPITWLAVGKLYLQLRQLPDALAAYSQALRLHIDENSHATALAWDGLSCVYEQSEDQLMDASDACARAAACFKSIGDVDSANFFEERARNLMLASKKEISPPAPRECPDVPNFLIRDYVALLPAERIALVQGSVRAAGQFHQQQENASYQATTSSQGQQSPPNRPHSTVPAQAHAKQQYPQQSPPQLFYPLPQPYKSSKSSTPRPASQQVWSPNQQANTTFNHPQYPSYMYHQPPPGVQMGPLPVPQMSHRSPLNPAQVVPGGVQYSLAPMSAPGPVGPPPPPPGYSYGQYGPIVYASPANNWQR

SEQ ID NO: 52 - protein, 641 aa, Millerozyma farinosa CBS 7064
MKRKGSITPEIKQKKLRGREGFDEIAVDTWIAVGNCSITLGLISAAIKSFEFALGHQPVNAEALKQSSHCLRLQDMQNNEIFGSQSAIGKLTRALEEHKELNNDSGLFKELAECYLTMGFVEEAQQAVQRSMQLDENDPSVWLLNAETLIRKNDRAQAANCLMRCLSMLPESLSQFTPENIEIARSAHAELAAISAADGNIELSIAELTVTLSLPPPPLSRIDDHFALWCALATAKERTNDIQGALRACEGAESILGDSPRILMTHAYLLLIDYSQENAEKAIKVTQKIIDAENVSESSSEGDFLPWYLMGKAYSILGSPRLAYDCYQVALRRASNSPITWLAVGKLYLQLRQLPDALAAYSQALRLHIDENSHATALAWDGLSCVYEQSEDQLMDASDACARAAACFKSIGDVDSATFFEERARNLMLASKKEISPPAPRECPDVPNFLIRDYVALLPAERIALVQGNVRAAGQFHQQQENASYQATTSSQGQQSPPNRPHSAVPAQAHAKQQYPHQSPPQLFYPLPQPYKSSKSSTPRPASQQVWSPNQQPNTAFNHPQYPSYMYHQPPPGVQMGPLPVPQMSHRSPLNPAQVVPGGVQYSLAPMSAPGPVGPPPPPPGYSYGQYGPIVYASPANNWQR

SEQ ID NO: 53 - protein, 712 aa, Candida dubliniensis CD36
MPVSPVMTKSTSTASTTANTTSYDTAATQTWITCGECATTLGLIVSAIKSFESAVNRDPANATALVGLCSSLRLNDISVNETVGSQAAIEKLNKSLESFPSLSKEANIFKELCECYLLVGLNDQAYQAVQSAIQLAPQDASLWLLSAQTLIRAGARAHATGSLAHCLSLLPDGTFSSTDIETARAAHAELAAISAADGNIELSIKELRATLELPPPPLSRIDEYVALVCALASALERDNDILGAIKVCEDGESVVGNSPRILMSHAYLLLSNSNTNDKDGAAQQAINLLAKVVDIDNESAVQEGSDFLPWYLLGKAYSHSDPRSAYDSYQVALRCASNCSIIWLAVGKLYLELKQLKDALEAYSQALKLQLGDGSNGTATAWDGLSCVYERCEDQLMDACDACNRAAVCFKAMGDIKSCRFFEDRAIALEKASKKEGPMLSLRDPPDVPTFLIRDIVALAPNERISFTQQQLQAQQQAQQRAQEQAQQQQAQQQQQQQQAQQAQQQQQQAQQQAQQQQQAQKSQHIQQQNHNQSPVPPQHQETARNSPQVPIQTPQQPPVQYQGPAPPPQLPPHQQYLYPIPKNSPRQPQLSTPQIQHSWSPQPQHLQHLQQSPHQTQQQQQQQQQQQQQPGPHQQQQQFFYPPPPLGPGQPQPNGGPHRSPMNPPQMIPAGGGPYAMGPGGPNNGAPGYYNYVSVPGSVQNSQYSSPNWRR

SEQ ID NO: 54 - protein, 736 aa, Candida albicans
MPISPVMAKSASTATTTTAPTAVNTTSFDTAATETWITCGECANTLGLIVSAIKSFESAVNRDPANATALVGLSSSLRLNDISVNETIGSQAAIEKLNKSLESFPSLSKEANIFKELCECYLLVGLNDQAYQAIQSAIQLAPQDASLWLLSAQTLIRAGARAHATGSLAHCLSLLPDGTFSSTDIETARAAHAELAAISAADGNIELSIKELRATLELPPPPLSRIDEYVALVCALASALERDNDIPGAIKVCEDGESVVGNSPRILMSHAYLLLSNNSSPNINGAAEQAINLLTKVVDVENESAVQEGSDFLPWYLLGKANSYLDPRAAYDCYQVALRCASNCSIIWLAVGKLYLELKQLKDALEAYSQALKLQLGDGSNGTATAWDGLSCVYERCEDQLMDASDACNRAAACFKAMGDIKSCQFFEDRAIALEKASKKEGPMLNLRDPPDVPTFLIRDIVALAPNERITFTKQQLQAQQQAQQRAQDQVQQQQAQQQQAQQQAQQQAQQQQAQQQAQQQQAQQQAQQQQAQQQQQQQQSHNQSPVQPHHQETARNSPQVPIQTPQQQLVQYQGPPAPPQLPPHQQYLYPMPKNSPRQPQVSTPQIQHAWSPQPQHLQQPQQSPHQNQHQPQQPQQQQQPGSHQPQQNQPPAPQLPPHQQQQFFYPPPPLGPGQPQPNGGPHRSPMNPPQMNPAGAAPYAMGPGGPNNSAPGYYNYVSVPGGAQNSQYSSPNWRR

SEQ ID NO: 55 - protein, 748 aa, Candida albicans SC5314
MPISPVMAKSASTATTTTAPTAVNTTSFDTAATETWITCGECANTLGLIVSAIKSFESAVNRDPANATALVGLSSSLRLNDISVNETIGSQAAIEKLNKSLESFPSLSKEANIFKELCECYLLVGLNDQAYQAIQSAIQLAPQDASLWLLSAQTLIRAGARAHATGSLAHCLSLLPDGTFSSTDIETARAAHAELAAISAADGNIELSIKELRATLELPPPPLSRIDEYVALVCALASALERDNDIPGAIKVCEDGESVVGNSPRILMSHAYLLLSNNSSPNINGAAEQAINLLTKVVDVENESAVQEGSDFLPWYLLGKANSYLDPRAAYDCYQVALRCASNCSIIWLAVGKLYLELKQLKDALEAYSQALKLQLGDGSNGTATAWDGLSCVYERCEDQLMDASDACNRAAACFKAMGDIKSCQFFEDRAIALEKASKKEGPMLNLRDPPDVPTFLIRDIVALAPNERITFTKQQLQAQQQAQQRAQDQVQQQQAQQQQAQQQAQQQAQQQQAQQQAQQQQAQQQAQQQQAQQQQQQQQSHNQSPVQPHHQETARNSPQVPIQTPQQQLVQYQGPPAPPQLPPHQQYLYPMPKNSPRQPQVSTPQIQHAWSPQPQHLQQPQQSPHQNQHQPQQPQQQQQPGSHQPQQNQPPAPQLPPHQQQQFFYPPPPLGPGQPQPNGGPHRSPMNPPQMNPAGAALMLWVQEVPTIVLSDITIMYSFSAVHKTCNIHHQIGEDRCNGNPKEWSTI

SEQ ID NO: 56 - protein, 707 aa, Candida maltosa Xu316
MVITPSMTKSPVLNINNYDVAAIETWIKCGECATTLGLIVPAIKSFETAVNRDPSNATALIGLSSSLRLNDISINETIGSQSAIEKLNKSIESFPNLLKDANIFKELSECYLLVGLNDQAYQAIQSAIQLAPQDASLWLLSAQTLIRAGARSHATGTIAHCLSLLPDGKLSPNDIETARAAHAELAAISAADGNIELSIKELRATLELPPPPLSRIDEYVALVCALSTALERDNDINGAIKACEDGEMVVGNSPRILMTHAYLLLYSKNGAELAINLLSKVVNLENESATQEGSDFLPWYLLGKAYSFIDPRAAYDCYQVALRCASNCSIIWLAVGKLYLELKQLKDALEAYSQALKLQIGEGSHGTATAWDGLSCVYERCEDQLMDASDACSRAAVCFKAIGDIKNSHFFEERANALVKASKKEGPMLELREPPDVPTFLIRELVALAPNERISYTQQQQQVQQQAQQQQMQQIQQQQQQQQQQAQQQQQQQLQSRSHQASARNSPQVQMQTPHQPPVQYQGPPPPPPGPLQQQQQQQQPQPQYMYPVQKNSPHPPQLATPQVNAWSPPPQQQQQPPPPQQQQQQQPPPPQSQPQGQQPPQRQPQQQQQQQQQQQQPPLPPPQPQGQPMQQQYFYPPPPPPIQGQPQPQQNGGPHRSPMNPPQMMPAGPYPMGPGGPNNVPPGYYGYVPIPGGVQNPQYSSPTWRR

SEQ ID NO: 57 - protein, 761 aa, Candida tropicalis MYA-3404
MTKSPILKMSTYDAAATETWIKCGECATTLGLIVPAIKSFESAVNRDPSNPTALIGLSSALRLNDISLNETIGSQSAIEKLNKSLESFPNLLKQANIFKELCECYLLVGLNDQAYQAIQSGVNLAPQDPSLWLLMAQTLIRAGARSHATGTLAHCLSLLPDGKFSPSDIETARAAHAELAAISAADGNIELSIKELRASLELPPPPLSRMDEYVALICALATALERENDIPGATKVCEDGEMVVGNSPRLLMAHAYLLLYSKNGAEQAINLLTKVVNLENESATQEGSDFLPWYLLGKAYSYLDPRAAYDCYQVALRCASNCSIIWLAVGKLYLELKQLKDALEAYSQALKLQIGDGSHGTATAWDGLSCVYERCEDQLMDASDACNRAAACFKAIGDVKNSQFFEERANALIKASKKEGPMLDLREPPDVPTFLITELVALAPNERISYTQQQLQAQQQAQEQAQEQAQLQAQQQAQLQAQQQAQAQAQAQAQAQAQAQAQAQAQAQAQAQAQAQAQAQAQAQAQAQAQAQAQAQAQAQAQAQAQAQAQAQQQQQQQAQQQQQQQHHHHPSQDTSRNSPQVPIHTPQQQAIQYQGPPPPQGQPPQQQQSYLYPMQKNSPRPPQLATPQIQHAWSPQPQQQGPPPPPPQGQPPQQQQQQQQQQPQGPSPQQQGPPPPQGQPQPPQQYFYPPPPPQGQPSQGQPNGGPHRSPMNPTQIIPAGATPYQMGPGGPNSVPPGYYGYVPIPGGVHNSQYTSPTWRR

SEQ ID NO: 58 - protein, 746 aa, Lodderomyces elongisporus NRRL YB-4239
MPKRSSPSTTKVSPVTKKPTILSSYDATATETWVKCGECATTLGINETAIRSFENAVNRDPSNLTALCGLSLSLRLDDIQNNATFGSQSSIERLNQSIEQFPHLLKHYQIFKELSECYLLIGLNDQAHQAIQQAILLSPKDASLWLLSAQTLIRAGARAHAANSLTHCLSLLPPPPPPSSQQQQQQQYSTKNYSSQDIETARAAHAELAAIAAADGNIETSIAELTATLSLPPPPLSRIEEHIALWCALATAKERANDIMGAINACKDAELAVGDSPRILMTNAYLLLLLNPRENAEEAISLLNKIVNLENEAMVSEGTDFLPWYLLGRAHSFMDRPRLAYDSYQVALRCASNSPITWLAVGKLYLELKQLPDALAAYSQALKLQLEDGSQGTATAWDGLSCVYERCDDHLMDASDACSRAAACFKAIGDLKNSEYFEYRADQLAKASKKEAPVPELRQPPDVPSFLLRDLVALAPNERIAYTQTQRQSQVLIQPQQEVKNEPQQQQQQQQQQQQPPPPPQQQQQQQPLQPPQPPQPSSSYQQQQPPPPPPPQQQQPQQPQPLPNHYHPSPLQMSPQQPTPQQVPQQLQQAQQTPQQVHQQQAQQQQQQQQQHYRGVPPQPQYYYPPPPPLPPHQQQQQQYYYSGPPPPPQQQQHPVSQQQSPQQHQHPQMMPPPNLPQANGHYIVPQQQHGPPPPPPPGASAISVGGAGVNGSYGGNVNGGGAQYLPIPGGVHNGSQYALPSWRK

SEQ ID NO: 59 - protein, 834 aa, Candida parapsilosis
MVKRTATGATTTVTNTDTSSPMVKKPTLNSSYDTTAIETWVKCGECANTLGLTEAAIKSFENAVHRDPSNITALCGLSLSLRVNDITQNETFGSQSAIEKLNASIEMFPHLLKNSNIFKELSECYLLIGLNDQAHQAIQSAIQLSPQDASLWLLSAQTLIRAGARSHAANSLSHCLSLLPPQDSSYSQQDIETARAAHAELAAIAGADGNIETSIAELTATLSLPPPPLSRIDEHIALWCALSTAKERANDIVGAIRACEDAQLAVGDSPRILMTNAYLLLLLNSRDNADAAIAILNKIVNLPADESLINEGTDFLPWYLLGRAHSFMDRPRLAYDSYQVALKCASNSPITWLAVGKLYLELKQLPDALAAYSQALKLQLDDGSQGTATAWDGLSCVYERCDDHLMDASDACNRAALCYKAIGDLKNYNYFESRADQLAKAAKNAGPIPELRQPPDVPSFLLRDLVALAPNERIAYTQTQRQSPYQAHAQPQTQPTQSLQQQQSEQQQQQQQQQQQQQRQPPPVKQEQVPSAHHTPSLQHQQQHYGPPLPPPPPPNQQQQQQQPPPHPHQQSQYGPPPPGQQQYQPSYHPSPYQGPPVPHQQPTPQPQHSQQQQPPVPPQQQQQQQPPSQQQTPSQPQYRSIAQPQYYYPPPPPPQSQQQYYYAPPPPPNQQQQQQQQQQQQQQQQQQQQQQQQQQQQQQQHSPPQLSHSQMLHGNSGGPPGGSNGPPPLPPPNTNVNTSTNATSGNGAGGPPLPPPPPPGTQYSMIPPTPGSLPSPHHQSAGAPGYGHGPAPGQGASYGSYLPIPGISNGGGGGGGATGSNGQSQYASPNWRR

SEQ ID NO: 60 - protein, 768 aa, Candida orthopsilosis Co 90-125
MAKRTTSAHPSPMVKKQTVYSTYDTAAIETWVKCGECANTLGLTEVAIKSFENAVHRDPSNVTALCGLSLSLRVNDITQNETFGSQSAIEKLNASIEMFPHLLKNSNIFKELSECYLLIGLNDQAHQAIQSAIQLSPQDASLWLLSAQTLIRAGARSHAASSLSHCLSLLPASESNYSSQDIETARAAHAELAAIAAADGNIETSIAELTATLSLPPPPLSRIDEHIALWCALSTAKERANDIMGAIKACEDAQLAVGDSPRILMTNAYLLLLLNPKENADAAIAILNKIVNLPEDESLINEGTDFLPWYLLGRAHSFMDRPRLAYDSYQVALRCASNSPITWLAVGKLYLELKQLPDALAAYSQALKLQLDDGSQGTATAWDGLSCVYERCDDHLMDASDACNRAALCYKAIGDLKNYNYFEARADQLAKAAKNSGPIPDLRQPPDVPSFLLRDLVALAPNERIAYTQTQRQSPQQAPAQPQPQPQTQQPPVKQEQNQSVHQTPSLQHQQQQQQQPQYGPPAPLQQQQQPPPQQPQPPQQQPQYGPPAPPQPQYQQVPSYHPSPYQGAPVPHPQATPQPQHQQHLQQQPTQQQQQQLHQHGPPPPQQPPSQQQTPSQPQYRQPHYYYPPPQSQQYYYAPPPPSSQQQHQQQSQQQQQQQQQHSPPQLSHPQMLHGGGPPPLPATTTTGGPLPPPPPGTQYSMVPPTPGSLPPPQATNGAPVYGPGQGQGQGQGPGYGSYLPIPGISSGAGGANSNGQSQYASPNWRR

SEQ ID NO: 61 - protein, 669 aa, Scheffersomyces stipitis CBS 6054
MYAAKRPSQELSPGSKRQRLHDKSLSDYASSATETWIACGNCANTLGLVVPAIKSFENAVVHDPSNAAALCGLASSLRLNDISLNETIGTQSAIDKLNKSLESFPSLLKQPAVFKELAECYLLIGLNDQAHQAIQTALQLAETDASLWLLSAQTLIRVGARSHAAGSLTHCLSLLPDSIHQFSTADIETARAAHAELAAIAAADGSIELSIAELTATLSLPPPPLSRIDEHIALWCALSTAKERANDIAGAIQACEQSEKAVGMSPRILMTHSYLLLFSNDRNNAETAINLLSKIIDLEKEKESEQPKNDGDFLPWYLLGKAYSLVDQPRLAYDSYQVALRRASNSPITWLAVGKLYLELKQLPDALAAYSQALRLQIDESSPGTATAWDGLSCVYERCDDQLMDASDACARSASCFKVIGDLKSAAFFEERAELLAKVSKKEAPVPELRDPPDVPSFLLRDLVALLPSERIAFIQGPQQQEQTQQPQQQQQQQQQGTPLQQTPNPQHHQPQHSPAISMIQSQQTPQPPQAHYPQPQQQQPQRTPQQHLFHQGFKQEQKSPRQQQIPPQLPPPQIQQVWSPNQQPQYFYQQGPPQGPPALHHQGGPAAPPSSHRSPLNPQLIPAGTYPVPAPPGVAPPGYPYGQYVPVQGGVMTHIQQQYAPPVNNWRR

SEQ ID NO: 62 - protein, 675 aa, Spathaspora passalidarum NRRL Y-27907
MLLNSDVTTNADLVFIVHCDVASEKGTTYRANTFGVLVSNAYDNAAAEVWLICGSCAQLMGQTDTAIRSFEYVLQHDPSNATALCGLSYSLRLNGIKNNETIGAQSAIEKLNKAIESFPPLLKEAAIFKELAECYLLIGLNDQAHQAIQTAIQLSPHDASLWLLSAQTLIRAGARSHATGSLTHCLSILDSVKKFSSTDIETARAAHAELAAIAAADGNIEVSIAELTATLSLPPSALTRKDEHIALWCALSTAKERANDIAGAIKACEDAEMTVGNSDRILMTHAYLLLLNPQSARKNAQTCIDLLNKIVNLETEKVLTQPNEKENDEDFLPWYLLGRAYSFMDQPRLAYDSYQVALRRAPNSPITWLAVGKLYLELKQLPDALAAYSQALRLQMDDGSQGTATAWDGLSCVYERCDDHLMDASDACARAAACFKAIGDLKNAGVFESRADALVQASKKEGSIPELREPPDVPSFLLRDLVALSTAERISYIQSQQQQLQQQQEQQRVQQQQQQQQQQQQQQQQQQQQQNPEVTMVQQTPQQIPIQVYQQVPPQQNGSQYLYPLQYAYKPDQKSPRQQQMLPQLPNPLPPSYLPPDQQQQQQQQQQQPQYFYQAGPQRGALPPAPPHLQPGGPLNHPQMIPNGGPYPGMPGAPAGYAYSQQQYVPIQGGVVPQQ

SEQ ID NO: 63 - protein, 21 aa, Artificial Sequence
  Consensus Sequence 1
  VARIANT (2)..(2): X can be C, G or L
  VARIANT (3)..(3): X can be S, L, T or A
  VARIANT (4)..(4): X can be I, M or V
  VARIANT (6)..(6): X can be V, I, N, S, T, or K
  VARIANT (9)..(9): X can be Y, F, L or A
  VARIANT (10)..(10): X can be Q, N, S, R, K or E
  VARIANT (11)..(11): X can be I, N, L or M
  VARIANT (12)..(12): X can be G, N, S, K, or R
  VARIANT (14)..(14): X can be N, F, Y, or L
  VARIANT (15)..(15): X can be H, R, E, T, P, A or K
  VARIANT (17)..(17): X can be A, S or T
  VARIANT (18)..(18): X can be L or I
  VARIANT (19)..(19): X can be D, G, T, N, A, S or E
  VARIANT (20)..(20): X can be A or V
  VARIANT (21)..(21): X can be Y or F
WXXXGXLYXXXXQXXDXXXXX

SEQ ID NO: 64 - protein, 24 aa, Artificial Sequence
  Consensus Sequence 2
  VARIANT (2)..(2): X can be Y, F, L, E or D
  VARIANT (3)..(3): X can be N, D or G
  VARIANT (5)..(5): X can be G, L, A or S
  VARIANT (6)..(6): X can be T, S, I, Q or C
  VARIANT (7)..(7): X can be L, I or V
  VARIANT (10)..(10): X can be T, S, A, R, K or Q
  VARIANT (11)..(11): X can be C or S
  VARIANT (12)..(12): X can be N, H, S, D, E or H
  VARIANT (13)..(13): X can be D, N, K, R, G or F, or no amino acid
  VARIANT (14)..(14): X can be Q or H or no amino acid
  VARIANT (15)..(15): X can be I, L, T, H, V, A or S
  VARIANT (16)..(16): X can be T, S, N, Q, E, R, I, A, M or G
  VARIANT (18)..(18): X can be A, S or V
  VARIANT (19)..(19): X can be L, I, A, S or C
  VARIANT (20)..(20): X can be D, H, N or E
  VARIANT (21)..(21): X can be S or A
  VARIANT (22)..(22): X can be Y or C
  VARIANT (23)..(23): X can be E, A, K, R, Q, M, T, L, N, D or S
  VARIANT (24)..(24): X can be R, Q or K
WXXLXXXYEXXXXXXXDXXXXXXX

SEQ ID NO: 65 - DNA, 3522 bp, Artificial Sequence
  Plasmid; Full sequence of pLLP
aaattttgcataatcctttacaacatggctatatgggagcacttagcgccctccaaaacccatattgcctacgcatgtataggtgttttttccacaatattttctctgtgctctctttttattaaagagaagctctatatcggagaagcttctgtggccgttatattcggccttatcgtgggaccacattgcctgaattggtttgccccggaagattggggaaacttggatctgattaccttagctgcaggtaccactgagcgtcagaccccgtagaaaagatcaaaggatcttcttgagatcctttttttctgcgcgtaatctgctgcttgcaaacaaaaaaaccaccgctaccagcggtggtttgtttgccggatcaagagctaccaactctttttccgaaggtaactggcttcagcagagcgcagataccaaatactgttcttctagtgtagccgtagttaggccaccacttcaagaactctgtagcaccgcctacatacctcgctctgctaatcctgttaccagtggctgctgccagtggcgataagtcgtgtcttaccgggttggactcaagacgatagttaccggataaggcgcagcggtcgggctgaacggggggttcgtgcacacagcccagcttggagcgaacgacctacaccgaactgagatacctacagcgtgagctatgagaaagcgccacgcttcccgaagggagaaaggcggacaggtatccggtaagcggcagggtcggaacaggagagcgcacgagggagcttccagggggaaacgcctggtatctttatagtcctgtcgggtttcgccacctctgacttgagcgtcgatttttgtgatgctcgtcaggggggcggagcctatggaaaaacgccagcaacgcggcctttttacggttcctggccttttgctggccttttgctcacatgttctttcctgcggtacccagatccaattcccgctttgactgcctgaaatctccatcgcctacaatgatgacatttggatttggttgactcatgttggtattgtgaaatagacgcagatcgggaacactgaaaaatacacagttattattcatttaaatcacggtcttggagtcatcaggctctgactgggcagctgctgcaactggaacttcccaagcctcccaccaaacagcaggtgtagccgaaagtattcacgtgtcccagaatgaggcccacagtacatctgtcaccgtttctcaacccccttcaacggtttctttgcaaattggagaagcaaataccctgaaatggtcagctttctttggagtagtagttccgctgctcaacgtactcttcgtttaaaagccctcctaggacaaaatggccaagctgggaaacgggatttggtggaactttattattctttctacgatccaagcattatgttgtggaacaaagcgaatactcttattagctggtaattgagcgagttgaaaaaatcaagtctattggagggtatggtcagagtactgatagagatccctgttaagataatcgatctttttcaaatatccaatttcattccatcttgccatcgggtcttggcttcttacatcaataattaaaactacttactctattagtgccaaaaatggtaaaccgtattcaaattgctgcaagcatatgcttaaaaggatcgcgttgcgagcttcttttgagattcgcaagcttgattttatgctcttgtgggaagaaaagcaacccactgaattccagatttgttgtgttttcatgcatggacgacatactttgagtaataccgttactgagattttaccgaattcgcattgcgttgaggcgtgaagtttcttaatgctgtgccatatggttaagttgcgtttcaagatggtccacaagtatttttgtatttaagcagtgtcaattcaagcctaactgctcataaaaactacacggtttgctgatatcaaaacgatgtaagggcggccgcagcgaatttcttatgatttatgatttttattattaaataagttataaaaaaaataagtgtatacaaattttaaagtgactcttaggttttaaaacgaaaattcttattcttgagtaactctttcctgtaggtcaggttgctttctcaggtatagcatgaggtcgctcttattgaccacacctctaccggcatgccgagcaaatgcctgcaaatcgctccccatttcacccaattgtagatatgctaactccagcaatgagttgatgaatctcggtgtgtattttatgtcctcagaggacaaggatccttcagtaatgtcttgtttcttttgttgcagtggtgagccattttgacttcgtgaaagtttctttagaatagttgtttccagaggccaaacattccacccgtagtaaagtgcaagcgtaggaagaccaagactggcataaatcaggtataagtgtcgagcactggcaggtgatcttctgaaagtttctactagcagataagatccagtagtcatgcatatggcaacaatgtaccgtgtggatctaagaacgcgtcctactaaccttcgcattcgttggtccagtttgttgttatcgatcaacgtgacaaggttgtcgattccgcgtaagcatgcatacccaaggacgcctgttgcaattccaagtgagccagttccaacaatctttgtaatattagagcacttcattgtgttgcgcttgaaagtaaaatgcgaacaaattaagagataatctcgaaaccgcgacttcaaacgccaatatgatgtgcggcacacaataagcgttcatatccgctgggtgactttctcgctttaaaaaattatccgaaaaaattttctagagtgttgacactttatacttccggctcgtataatacgacaaggtgtaaggaggactaaaccatggctaaactcacctctgctgttccagtcctgactgctcgtgatgttgctggtgctgttgagttctggactgatagactcggtttctcccgtgacttcgtagaggacgactttgccggtgttgtacgtgacgacgttaccctgttcatctccgcagttcaggaccaggttgtgccagacaacactctggcatgggtatgggttcgtggtctggacgaactgtacgctgagtggtctgaggtcgtgtctaccaacttccgtgatgcatctggtccagctatgaccgagatcggtgaacagccctggggtcgtgagtttgcactgcgtgatccagctggtaactgcgtgcatttcgtcgcagaagagcaggactaacctctaggacaccttacgattatttagagagtatttattagttttattgtatgtatacggatgttttattatctatttatgcccttatattctgtaactatccaaaagtcctatcttatcaagccagcaatctatgtccgcgaacgtcaactaaaaataagctttttatgctcttctctctttttttcccttcggtataattataccttgcatccacagattctcctgcc

SEQ ID NO: 66 - DNA, 4118 bp, Artificial Sequence
  Plasmid; Full sequence of pGAP with DLX521 as GOI
tccaaaacccatattgcctacgcatgtataggtgttttttccacaatattttctctgtgctctctttttattaaagagaagctctatatcggagaagcttctgtggccgttatattcggccttatcgtgggaccacattgcctgaattggtttgccccggaagattggggaaacttggatctgattaccttagctgcaggtaccactgagcgtcagaccccgtagaaaagatcaaaggatcttcttgagatcctttttttctgcgcgtaatctgctgcttgcaaacaaaaaaaccaccgctaccagcggtggtttgtttgtcggatcaagagctaccaactctttttccgaaggtaactggcttcagcagagcgcagataccaaatactgttcttctagtgtagccgtagttaggccaccacttcaagaactctgtagcaccgcctacatacctcgctctgctaatcctgttaccagtggctgctgccagtggcgataagtcgtgtcttaccgggttggactcaagacgatagttaccggataaggcgcagcggtcgggctgaacggggggttcgtgcacacagcccagcttggagcgaacgacctacaccgaactgagatacctacagcgtgagctatgagaaagcgccacgcttcccgaagggagaaaggcggacaggtatccggtaagcggcagggtcggaacaggagagcgcacgagggagcttccagggggaaacgcctggtatctttatagtcctgtcgggtttcgccacctctgacttgagcgtcgatttttgtgatgctcgtcaggggggcggagcctatggaaaaacgccagcaacgcggcctttttacggttcctggccttttgctggccttttgctcacatgttctttcctgcggtacccagatccaattcccgctttgactgcctgaaatctccatcgcctacaatgatgacatttggatttggttgactcatgttggtattgtgaaatagacgcagatcgggaacactgaaaaatacacagttattattcatttaaattttttgtagaaatgtcttggtgtcctcgtccaatcaggtagccatctctgaaatatctggctccgttgcaactccgaacgacctgctggcaacgtaaaattctccggggtaaaacttaaatgtggagtaatggaaccagaaacgtctcttcccttctctctccttccaccgcccgttaccgtccctaggaaattttactctgctggagagcttcttctacggcccccttgcagcaatgctcttcccagcattacgttgcgggtaaaacggaggtcgtgtacccgacctagcagcccagggatggaaaagtcccggccgtcgctggcaataatagcgggcggacgcatgtcatgagattattggaaaccaccagaatcgaatataaaaggcgaacacctttcccaattttggtttctcctgacccaaagactttaaatttaatttatttgtccctatttcaatcaattgaacaactatcaaaacacagaattcaaaacgatgcgtttcccatcgattttcacagctgttctgtttgcagcttcatctgctttagctgcacctgttaacacaactacagaggacgaaacggcccagatcccagctgaggcagtcattggttattccgatttggaaggtgatttcgatgtcgctgtgttaccattcagtaattccacaaataacggtttgctgttcattaacaccactatagcaagcatcgctgcaaaagaggaaggtgtttccctagaaaagagggcccagtccgttttgactcaacccccttccgtatccgcagctccaggccaaaaagtaacgatctcttgttcaggttccactagtaacataggtgacaattatgtgtcatggtaccaacagttgcccggaactgcccctcaactgctgatctacgacaataccaagaggccgtcaggtatcccagacagattttccggttctaagagcggcacatcggctacactaggtatcacgggacttcaaaccggcgacgaggcagattactactgcgcaacttgggataatgataagtggggagttgtttttggaggtggtactaaactcgaagtcttgggtggtggaggaggatcaggaggaggaggttctggaggaggtggttcatctggcggtggatctgaagtgcagcttgtggagagtggtggtggtttggttcaaccaggaggtagcttgagactgtcatgtgccgccagcggttttactttctcctcctatgcaatgtcttgggtcagacaagcacctggtaagggtttggaatgggtatcagctatttcgggtagtggtggttcgacatattatgctgactccgttaaaggtcgttttactatttctagagacaattccaaaaataccttatatcttcaaatgaactcccttagagctgaggatactgctgtttactactgtgctcgtgatgcttggttggatgtgttgtctgacggctttgactactggggacaaggtactttggtcacagtgagcagctgaggggcggccgctcaagaggatgtcagaatgccatttgcctgagagatgcaggcttcatttttgatacttttttatttgtaacctatatagtataggattttttttgtcattttgtttcttctcgtacgagcttgctcctgatcagcctatctcgcagcagatgaatatcttgtggtaggggtttgggaaaatcattcgagtttgatgtttttcttggtatttcccactcctcttcagagtacagaagattaagtgaaaccttcgtttgtgcggatccttcagtaatgtcttgtttcttttgttgcagtggtgagccattttgacttcgtgaaagtttctttagaatagttgtttccagaggccaaacattccacccgtagtaaagtgcaagcgtaggaagaccaagactggcataaatcaggtataagtgtcgagcactggcaggtgatcttctgaaagtttctactagcagataagatccagtagtcatgcatatggcaacaatgtaccgtgtggatctaagaacgcgtcctactaaccttcgcattcgttggtccagtttgttgttatcgatcaacgtgacaaggttgtcgattccgcgtaagcatgcatacccaaggacgcctgttgcaattccaagtgagccagttccaacaatctttgtaatattagagcacttcattgtgttgcgcttgaaagtaaaatgcgaacaaattaagagataatctcgaaaccgcgacttcaaacgccaatatgatgtgcggcacacaataagcgttcatatccgctgggtgactttctcgctttaaaaaattatccgaaaaaattttctagagtgttgttactttatacttccggctcgtataatacgacaaggtgtaaggaggactaaaccatggctaaactcacctctgctgttccagtcctgactgctcgtgatgttgctggtgctgttgagttctggactgatagactcggtttctcccgtgacttcgtagaggacgactttgccggtgttgtacgtgacgacgttaccctgttcatctccgcagttcaggaccaggttgtgccagacaacactctggcatgggtatgggttcgtggtctggacgaactgtacgctgagtggtctgaggtcgtgtctaccaacttccgtgatgcatctggtccagctatgaccgagatcggtgaacagccctggggtcgtgagtttgcactgcgtgatccagctggtaactgcgtgcatttcgtcgcagaagagcaggactaacaattgacaccttacgattatttagagagtatttattagttttattgtatgtatacggatgttttattatctatttatgcccttatattctgtaactatccaaaagtcctatcttatcaagccagcaatctatgtccgcgaacgtcaactaaaaataagctttttatgctcttctctctttttttcccttcggtataattataccttgcatccacagattctcctgccaaattttgcataatcctttacaacatggctatatgggagcacttagcgccc

SEQ ID NO: 67 - DNA, 2760 bp, Pichia pastoris
agagggaaatcctggggttgaaaggtaggctccagaacggacaaccacacctttccaaatgtcaaggacgaaatcattgctggcaataccctttctttgggcctcttctgctgagacgtcagtaacaccactcactcttggttccacaatcgaaatgtatgctaatctgtttccctgttttgcccgtttttcaagctctgaaaggacgtatccgtagagaacaattggatgagggtcgccattaactccagcggaaccttggacttctgcccaaggagaaagcctgactgccagcttttcagccccaacggtatcgatcaaaagatcaatcacttcaagcaaaaatctggctctgttttcgatagtacctccatattgatcggttcgttcattcacacctttcccttgcaagaattggtcgaataggtatccgtgagcaccatgtacttcgataaaatcaaatcccgcaacttcgactgccagcttcgcagctacaacatactctttcttgaagttctctatgtcctcaatggtagcagcctggatctcaatgcctgcctcctgggctgccttttcactggcttcactttcgtaaaaggcggatggtcctaacaacttcaaaccatgttccttagccaattttggagaagcgacccttcccagattccacaattgcaccgaaatggcagtattgttttcgtggactttgtctgtaatagccctccaagcctttgcctgtctctcggaccaaataccaggtgcttgatcgtacaggcctccctgcttggaaacgaatgttgcctcagttatgattagacctccattatcctttgaacggtcaccatagtactgcagttgtagctgagagggaataaaatcaacagtcgctctccttctagtggttggagcataagtgactcgagttgtcaggttgacgttaccaaccttaattggcttgaaaaggtttgtttctttcagatcagaaactgtcatctcgcttgaagaatcaagagttagcaccgcaaaaagtcaagaggttcctacctttatacgacagggaggactgcattagatcattagtaagctaagtgataacgtcttttcaggtcagaatttacaataccagcgccatacagagcgagttaaatttgaaatttgactgaagataagggcatcaagcggagaaccgttagcacaacccaggtgaaaggttcaaagtcaataacgctatgactgttcagattcagattggatcttcccgattatgtggcttggaccaaaaataaaatgttacgtaagaacactttggcccacgcttgaatgaatcgggcggtctggggttgattgtgactgcaaagaaattccaaatccaaatggactgactatcaactcatcaaaatgtcctaccagccttcgttttattatgctcctacaatgatcttagtgagctgccctgaacagccttctcctactgtgttatattaaccgcgcaggttgtttcatttcctgcacgcgtttctttcaggtcgtttcttttaggcgtcagtaactgaactgaaaagataaccagtttctgaatacctcgcaacagtgtagctgaggaaatccttgaaatggtctacgaagcactaaaatattgctttgatggtcaaactaatcagggactctgaaatccttgaataaagtacaactctatatgcatacagtctcatagtcaatctttataacatttacctacctttataacatctatacagccaagaattccaaaattgctttagttgaaatggtgattcatcgtcggtaacactgttcaggccagcgcaacgggagtttttttggacactgggtcgtcctcgcttaccactgtatcgtccccatacttcttccaagtattgtaaccatagttgtcattgcggtagaaggagtttcgatcataatgggtaagcttttgcccattcttcaatctttgtactaagtcaggattagaggtccaatatctgcctgcaccaatcaatgttctatcgtttgcattgacatccctaattagcgtggggtatcctgggttggaaagataggttccagaacgcacaaccacacctttccagatatcaaggacgaagtcattgctggcaataccctttctcttggcctcttctgctgagacgtcaataataccactcactctgggttccacaatcgaaatgtatgctaatctgtttccctgttttgcccgtttttcaagctctgaaaggacgtatccatagagaacaattggatgagggtcaccattgactcctgcagaaccttgaaattcagcccagggagaaagcctaattgctaacttttcagcgccaacggtatcgatcaaaagatcaatcacttcaagcaaaaatctggctctgttttcaatagtacctccatattgatcggttcgttcatttacacccttcccttgcaagaattggtcgaataggtatccgtgagcaccatgtacttcgataaaatcaaatcccgcaacttcgactgccagcttcgcagctacaacatactctttcttgaagttctctatgtcctcaatggtagcagcctggatctcaatgcctgcctcctgggctgccttttcactggcttcactttcgtaaaaggcggacggtcccaacaacttcagaccatgttccttagccaattttggagaagcaactctgcctaggttccacaattgcaccgagatggcagtattgtttcgtggactttgtc

SEQ ID NO: 68 - DNA, 1070 bp, Pichia pastoris
agtcatcagctcgcgctgattacgccctgcccttcgtacacaccgcccgtcgctactaccgattgaatgtttagtgaggcttgggagggcgcgagcctgaacttggacaaacttggtcatttagaggaagtaaaagtcgtaacaaggtttccgtaggtgaacctgcggaaggatcataaagaagcttcggcgctagccggagcgcacttacacactgagtataacttctaggataatacatatacacaatcagattatttaaatctcctcccaacggatctcttggctctcgcaacgatgaagaacgcagcgatccgcgatacgtcctggaagccgccgtgaaccatcaattttcgaacgcacattgcatacagggagggtggggtgagtctactctcacaatcgtggtttaaatacaaaggatgactaataaaaccgtcacccctcattttctcccccgccccctcagattacccgctgaacttaagcatatcaataagcggaggaaaagaaaccaacagggattgcctcagtaacggcgagtgaagcggcaaaagtccacctttgaagtattgacgtggttgggagaggcaatgtgcacaagtcgcctggaacggccgccaaagagggtgatagccccgtggcacacgaccaatcttcccagccgacagagtcgagttgtttgggaatgcagctctaaaggtggtagggtccatcaaagactaaatatcagcgagagaccgatagcaaacaagtacagtgatggaaagatgaaaagaactttgaaaagagagtgaaacagtgcgtgaaattggggggagggaaggcaaggccacgacaagtggtcctgcgcccgtcttgaaacacggaccaaggagtctaaccggggtgcgagtgtgcggacgaacatccaagcgcgaagcgaaagcgacactcacctttggtggtgagtgagccagcacccctgttgggacccgaaagatggtgaactatgcctgaatagggcgaagcctgaggaaactctggtggaggcccgcagcggttctgacgtgcaaatcgatcgtcgaatt

SEQ ID NO: 69 - DNA, 975 bp, Pichia pastoris
atgtaacatttgtatataatttatataaatataaattatatattctaataatggtaagatttatcggggattatcgaattaaaaaacacaatccactgcctttatctgtaaccgtctattgtcttggatttcatccttgcgaatatactcaccaggcggaatacttacgttttcacttactacaaattttatttatagaagtattcatcgtttactgcataaactaatcgggtatcgaatccgttttgctacttatgccttcatccctcaacgtcagttttatttttgattaatgttttcacctttaacagtctaattattatcataattatttcatctttactataattattctttaatcatacttaaaactctaatatatttttatttatttcctcctcactttttaactttaagttaaaatctcagtttattaggaaattatatatcgttctacggatcctttaagccttaatgattaacgttagccttcatagtgtaaccgcaactgctggcactatttttggttaagactattattatagattatcattattttttctataatttagattttatttttaatcaattttatctttattcaaattcccttcaaggaaaaacatagtccctccttgaaagatgtatattgataattcatctttctaagtaactagatcaatctttcgatcattgtctaatattccttactgctgtttctattgaaattgatccatttcagaatcaacgtgatcattataactttcattattgactatggatctttggctaggttggtccttatccaaactactacctaatccattattgacttgactattaacgaatttttattctttttatcttttctcctagatgaactatagttcaatctacgatatttataagataatttataaaagtatttaactttattaatagttcatattttcaatctcttactcacgtttacac

SEQ ID NO: 70 - DNA, 951 bp, Pichia pastoris
tcacccgactaatagggaacgtgagctgggtttagaccgtcgtgagacaggttagttttaccctactgatgagccccacggcagtaattgaacttagtacgagaggaaccgttcattcggacatttggtttttggggctgcctgacaaagcagccccgacgctacgtccgtcagatcatggctgaacgcctctaagtcagaatctgtgctggggtggggaggagtgtacaagaaggatatatttcatagcagcattccacaatctcccgcccacgacttgaccccgacagggtattgtacgcagaagagtggccttgccgtcacgatctgctgagattaagccccggtcgagcgattggaacttccataccgaaggacgagcctagaccccaccgagcgcagcgaaggtggtggtcgtggctcgttccgaagacggttaaccaagcggtaccaagcgagcgcagcgacgctggttggtgaacttgtattcttccaccaacagtcaaccaccagtcaactacccaccaagcgtaccaagcaaccgcaacaacgctggttggtgaacgcaaatctccaccagtcaaccacgccccgtcgtaccccgacagaccctccttgttgagtccaacaggcggccctgtcctgctccgctcccgtggcctgccgttccattgaccacctggatctgtgaggattgtcctggacttgagattctccttagaagtcctcacgtgacacctccacttccaaaaaactgtcccacctggacttgcacttgcacttgcacgcacttgaaaaactataggaacttgagaccttcacctgacctcaccttgactccctcagcatcacccccccagctgcgctccgctcgccggaccatctcccgccggatacgtctcccgcggttggacttgccatcatctgactccccccagctgcgctccgctc

SEQ ID NO: 71 - DNA, 1018 bp, Pichia pastoris
gtagtcgttaaccataaacgatgccgactagggatcggggaatagccttccccggcaccttacgagaaatcaaagtctttgggttctggggggagtatggtcgcaaggctgaaacttaaaggaattgacggaagggcaccaccaggagtggagcctgcggcttaatttgactcaacacggggaaactcaccaggtccagacacaatgaggattgacaggatgagagcactttcttgattttgtgggtggtggtgcatggccgttcttagttggtggagtgatttgtctgcttaattgcgataacgaacgagaccttggcttttaactaggttacctggcattgctgggggatcttcttagaaggacaactggcgcaagccagcggaagcgaggcaataacaggtctgtgatgcccttagacgttctgggccgcacgcgcgctacactgacggaggcagcgagtccttgccagagatggccggggaatcttagactccgtcgtgctggggatagcgctttgcaagaggcgcttcaacgaggaattcctagtaagcgcgagtcatcagctcgcgctgattacgtccctgccctttgtacacaccgcccgtcgctactaccgattgaatggtttagtgaggctttgggagggcgcgagcctgaacttggacaaacttggtcatttagaggaagtaaaagtcgtaacaaggtttccgtaggtgaacctgcggaaggatcataaagaagcttcggcgctagccggagcgcacttacacactgagtataacttctaggctaatacacatacacaaacacagattactaaatctcctcccaacggatctcttggctctcgcgacgatgaagaacgcagcgatccgcgatacgtcctggaagccgccgtgaaccatcaattttcgaacgcacattgcatacagggagggtggggtgagtctactctcactatcgtggtttaaatacaaaggatgactaatacaatcgtcagcccccaaattttctc

SEQ ID NO: 72 - DNA, 6760 bp, Pichia pastoris
tatttgtaccatttatttgaggaggattctcagtaagtaatccaacaattcaacgttttttttgcttttacattatttattaccatttatattagctgcattagtagtattacactttattgcattacatacaaatggtagttcaaatcctataggtattactggaaatatagatagaatatcaatgcatccatattttatctttaaagatttaattacagtatttgtattcttatttgtattctgtttatttgtattcttttcacctaacactttaggtcaatcagtgtggcctttaataaatatattttatatatatttattacaacatcgtgctatatgctggaaatgttttaattataataaaactaatattattagtgatttattttttattataaaattttatgcgaatcccttattagtaaaatattattataataaatataatcagcagataaccaatatatataaatatatccctaaagaaggattatatttgataactaggggtaattatatattagtaggaatctcagagactacacgcacacaaaatttaattaaattaacccccggggacggactacgttcgatccccggggtaaatatacatttatataactttttcattaacttttatcttttattcttaaatttatttacttatttaggatctagtaaggaaaataatatctcagaaattgaacatagttcttttcctggggataatattgttaattataatacacataataataatattaataataaattcaatcaatgattagccggattaatagatggggatggttgttttggaataacacagaaaaaatatacaaattgtgaaattacagtaggaatagaagatgaaaaaatgttacgtcaaattcaaaataaatatggtggttctattaaattaagatcaggttcaaattctataagatatagattacaaaatagaccacaaatgataaatctaataaacgctgtcaatggaaatattagacatagtaaaagattagttcaattagcaaaagtatgtaatttattagaaattgatttaatttctcctatacctttaaataaagacaattcttgattaagtggattttttgatgcagatgggacaataaattattactattataataataatagaccacaattgtttattagtgtaactaataaatatttaggagatatacaaccatttaaagatattttaggtggagagatatattttgataaatcacaaaatggttattataaatgagttataactaatgaaacaaatcataatatatttatagaatatataaaaaataatccatcaagatcttttaaaggtaatagaatatttttaataaaaaaatattataaattatataatataaaagcatatttaaataatgaatcattattatataaaaattgatctaattttgaaaaaaaatgaaaaagttatagttataaatttttttaattaaatattgaagatatagtccaatttatgcatcctgataattatataccaggaaatccattagtaactccagcttcaattgtaccagaatgatatttattaccattttatgcaatattacgttcaatacctgataaattaggaggagtaatagctatgtttggagcaatattaatattattatcattaccttatacagatagaagtataataagaggaaatagttttaaagctttatctaaattctttttctacttattcttatttaatttcttattattaggaaacttaggacaattacatgtagaaataccatttattaacttaggtatatatgcaacaatattctattttagttattttgtgataattgtacctgctatttcatcattagaaaatatcttattcgtattaggtagaagatcagtaaaataaatctcaaggatttaacaaaatctatttgtagataaataatattattatttctctaaaaagagaaaaaaatatccatcaatatattttacttagaatatactacattagatattctggagtatttgaaaggtggaataaaaataaagaaaatgttatttacatcattattattaataatagtatatggatcattagtaaataaaagtcatttattaacaaaattaattaatagattaggattaataattataatatatacattattaattcatttaaatataaatacattagaaaatttatcaatagggataaatatgtttaataatttattattaattaatagttttaataatacaataatagaattaatattaattatatgtattttatatgtattattaatatcatttaatattacaggattatctataatagataatttaaattatagtaaaagaacatttatagtcatagtattatttaatataataggattaacattattaccattagttaatgatataatgatattatttatcataatagaattacaatcatattcattatatttattaacagcaatatttaatgaatcacataattctactaaatctgctttatattattttatagtaggtagtatagcttcatttattatattagatgctacagtatcaatatatgatgatttaggtttaacaaatattcaatatattttaatgtatatagataaattagaaatatttgatttattatgtttattatttggattatttattaaaattggtttagcaccattttattcatattctataacaatatattcattaagtcctacaataattacaaattatataagtttaatgcctaaattaagtatattaacattaatatatataattatgcattatattaatatagttaataatacagatttaaattatgtaataagtttcttaattttaatctctatgtttataggtagttttggtggattaaatgttattagaataaaaacattattagcttatagtagtttattaaatgtaagttatatgttattagctattttaagtaatagtaatgaatctattatcgcatatatttattatattatacaatattcattaacacatataaatatatttagtattatattagtaatatcaatatatttacctattatgaataataatataacttctaatacagtagataataaatactctaataatggaggtaatatgttaaatgtaatgataactaaatattcacctatagaatatattaatcaattaaaaaatttatttattaataatatatttatagctatagcattatgtataagtatattctcattaataggtatacctcctttaacaggattttatggtaaatatttagtattaatatcaggattaaataatggttatgtattattatcaattgtattaataatagctagtagtatatctacagtatattatgctacaatattaaaagtattatcatttgatacattatcatttaaagatattatatcaaataatttaataataaatacatcaccagaaaataataataatgaaattaaaccagaaattagtaatgtaataagttatgttattagttcattaactttaatcatattattaattattattcaatatgaaaatatagtaaaaggggcatatttagtattattatataattgagtttaatgttacaagatttatttaataattatgttattttagtaggtattttaggtttaatatttttaggtgtaaattatttcattgttgaaagtcctagaatggatgaaaataatggtaatattagtgattatatagaaaaaagtggtccttttgaatgtggttttagtagttttgaacaaagtcataatcctattccaatcgcatttattttagttgctttattattcttaccttttgatttagaagtatcatcaatgttaccttatatagtttcaatttattcagtaggtatttatggtttaattatatttattttattcttattaatcttaatagtaggatttatttatgaatttaatacaaaatctttaagtattacaactattttacataaaaaaaataaagctttagttaaaaatttatactaaagtctttaatttataatattatttttataagtgatataaatatatatatttcttcttaaatctttgaattaaagttatactcttaattaatatcaagagatatactttatttataggaggagaatatttaggatatatgtgtttatctataatgtataatataaatataattatataagattaaattttttttaataaattacaaaaatcgaattaaattcgtaggaaatattaaaaataataatctaaagttatttattaaaataatagagttaaattattaattttaataaatctagaaccaggtattatcctgtactagaattatatttaaaaatcaattagaatatgaatattattatttattactagaatcatctgatgatgtatttaagattattataattaaacctataaatttataagaataattattaaaattaataaataatattatttatataaatattatatatatattaaaataaaagattttaggtatattatatataatataaaattaatgtatactaataggtatataatttaatatatttatttaaaaacgaagttctagacgtaaataataaatagattaaatataataaaataatgatcatttattaatgaattatataaatagatgattattcagtactaatgcaaaagatatagcagttttatactttatatttgcattattctgtggattattaggatcaataatgtctttaatattaagattagaattatcagctcctggtaaccaaatattaatgggtaaccatcaattattcaatgtagtagcaacagcacatgctgtattaatggtattctttttagtaatgccagctgcaataggattttttggtaattatctattacctttaatgataggtgcaagtgatatgtcatttgctagattaaataatatttcattttgattattaccacctgctttagtatcattattagcaagtgcattaatagaaaatggagcagggacaggatgaacagtatatccaccattagcaggagtacaatcacattcaggtccatcagtagatttagcaatatttgcattacacttaacatcaatatcatcattattaggtgcaataaactttataacaacaacattaaatatgagaacaataggaatgacaatgtcaaaattaccattatttgtatgagcagttgtatttacatcaattttattattattatcattacctgtattatcagccggagtaacattattattattagatagaaattttaatacttcattcttcgagccagcaggaggtggtgatcctatattgtatcaacatctgttttgattctttggtcaaaaatggccgttttgatatgtaaatatcaatttagatttcgctatatgcaagaaactttgaaattatataatattagggttaaactttgtttgaatcataaataaaaatatagtaactttgaacttttttaattgaaaaagagaaatagtttctctcgtagacgaattatgttttatctacgggggaggaataatattaattactatatttataagtctttttaatttaagagccaatatagttaaaatattaatattaataaagagtaatttgcagataaccaaaagtagatgaaaatcttacttagtaggaatctcagagactatacgcgaaacatccttattaaaatctcagaaaatattaaagtctgggaaaaataaattaaatgataataaatttaatgaatgattagccggattaatagatggggatggttatttaggtgtatctaaacaaggatatacatcatgtgaaataactttacctttagaagatgaaaaatgtttacaacaaattaaacaaaaatttggtggttctgttaaattaagatctggtgttaaagcagttagatatagattacataatagaataggtatgataaatttaataaatagtataaatggaaatatacgtaatagtaaaagattaattcaattacataatgtatgtagtatattaaatataccaatacaatatccaataaatttaactttaaataatagttgattaagtggattttttgatgcagatggtacaataacatattcattaaaaaataattatccacaattaacaattagtgtaactaataaattattaatagatgtagaaatgtataaaaatttatttggaggtaatatttattttgataaatctcaaaatggctattataaatgaagtatacaaagtaaaaaagatatattaaattttatagaatatattaaaaataatccatctagaactattaaatttaatagacttatgttatgtaaattatattataatttaatagaattaaaagcatataaatcagaaatagattcgataaattataaagcatgattatcatttaataaaaaatgagataaaaaataaggatgaaaaaatagtccaatttatattataatttaatataaatagcatccagaagtatatattttaataattccaggatttggtataatctcacatatagtaagtacatatagtaaaaaaccagtatttggagctataggtatggtatatgctatgggaagtattggatttttaggattattagtatgaagtcatcatatgtatacagtaggattagatgtagattcaagagtctacctt

SEQ ID NO: 73 - DNA, 1002 bp, Pichia pastoris
ttagcaacattatatggagagtcaataagatatactacacctatgttatatgcattcgcattcttattcttatttacagtaggaggattatcaggggtagtattatcaaatgcaagtttagatatagcattccatgatacatattatgtaattggtcaagaaatggcccataatattacctcaaatatagggttatactcttatttgatgagtaataattatgaatttgactatatgctggaaactatatttttaagtttatatttactattaatcttctgtggatctaatttgtttgatcctcagagatatattataaattctcaagaattaaataatattttgaatcatagtaatactaagatttcaaagagaaatatctttaaaatagatgaatataactttatgaatagattaaattctatttatgaggaaatattaaataaaattaatagtcaaaacaatataaaacttgttatgttaaataaacatacggatatacaatcagcagaaaacgaaaacttaaaacaagtattaggattctcagagactatatgtcaacaatctacccccgtggacggactaggttcgatccccggggaaaatatagataaaaagttctctttaaatagtacgaaggacgaattaagttcgacctatcggagaaatacaaaaatagaattattaaataaaattcaatcaataaatatagatgataaaattttaaattgattcgcagggatattagatggagatggatattttcaagtaaaaaaaataaatggaaaaaataaattaaaaagtatagaaataaaaatacataatagagatataagaatattaactcgtatacaagataaattacatataggaagaatttatagatataaaactaaagaatattcaaaatgaatagtatctacacaattagaaatggaatatattataaataaaataaatggaattaataaagattaaaaagtagaacttttaaaaaaaagt

SEQ ID NO: 74 - DNA, 9592 bp, Pichia pastoris
tttgcaatcttaggatttgcattatcagaggcaacaggattattctgtttaatgatttcattcttattattatacggagtataataaataaatttttaataatattatttttaatagatttaatagaaaattactttctatatataaattcaaataaaaaatttatatatatatattgattttaattaaatgaaattaaataataatttaattcgaaagaataaagattaaatcttgtaaatggtattatataggtcaattgggattatatataagaaatatatatatatatatatatatattctatagattataatttaaatataataaaaccaagtcaatgaagcatagtttaataaaataccacaatctaaggttatattataattttgggttaatgtataacagtggcgaaattggtaaacgcggttagtttaggtctaatttaaatgtgggttcaagtcctgtctgttataagagaagatttccaatgttggtaattggtattgagctgtaaactcaacgattaagttcttcgtgtgttcaattcacactcttctcattaaataatcttctagggatttattttagaggattatgttttaatagcttagtggtaaagcattgcactgttaatgcatagatttgggttcgattcccaattaagacttaactatttaataaataattaatttaataaaaccttgtttaaagtaatacttttttctaggaaaatacttgtaaattaattatattattatttaacttacgtgtaaaataattaaattttatgtaagaattaatagtaaattatatatataatttatcaaatgaactaaggtaatactttggtcttaggatataattagttaagtagattaaattaaatttatctactataaatatataattgaattaaaataaaaaaaaagatcaaaatatgaagatattttccattatatatttaggtatagaagataattttatacttaaataaactcataattataatttttaggggatcaattatgttagattttttaaagacttatagtataatgttgagttataacataataaaggtaaaagaaaagaaaaagaatgaatttagaaattttagatttatcaatattaggattttattcattaataagtagtaattcatttgaatcaatagcaatattagtagcaacaataatgccagtaataacagaattatgatataattattcacaattatttgcattattatatacattaatatatgtaggagctgtagtaattttatttgtatttattttatcagtaataaatgaaaaagaagaatatgaatatgaatatagtggtttatttatattaattttagttttattattagatgatttagatgataatgaatcaaatgataatgattataataatgtatatataacagattatgcagattgatttaataattataatgaatcagatttatctgttataggtaatttattatttacagaatatgctttattattattaataatttcatttattttattaatgagtattattggtttaattttaattgttaaaaaagattaaattaaagtaaaatcttaaactttgtatacaacataagttgtatccagggtaaattataagattattaaaaaaatattatattgaattttaataatcttatatagatcttttgatagttattttatattcatataattatatgggtataaggtttaaatatgaaatatattttattttatatttaaaatatgatatatcttagataaaatacattaatttatatatttaataatatattcatataattatattataattatatgggtaatttataggaaaataaccttgtggagtgatttattctcgaggggaatattagatataacaaatatataaaaaaagattaaatctattataatttaattctctggatttatatcaatatcatagttatatttaagtattatgggagattataataatagatttaataagaaaataaaaaagtaatgttaaataatttatttgattttatagaatatatagaatattgattaataatagtagcatttgtagcatcagtattaatagtagtagcttatttaacagttgcagaaagaaaaacaatgggttatatgcaacgtagattaggtccaaatgctgtagggtattatggagtattaatggcagtagctgatgcattaaaattattatcaaaagagatagtattaccacataatggtgatattatatatgtaatgagtggtcctttaatctcattattttcagtattattaagttgagctgtaataccatttggtcctggattatcattattagatagtgaatattcaataatttatttattagcttcaggatcaataggagtatttggaacagtaattgtaggatgaatgtcaaattctaaatatacagtattagcaacagtaagaacaacagcacaattaataagttatgaattagttttaacaacagtagtatttataatagcattaattgtaagttcattaaatattaatgtaattatagaatcacaatataatatatgatatattataccattctttccattatgtttaatattctttatctctgctttagctgaaacagctagacctccatttgataatgttgaagctgaatctgaattagtttcaggtcatatgacagaattatcagcatcaccttttgttatattcttcttaagtgaatattgttcaatggttttaatgagtacattaacagctatattcttttttggtggatatttacctttttctaatactatacatcatttaattttaaatttatttgatcaacatagtatttattattttattattgaaggtatcttattatcaggttatttagccattaaagctaatttctttatgttctcatttgtttgaattagagctgcagcacctagattaagatatgatttattaatcttattctgttgatatgttctattacctatcgtatttgctattgtagtatttgctccaggtatattatattgctttgatgcactacctgttattatataattacccgtcacgaatataatattatttgctgataggaattattttatatatattcattctgattaaaggtatactctatatcagatataatattatttcttgtataacaatgttataacattgttaaaatcatggataatttatattatggtattatttttccggaatcagagtataatcctgtctccgggtataatattattcttaatactatcttctataaattatgttaaattagtaagataaatttattcaatttaagattgaatttaaaattggaatttcaatttcatggatgaactttgtttaattcagtaaatagttatataatccttgaataataataaaagaggattatagtattattatgaaattgaaaggtaattaatataagaaatatatatatataatataaatcctgtgtatgaaggatagttaaatggacaggggaagatggattgatgatcgagtggtttatggtgtaatatttgagatattaagtacttttatagtaccgtaggttcgaatcctactcaatccgaaatatataaaagggggtaatagtttaattggttagaacaattgctttgcaagcagtagatcccggttcgattccggtttactccataggttctatagcttaatagtaaagcctcattttgtcacaatgaaagatgcctgttcaattcaggttggaatcgaaaggaaactttttcatcggtaagataaattatttgctacataattgaatttatattcatgaagggttcgaatcccttagtttccgatttacctttaatttaattggttaaaatattaatctacggaattaaatatattggttcaattccaataaggtaataaataattaggaaataaatctagttaatttaatttttatttatcgcctaaatataactatagggtaaaaatgatgaataaaggaaatgtaaaataaaaatattataaatataatatatataaaaaagatatattatatataataagaaaaaaaaataaaaaaatacaatgttagtacaaaatttaattatatttaatataataggtatagtattattagtattattaaataataataataatggtatattaaataaaaaatcattattaacaataaaaaatgaattaaaattaaaacaaataggattaataataagtataataaatatattaataataatagaaaattgaataggatttaattcaaattattatggatttcaaaatatagaaagatttttaaatatatattgaggaatagatggtatatcactattattagtattattaactttaatattaggaccaatagcaatattatcaaattgaaaaaatttaaaaggatattatacttattatgtaatatcaataaatatgttagtaatattaatggctttaaattttatatgtttagatttagtaagtttttatatattatttgaatcaacattagcaccattatttttattaataggtatatatggagctaataataaaaataaagcagcatattatgtattaatttatacattagctagttcattatttatgttattatctattgtaatatattatataataataaattcaacagattatatatatataaataatataattttatcaataaatttacaaagtttattatttataggtataattataggtattgcagtaaaaacaccattgatgcctgtacatacatgattaccaacagtacattcagaatcaccattaggaggttcaatattattagcaggggtaattttaaaattagctatttatggtgttattagattattattacctaatttatcagaaatatcaatgatgtttacacctattatttatataatatctatattaacattaatatatagtagtttaattacattaaaacaaactgatttaaaagtaataatagcatatagttctataagtcatttagctgtatgtatgataggtatatttgcaaataatttaataggtataaatggatcattaatcttatgtttagctcatggatttgtatcaccagctttatttatattagttggaggtattttatatgatagataccataatagattaataaattattatcaaggtttatctacatttatgcctatatttagtatatacttagtagtatttagtttctgtaatacaggtacacctttaagtggtaattttgtaggtgaattcttatctattacaggagcagttataagacatcctattattggttcattaactgcagcatctgttttattatcagcatgttatcaaatgaaattaacaaatagattaacaggttcagtattctcacaatatttacatattactaatgatgtaactaatagagaaatattcttattaaattgattattaatacctactattattataggtatctatcctagttttgtaacaaatattttaaatttagcttcatctactttaatttattctgtattaatataatttttatttacttttatattatactcttaattagttaatatagcctcattgattatgtaaaattcgtgagtaagatataatattattatttttatttgaaactaaaatataaatttgaatttaaatttaattaaaaatttaatataatttagtttttgttatatgtatatataagaaatataatatatatatatatacaaatatggattagtgttagtggtctaacatattgattgcaaattaattatttttgagttcaattctcatctagtcctacgtaataaaatgtattacgtaaagaaaagtcattatggtggaattggtagtcacaatacacttaaaatgtattgctttatagcgtataagttcgagtcttattaatgacataaattctttattataatttattcacttcataattaaagtgtaaagttaggtgtaataaatctaattaaacaaagtttattgagaggtgattaatgaaaataatgtaataggaagtaatattaaactcaagaaataaattatattttatcttggggagaataatataataattatttttaattaggactaaagtataaatcaggagttaaatataattgaatcgtagactaataggtaagtcacttgcttttgagtcaagtctataatagttcgaatctattcgattcaaaatagggagaatagtttaatggtaaaacgtttgacttttaatcaatttatgcgtggttcaattccggcttttcctattataaccgccagatgtattttgtttgatctttggtggttcaatataatctttaatagaaatgtaaaatattttttagtttttttaagatttagtattgaaaaaaaaaataaggtaaatataatttaatcggttaaaatggatgcttgtggtgcattaaatctgagttcaattctcagtatttaccctaatttatgttttcttacataaacctggggataaaatgtaatctgttactggggacaataaatttattgagataaatttaatttttatcttgtaatttatatattaatataataagattatatatcataatatagtattggttttaaatatataaagttagtatagtttaattggttaaaacgattgtctcatatgcaataaatgttaagttcaagtcttactattaacatatattaattcatttcttattaggaataataatgtatatatgtactttgaaatgtattatgttaaatttcgggtaaaaattaatatatattaatatatatatatataagaatatattatataatatttaattttgtatattctaagatattaatttaaatattatttaaagataatttaaataattattttttagtatgtaaatatagaatatatacttgttaaatataattataattagtataaatatataatatatgacaaataaataaaaataaaatggaaaaaataattaaatgaggagtattattattagataataaagatattgaaaaaaataaattaatcttaaaagaattattattaaaattaaaaatattgaaagaaataaagataaataattcaaataatgtgaaaaatataaaaaaaggattagtatctaatattcaaaaatataataagataaataattgaaaaagtcaagtatataaatttaataaaacagaattaataaatacaataaatttagataaattggtaaaatcattaataaaaatgataataacattaaaattatatgtaatattatcaacaaaagaaaatgaaaatacatctaaaaaaatagaaagatcaatattaattagtgatataataataaaacataaattaaataaagtaataataaaattttattataatattggtaataaaaaattaaatagtaataataaatattatatatcatcaataaatatttgattaaatacattaacatcaggtgtaaagaataatggtttaaataatttattaagtaattattataataaagaagtagaaatacaacctatatatttaaaatataattatttaaatagtaatatttttatgtcaagtataaaaaaagaattacaaaaaaatagaaaatttaatttacaaggtagatataatagtaatttaattaacactatccctgtattaaataataaaaatatagctttaaattatattaaacaaaataaaataatatttaataatgaattaaataaaagtatacaatatttaaataataatttaaacttattaaataagaataataataataatataaatataaaatcaatatataatattaaaaataataatcaattattttcacaattattatttaaaaatattataggttgatcattattaataaaaggtagattaatatcatcaggtgtaaatagaactactaaaatattattatctaaaggtacatttataaatagtatatctaatactagtaatttattccataatgtatataaattaaattctactaaagtaaatttaactcaaacaaattcaagttataattatataaaatatggtaaaataggtttaaaattaaaattaaatactatataatattgaaaaatcaaataaaatttgtcagtaaaaaaaaagtataatactaaaatttataatatactttaatttagagagaattatataaataatattattattaaatagaaaaaaaaagaatatttataaacagaaaatataaagaatatttagtaatttagagtgtaaatatgagtatatataaatatattatgtttaaataaaattataaaattaaattaatataagtaatatataatattgaaaaaagtagcaaaaatataggaatatgagaaaaaagaaagaaaaagtgaaagatatagaaaaataggaagagtgaaaaaaataaaacataagcttggttaacaatattatatatttctaagggttatataaataataattatagatgaagattagactatggtttaggaggaggggtcataatcagatagataccgaatggttaggtgctttttttgggtaaaagaattagttagttcgattctagcctatctgaaagctcttttagtttaattggttaaaacttattacttctaataatatgatcaacgttcaaatcgttgaaagagtacaatatataatactaagatcaaagtgtaaatcttagtgaataatattataaataattaaagggcggactaggttcgatctctgaaaataaattaaataataatagatgataaaaatctaagtaaagaataaaggtaaatataatgtaaaagagagtttagttaaattggtataacatttgttttacacacaaaagtgtataggttcaaatcctttaattctcaaataaatataagtaatatataaagaaagaaaaatataaaaaaatataagagtatgatgttggctcagattaagcgttatctaagaacataatacatgcaaatcgaacgatatatatatattaaatatcccccggtgacggattacattcgatccccggggtaataataatatattatagtggtgtaaacgtgagtaagagattgaaatatgaactattaataaagttaaatactttataaatatcttataaatatcgtagattgaactatgttcatctaggagaaaagataaaaagaataaaaattcgttaatagtcaagtcaataatggattaggtagtagtttggataaggaccaacctagccaaagatccatagtcaataatgaaagttataatgatcacgttgattctgaaatggatcaatttcaatagaaacagcagtaaggaatattagacaatgatcgaaagattgatctagttacttagaaagatgaattatcaatatacatctttcaaggagggactatgtttttccttgaagggaatttgaataaagataaaattgattaaaaataaaatctaaattatagaaaaaataatagataaatctata

SEQ ID NO: 75 - DNA, 982 bp, Pichia pastoris
aaataataaagaaatagaatgaaataaaaatctaaagtaagaataaaggtaaatataatgtaaaagagagtttagttaaattggtataacatttgttttacacacaaaagtgtataggttcaaatcctttaattctcaaataaatataagtaatatataaagaaagaaaaatataaaaaaatataagagtatgatgttggctcagattaagcgttatctaagaacataatacatgcaaatcgaacgatatatatatattaaatatcccccggtgacggattacattcgatccccggggtaataataatatattatagtggtgtaaacgtgagtaagagattgaaatatgaactattaataaagttaaatactttataaatatcttataaatatcgtagattgaactatgttcatctaggagaaaagataaaaagaataaaaattcgttaatagtcaagtcaataatggattaggtagtagtttggataaggaccaacctagccaaagatccatagtcaataatgaaagttataatgatcacgttgattctgaaatggatcaatttcaatagaaacagcagtaaggaatattagacaatgatcgaaagattgatctagttacttagaaagatgaattatcaatatacatctttcaaggagggactatgtttttccttgaagggaatttgaataaagataaaattgattaaaaataaaatctaaattatagaaaaaataatgataatctataataatagtcttaaccaaaaatagtgccagcagttgcggttacactatgaaggctaacgttaatcattaaggcttaaaggatccgtagaacgatatataatttcctaataaactgagattttaacttaaagttaaaaagtgaggaggaaataaataaaaatatattagagttttaagtatgattaaagaataattatagtaaagatgaaataattatgataataattagactg

SEQ ID NO: 76 - DNA, 1553 bp, Pichia pastoris
cccagtatgtaagcagatttgacccttatgtaagctttgaacacttatgtaagctcgaaaccggttaggtaagcagctttgtaagcaatctggacaattatgtaagcgggttacgtaaacagttatgtaagcagaaaaatttcaaacgacaaaacttggggtctacagacacagtagccagaagattgcactaccattcgactcctcatgacccactctttcgatccatgtagttaggttaccgtttttcctaatatttaaggatgttgaaaattcattttcatttttttcgtttttaagattttctcacaactcttccaaagattactagttgacttttcaaatatttagggtatttttctcactttttcctagcaaactccaattggtgggtccagtgcaatggagtacgattttgcaaccacaatgtgatagctaacttgtggccaccatgtctggttgtagagataattggattctaatgtggatcacatgactactcacgtgtcaaaaacccaacctgacttggcccagcttagcaagaatatttcgaatccactcttgtggcctagtggacaactgggaaagcttgcgacgcagtcgtttttggcgatccaggcgtagtactaggttcgagcctggtcattcagatggctcagaacttgaggttgactgagttccaggttcgagtccaggacgggttggttggtgtcgtcggctttcggttggtctttgatcggcactcggcatgatgatgttgagactgacgcgtcgactggacgtgtttacgtgtttacgtgtttactacacggtccacgcgtaatgtgtggtcttgtatcttatcttgtctggtgtcttttgtctggtatcttatcttatctgggatgtgtattatgtaagcaggagaaaactctgcggcaagagaaaaaaacaacaagtccaaccgcgggagatcatgcggggagggtggccggcaagcggagcgcagctgggcggtgatgctggggggagtcaagatgatggcaagtccaaccgcgggagatggtccggcgagcggagcgcagctgggcggagaggctgggggagtcaaggtgaggtcaggtgaaggtctcaagttcctatagtttttcaagtgcgtgcaagtgcaagtgcaagtccaggtgggacagttttggaagtggaggtgtcacgtgaggacttccaaggagaatctcaagtccaggacaatcctcacagatccaggtggtcaatggaacggcaggccacgggagcggagcaggacagggccgcctgttggactcaacaaggagggtctgtcggggtacgacggggcgtggttgactggtggagatttgcgtccaccaaccagcgttgttgcggttgcttggtacgctcggtgggcgttgactggtggagatttgcgtccaccaaccagcgttgttgcggttgcttggtacgcttggtgggtggttgactggtggttgactgttggtggaagaatacaagttcaccaaccagcgtcgctgcgctcgcttggtaccgcttggtgggat

SEQ ID NO: 77 - DNA, 1312 bp, Pichia pastoris
acgccgggagagtcatgcggggagggtggccggcaagcggagcgcagctgggcggtgatgctggggggagtcaagatgatggcaagtccaaccgcgggagatggtccggcgagcggagcgcagctgggcggagaggctgggggagtcaaggtgaggtcaggtgaaggtctcaagttcctatagtttttcaagtgcgtgcaagtgcaagtgcaagtccaggtgggacagttttggaagtggaggtgtcacgtgaggacttccaaggagaatctcaagtccaggacaatcctcacagatccaggtggtcaatggaacggcaggccacgggagcggagcaggacagggccgcctgttggactcaacaaggagggtctgtcggggtacgacggggcgtggttgactggtggagatttgcgtccaccaaccagcgttgttgcggttgcttggtacgctcggtgggcgttgactggtggagatttgcgtccaccaaccagcgttgttgcggttgcttggtacgcttggtgggtggttgactggtggttgactgttggtggaagaatacaagttcaccaaccagcgtcgctgcgctcgcttggtaccgcttggtgggattacgtcttcggaaacacaacctcgctgcgctcggtgtgtttccttcggtatggaagttccaatcgctcgaccggggcttaatctcagcagatcgtgacggcaaggccactcttctgcgtacaataccctgtcggggtcaagtcgtgggcgggagattgtggaatgctgctatgaaatatatccttcttgtacactcctccccaccccagcacagattctgacttagaggcgttcagccatgatctgacggacgtagcgtcggggctgctttgtcaggcagccccaaaaaccaaatgtccgaatgaacggttcctctcgtactaagttcaattactgccgtggggctcatcagtagggtaaaactaacctgtctcacgacggtctaaacccagctcacgttccctattagtgggtgaacaatccaacgcttaccgaattctgcttcggtatgataggaagagccgacatcgaagaatcaaaaagcaatgtcgctatgaacgcttgactgccacaagccagttatccctgtggtaacttttctggcacctctagcctcagggtctgagggtgtaaaggatcgataggccacactttcatggtttgtattcacactgaaaatcaaaatcaagggggcatttgcccttttgctcggctgaagatttctgttcttcatcgagccccccttgggacatctgcgtta

SEQ ID NO: 78 - DNA, 1182 bp, Pichia pastoris
ctttttcgcgggtgcaaaactagactaggtggatatgcgttgggtggactagcggagtgaattggtcgactgtttgttaggagtctggtgtgcgcgagacgtccctaacaaatgtgcgatttcgacttacgatttttcagaccgtgagatgggacaagtatccgcgaattgccttgctgggcattctgggcgggaagaatgtttcgctggaaggggaactttagattacagggcaaacatgcaaatcccaggcggggaaagcgctgatttctgcggttcaggccctgatccggagtttgagaaccccaacatcagaatacaccaaaatgggttgaggtggtgaatgctatgtagtgaacgcttatgtaagtgagcacttatgtaagcggttgaccattatgtaagcttgtggtttacgtaaactgttatgtaagctttgaccattatgtaagcttgtggtttacgtaaactgttatgtaagctttgaccattatgtaagcttgtggtttacgtaaactgttatgtaagctttgaccattatgtaagcttgtggtttacgtaaactgttatgtaagctttggccattatgtaagctttaaacacttatgtaagctcgagcccagtatgtaagcagattgacccattatgtaagctttgaacacttatgtaagctcgaaaccggttaggtaagcagctttgtaagcaatctggacaattatgtaagcgggttacgtaaacagttatgtaagcagaaaaatttcaaacgacaaaacttggggtctacagacacagtagccagaagattgcactaccattcgactcctcatgacccactctttcgatccatgtagttaggttaccgtttttcctaatatttaaggatgttgaaaattcattttcatttttttcgtttttaagattttctcacaactcttccaaagattactagttgacttttcaaatatttagggtatttttctcactttttcctagcaaactccaattggtgggtccagtgcaatggagtacgattttgcaaccacaatgtgatagctaacttgtggccaccatgtctggttgtagagataattggattctaatgtggatcacatgactactcacgtgtcaaaaacccaacctgacttggcccagcttagcaagaatatttcgaatccactcttg

SEQ ID NO: 79 - DNA, 5479 bp, Pichia pastoris
tttggataaggaccaacctagccaaagatccatagtcaataatgaaagttataatgatcacgttgattctgaaatggatcaatttcaatagaaacagcagtaaggaatattagacaatgatcgaaagattgatctagttacttagaaagatgaattatcaatatacatctttcaaggagggactattgtttttccttgaagggaatttgaataaagataaaattgaattaaaaataaaatctaaattataagaaaaataatgataatctataataatagtcttaaccaaaaatagtgccagcagttgcggttacactatgaaggctaacgttaatcattaaggcttaaaggatccgtagaacgatatataatttacctaataaactgagattttaacttaaagttaaaaagtgaggaggaaataaataaaaatatattagagttttaagtatgattaaagaataattatagtaaagatgaaataattatgataataattagactgttaaaggtgaaaacattaatcaaaaataaaactgacgttgagggatgaaggcataagtagcaaaacggattcgatacccgattagtttatgcagtaaacgatgaatacttctataaataaaatttgtagtaagtgaaaacgtaagtattccgcctggtgagtatattcgcaaggatgaaatccaagacaatagacggttacagataaaggcagtggattgtgttttttaattcgataatccccgataaatcttaccattattagaatatataatttatatttatataaattatatacaaatgttacatcgttgcttttagttcgtactttatggtgttagattaagttcgctaacgaacaaaactccacatttattaaaattctaactagagttatactttagggaattataaaataaatggttttttcttgtaaataagaatataaatggaattaaagcaaatcctgatgactttaatataatgggctaaagacgcaatacaaaattttatacaaagttatataaaaattatatttagatataattttaataattaattaaaataaaatatccattgaattatatttaattcataaataaatttggattaatatctgaaattcgatattatgaaaaaggaattgctagtaatcagttcttcataatagaacggtgaaatttatcctctgtttcgtactaattactcatcattcgcttaaatgatatttaaacttaaaatatataaaatatattttatattaatataaaatatattattataatgtatataatatatatccttgtttaatatcaaataagtgagaagttgaaatacagttatcgttgaggaatcagcggtgggctataaaaatctctataatattcttctttaatatactccgaattagagtataaccctggtccaggaaattttataataattttatatggttttagtttaaatattcccaatgaatcgattatattcacaggtttatataaggtatttagtttaatggcaaaaccgtaaccttcaaagttatattcggaagttcgaatctttcaatacctgaaataatagtaaactgttatatatatatataattataaatcttaatatagtattaagataaaagtatcttccacttaagacgaattatattcgatttatagggagtaaatcaaataaaatcttgtcaatgaattttatttgattggcaagagaaaaaaaataaaataattataaagaattgtaattataaaaagaaaataaaataaaaaataaaaaaaaagatggctataagaaaatcacaagcttatttaagtttagttaatagttatttaatagattcacctcaaccatcatcaataagttattgatataatttaggtagtttattaggattatgtttaataatccaaatagcatcaggaatatttttagcaatgcattattcatcaaatatagaattagcattctcatcagtagaacatattatgagagatgttaatcaaggatgattaataagatatatacatgcaaatggagcttcatttttctttatatgtatgtatttacatataggaaaagcattatattatggaagttatcgtaaacctagagtattagtttgagcagtaggagtagtaatatttattgcaactatggctacagcatttatgggttataaaaacaatagcccaaaatcatattattatattaattatcctctggaaattgaacgtagttcgcgtcaggggtctttatataatggttcaaaaggtatatttaatatatctcaaaaaagagatattcattattatataaatcctaaacaagacataactaaacctgaagaaatatttaattcattaaatattaatttagaaaactattgagataatttacatgataataatatacgttcacaaatgagatcagatttaaaagataaaagtggaatatatataattataaataaaatatcacgtaatatatatgtaggatctgctataaaaaataaattatatacaagattttctaatcatatgttaaattttcatggaagtaaaatagtaaaaaaagctattttaaaagatggattaaataattttatatttggtatattagaatataatttgtatgatacaaatattaataatatcggaaattcagagttatactctagccttggaagagactatttatatgaattagaaacaatatacataaaattattacaaccaaaatataatatattattagaagcaaaaagtagtataggttataaacatacagatgaaactatcaataaaattaaatcctcatttactaaggaaagacgtttattattaagtaaattacaatcagatcgtaaaaatagatgatctgagaatagtataaataaattaagaaatattgcattaaatagacctaaagattatcttacaaaaaatggaagattaaaaatatctgaagtaaatagtaaaattataggattatatgatattaataataaatatgtatgtaaatttaatagtataaatacaacagctcattatttatgtactagcactaaaacaatacaacgtggtttacatttgggttgaatatatataccattaaaattaacaataaatttaaatgataattatattaataataataatgatttattaaattcaaatttatctcctaattctaaagttaatttaaataaaaaagacttatattatataaattcaagaaataaattaagtaaaatgaaatcaggtttagttaaattagattttagtattaaatattatataaaacctttaacgccattaaatatgaataataacatataaaatcaataattagttaaattatacggggcacaggattatattttgggtccaatataataatatgatagtctactatattataaaactaattttatagttttataaccccggggacggactaggttcgatccccgggggacttatataatttaacagttaaatattccaccagtgatgggtaatattcaatttttgggttaaattttaactgtaaataaatataactataattgtaacttttattagaaaaattatagagatagtaaataatagtatattattaatgaaaatatattttcattggcgatgcttgtgaaaacgattaaaaaatatatatataaatattaaagataatatatatataaaagatcgtcggttaaataaataatcgcgacagactggaacacaagtgggtgtctgaaattgatgcttaatgcacagtcgaataaaatttagtattgtttagtatatggacaaatgagtcactgaggtaaaataaatgcctgaaatgtaataattatatatattttatataaccggggggatggattacgttcgatctaccggggaattctatacttcgaatcagagttatattctggttttgataaatatttaaggaaaacaattttagctatcgtaccaaaatttaatattaaacaaaaatgaaagatattaaaaagatgtgaaaaaagatctgagattacaaatttaaatgcattaaatgataaaatattatctataatttatggatcattattaggtgatgctcatgctgaacatcaaaggaggaaaaggtactagaatcttattttatcaagaaagtagtcatttagattatttattatatttacattcattaataactaatttaggttattgtaatagtaagatacctaaaatacaaactagattagtaaataaaggtaaaataagacacataataagatttagtacttgaacttatactcaatttaatataatacataatgaatgatataaaaaaggggaaaaaatagtacctttatctataaaggaatatttaactcctttagcattagctatttgaattatggacgatggatgtaaattaggaaaaggattaaaattatcaacaaatagttttaaatataaagatttattatatttagttaaaatattaaaagataaatataatttaaaatcaactattcaaaaaactggtaaaattgatcaatataatatttatataagatcagaatctatgcctaatttagtaaaaatagttaaaccttatataatttcaagtatgaaatataaatttggagaatatatataaaagattatatagtgttatatataccttttaaaattatatttaattgagggttatactttgtattaagtaattttaaggttatttatgtaatatataattaaaaataaatatttttatactctaccttttaggaaaaagtataaaaagtatataatgcaacattattgaaaacaggtcaaagttatatgttaaataataagaccgtgggtaaattatattatccctacagagtggtccaatgatgggtgtctgaaattgatgcttaatgtgcactcggaaataaaaatatattgtccctaatagaggggttatatccaattaaaagggttaataaaacaatatattcacaaggcttataataaactggagaatgggctttttatattaataaaattaataagatttgatttactataaataataaaaagtagattttgaagtaaatataagtacatggtataatttatattaacaaatatgagatcaagggtatactttgatcgataaaataatacttagggtgagaataatattctcgtctgggtaagaataaattatatttttattttggcaactgtaattactaatttattatcagctataccgtttataggacaagatattgtaccatttatttgaggaggattctcagtaagtaatccaacaattcaacgtttttttgctttacattatttattaccatttatattagctgcattagtagtattacactttattgcattacatacaaatggtagttcaaatcctataggtattactggaaatatagatagaatatcaatgc

SEQ ID NO: 80 - DNA, 6417 bp, Pichia pastoris
agaagtagaccttcgcatgttttgagatgattttcatcacgcaaaaaaattttttagatgattttcaatttttagacacttaaaagggaattttagatctatttccccccaaaacaaaccctttcatcatgtttcagagttctattagatccaaaaataaaaatttagaaggaaattttttggatcatttatatcatttttagatcatcccaaaaattaaaaaagaacactaaccattctcttcgaaatggttatctccatccatcatttcattttttatttactatcaaggtaattatttgaatgtctatactcaaatttttaaaatggaatataaggataattataatagagctttagagattcttcatcaacaattcaccgagagtgtatttaattcttttcctgttgaattaaaatataatttaattgaagagaagagaagattattagattttgaatggcaagaacagaatttaaaagaacatgataaaaggaaagctcaggctagagctttaggaagagaaatggcagctcataagaaacctgatagaataggtcaagatcccttaggtccatatactagatacaagagtgtttctattagcatagaagaatcatcagagtttatagaaccggaaccagtcgcttcttcaggtgttaactttcactgttttagaaaagaaactttattaggtctaaaagatagagtaattcaagcagttaatgaagctgcttcttataaagatacatctagacatcctgtgtcatacatgtactttaaaatgtataataatggtaaagcttgtgcttctacaagagctgtatcagtctcagctgataaattcgaagagcaacttgatcatctttttgaagattacgaaagagtagttggactaattaacaataatgtctatggttatgaaagtttatttagtaatgaatctaatatttatacgtctttctttatgaaagccttatattttccttcacctaaatctattttatattggggtaagaatttacccaaaattttacctttaggtatatttaaactctttacagctaatgatactagtatagattgtattatccaatgttctaggtttttagattcaaagactaactttgataagttgaatgatataattcagcattttaataataaggtttgtattttaacacctcaacattatgttttagatattaatgagattagatcctattcagatttaagattacatcatgatagtcctattaagagtttcagtgtcattgaccctgatattaaatatttattaatgtataaggaacatgtaggagttctttatgattttaaagagtctagaagagctgttagagtaactaagtttaatcctcttagtaaatattcaaagacaactagagtgacagtatgttttgatattgaagcttattttgatccagaaaatgattctggtcatacaaatattccttatttatgttgtgcttgttttgtttatgatagttctataggtaatgtattagaattcgagggtcgtgattgtgttgctcagatgattgaatatgttatagaaatatgtcgagagttaaaaattaaaaatatagaattaattgctcataatggaggtgcttatgactttcattatattcttagtagtatgtatgatccatcacgagttaagaatattttaataagaaacaactcatttataagttttacatttactcatgagaatgtactgtttaatgttaaagattcttacagttttctattgtgtagtttatctaatgcagcaaaagcatttttggataataatcatgattttagaaaaacagatttccctcatcatgaagtaaggacaaaagaagatcttgagagaacttataggaggtggagatctgttgacactattatagatacaagtgttgagaaagagaagttactaatatcttctcatcatgttataaattatgataatgataatgttagtaggagattaatagactggtctaaggaatactgttgtaatgatgttatagttttagctaaagtttggttagaattcaagaacgcagttttcgatatttttaattcaaaagtagtggatcagactttaacattagcaggtttaagttttaggttatttcaggcacatttagatcaaggtattattttaaaacatcccaggaaggaagattacatgaatatgcgagcatctcttataggtgggaggtgtataagtttaaatggtatctatgaaaacatattatgtttagatgttaaatcactatatcctgctgctatggctttctacgatcagccttatggtagttttagtagagtacatgatagacataaggatgaattaggaatatatcatgtgtcagtaaaaccacaatataagaaacatagttcaaatttctttccaataagattcaatgataaagttacatacgataattactcttcagtagaatatactgcttggtatacaagtgtagatatagatattggtatttctgaaggacatgatatttcttatctcccattcgatgaggagggccatgttggatattcatggagaggtaaagataagatatttaagaaatatattcagaatacattatacaaactaaagcttaaatatgaagttgaagataacaaagtaaagagacaagttataaagattattatgaatagtttatggggaaaatttgctcaaaaatgggttaatacaaaatattctattaaacatgagtttgatataaattttgaagaggctgaggcatataagatatgggatacagagtttatgttgcttaaagagtttgaagagggagagttcgcctctaaacctatacagaatggtgtatttacattaagttgggcaagacaccacatgaagcttatatgggatgcttctactaaacctggaacagaatgtatatacagtgatactgatagcattttcattagacaagaagactttaatgttaacagtatgtttgaactgaacaatgaaacagttaaagttcttggatctgatgtagggcagctagaattagaatgtgtattcaatagattactatgtgtaggaaagaaacagtatatgggattttataagtactttgattctgaaaataatatcaagctaggagagaaaaagagatttaagggtattcctgctaattatatatcaccggatttatatgttcatttacttaaaggcaaagataaaactgcacagattaagtttcttaaattcagaagggaatggggatcagtaaaaggttacatagaaagcaaaaatgtgaaggcaacttaatatctttcaaaataatgataagtatacattttagataatattttttcattttctgtaccataatcaagactatctaatagttttatatggttccaaccaagttcaataaactctcctattatctcattataatctgttaaattttctatgaattgatcatttagatatattttgttattttcaattttagtggtaaatgtttctgattgatgatcaaagggatgactcatacatatcagtataaagtaatcagcttgttctattaatttaataaaatctttatcccagggtacaaagaatattgaaacagagttatattttatgtctgtaggtatatttctagcgtagtcttttatttctagtacatttttactatgttcatttaattctaataaagggtctatacaatatacttgttcaaatttgaggttatgccatttatttatatcttcgcccgtagctgatcctatatctaataacctggttttaggtagaaattctaataatctagttttcattttattatgaaaacatttcaaagaaggtaatccaattccataagctattttataaagtggattatcatcataaggaaatttataattagctattgttttatctttcctttctttaattaggttcatttctaaatcaaattcataaattccatcttcttcaaatttataatctgtatttttcggtattctttcagctacaagttcattctctagtaataagtatccatttttaaatcttaaatctactgtattgataaattttgatttatatattaatttcctattgtaaatatttgttattatgaacccatctgttttatagtcgaatttgtattttaatattattcttagtccttcaagatcattaaattgatatgcaactttctttgattttttaggtaagaattttctcctttctaaataatttaatctacttatatcatttcctttatataagaaacaatcgtaagttaataatttattgttatctaataattctgcttcataaattgtatctggttctatcatctcttgttcaacaccctcaaggtctgtcaatttaccattatcatgtactataacagcttcatcgttattcttcgtgtatattaagatatgctctccatcagctttaggagcgatacaccattgatctgttttgattaattttctagctaaatttaaagatgatatttccataggttttacagctggccaaaacggtgatttgtgttgttttaatatatccattacttgattatgtgttcctagatcaaactctacttctaaggtgtattcatcatttacttttgtaattgttgtatacggacttttatttataatagctctttctacttttcttgtgtttacttttattaaatttaaatttctttttattttctgttctactgacaacactatgtttatgtcttttaattttattttttctacagtttcttttgattccatctgaccgtcattgatctgtctgaaagttatactaggatacaaagtggacctataataagtcagattataattttgtgtaaattttatatctttgggttttaaaattttagttctagcttctagttctactgttattaaaggtgattttaattcctctgctaatttagctaattttagaaacatggataataagatctctttggactgtgatactattgtatcatatggtatgtcatgggaagaagctaaacaaatatttgatattaacagcggaaatctacaaaaagtatatattcggtatataatcaaaaaatatggtctaaagactgccgagaggttactatgtgaaccgaataagggtcaatcaaaaggatgaaattgtttactaaactctctgttgaaaaatatggttttttcacaacctatgacaaccaaaattatatattgtcttaccttcatcctgagacaccttatcgaagtttatttttgtgttacgaagttggtcaaggaaagacttatgctgcagcttgtttagcacatatttattgtttagaaggttttaaaactttgtatttatctaattctataaattctattaaaagttttcaaaatgaatataaatcagttgttaatgataatagatcagaatctttagagcacaatataaatgtaatgagctttactaaattctatagacaaaaattagatatgaattatggattggttatcttagatgaagttcataacctaagggaaaatgctaatagatataaagtcattaagaacaaattagatttaatgattaattcaaaattacttattatctctgctacacctatggttgattctgttgacgagatgcaaagtatattaaaacttaccaacgaggatactaaaatattattctcagcaagtagagaaagacctgaaataaattatgttggtgaaaaagtaaatggagagattttatttttatctcaacttaaaggtaaacaattagagtattataatagtcttaacagttcaaatgatacagtttacacatacaacagacaggcctctatatcttgtaatgatgagtttgatcctaatataccactagaagaacaatcttctaaggtttacagacttatagaaacactagatagtgaaaagttgacattagtgttctgtttttatattaaaagaggattgcattttatagcaaaggcattagaacatatagggtatactaagtggaatcctttaactgaaggtaaggcgtatgcaattatagaagggaacacctctcctcatgaagttaatgaaatcatgacagcttttaatagtttagagaatattaaaggtagcaagatacatatattaataggatcatctgtattaagtgaatctataactttatatagagtacagcatttacatattttgtctccattttggaattatggacaaatagaacaatcgattggtagagctattagaataaactctcattatggacttaaagaaagtactgttaaaacatttatttacatgctagcatatactagaaaaacgttggtaacgaatagtatgggaatagatatagaaaatatggaaaa

SEQ ID NO: 81 - DNA, 7217 bp, Pichia pastoris
agtagagaaagacctgaaataaattatgttggtgaaaaagtaaatggagagattttatttttatctcaacttaaaggtaaacaattagagtattataatagtcttaacagttcaaatgatacagtttacacatacaacagacaggcctctatatcttgtaatgatgagtttgatcctaatataccactagaagaacaatcttctaaggtttacagacttatagaaacactagatagtgaaaagttgacattagtgttctgtttttatattaaaagaggattgcattttatagcaaaggcattagaacatatagggtatactaagtggaatcctttaactgaaggtaaggcgtatgcaattatagaagggaacacctctcctcatgaagttaatgaaatcatgacagcttttaatagtttagagaatattaaaggtagcaagatacatatattaataggatcatctgtattaagtgaatctataactttatatagagtacagcatttacatattttgtctccattttggaattatggacaaatagaacaatcgattggtagagctattagaataaactctcattatggacttaaagaaagaatgttaaacatttatttacatgcagcatatactagaaaagttggtaacgaatatatgggaatagatatagaaatatggaaaactgctatgaataaaaagatattaattgatgagaaactaaaagaaattaaaactgataatataaatgtagaaaattatgagtttgtaacaccaacaattgataaccaaatggttgttaaatataaaaattggatatgggatttaagagattgttttgaacataataaatataaaatatcatggtgtaaattctttccagataaagctgtaggatatgacttggaaaacaaaatcaaaatcgtcggtagtctccctagttatttaagaataaacagacccttagaggatggatatactatttggaggtcatgtgtagataataaattaagaatatcctatatagctaaggaaaagaagaaattttctaagagaggaaagctagtttccaatgtgaatattaaagagttatccacagaattaggttgtaagaactcattaattgatataattgaaactttgaagaaacaaaagagatattttgataagcagattgaatatgttgtatgataagattgatacagatttaattagtcttggaacacccaaaaagttcaaaaatgaagaaaataagagtataactccagtattttataatggagaaagtcttgatttttcattgaagaacaagtatgtgcaggtagaaggtattgaagaaaatatctacaataaagaatatataactattaaatcaaaacaatatggtgaatttatttctgatgtttgtaataaattgggagcttttaatccaatacaattcgatggtagtttcagagctgttattaatgacaaatctaaaattgataagaaattaaagaatgctacttttaatgcctgcattagcttaaatattccgactgtatacaaagatggtgataaaacaacagtacaagtatatgttaaggatttggtagttattaaaattattgaagatttggaaatagattttgacaaactagagctagccatttgattaactatcgaagatttttaaaatggatcaaaccgattttggacagattgaaatttacaataatttatttagtaaactaaatgttagaacaattaaacatactcctagagaatgtatagataagaaattaagctattgtgggttattcaatagaagagagttacctataatgattggatctaaatttgacaagaatgagaatccattgaaaataaaaggatattttataatagatggaaattgtatgtcgataaataatataaaaattaaccagaaaatatctttctctagagatagagcatatttattagataattcaagaattgatataaaggatatgtttcattacacaagaactctcaaaggtgttactaagaaatggggtcttccaattaactggagagaaatactaaaatttagcaagcatgcaaatgtattagaaaaacatttatgtctaattacagatgaaagtgaaaagatagagagtgaaacagatctaataactctttgctatatgtttgaatgttggctaggactgagagaggaaccgaaagtaccatggagattattaacagccggagagataatttatgatgctattacatctaaacaaaatgtagtaaattgtttcagagtaagtacatggtcattaaaacaatattctaaagtatacacagtttcagaacacatgaaacactataatctaacttatgatatagaatcaattagaagaataacattgcctggaatgagagagaatacaagcatgaaaaacagacaagttaaatacgaagataaatataaaatatgtcctgtacagacatcagacggatctctttgtggcacggtgaactatttatgcagaaatgctaagatagtcaataagatcgaagagcagcctgaaataataaaagggaatattcacgtatttttaaatgataaatacataggtaaatgttcagaagaatatatcaataaagctataggagagaagataagaatagatgaactttgttttattaataatcaatatggtagagtaataaaaggagatagtattttaagctatacagcaagtttaattcctcatgtttttaataatcctcctgcaagagctatgtttacatgttcaatgataaaacaagctataactggagatagcagactaaatgataatcttataagtaatactaaaacactaataaatggagaattaggacacaaattgaatgttgcgattatgccctggtatggatacaatgtggaagacgctatagtaataagtaaatcaactgcaagaaaatttaggtctaggaaatgtacaatattaaaagaaacaaaatcaaaaataattggtgtatatgtcaagacaggttgtaaaatcattaaaggtcaagttttatataaaaaatacacaccaacggaaattaagactatagattggatacattcagaagttgatggagtagtagaagaattagttaataaacctgaatactttaaattggttataataaaaatgaaagaagtagaaataggagataaaatgacaagtagacatggtcaaaaggggatagtttcattaattgaagatgatcatgatatgccctactattacgatgaaaatgaaagagagataaaaatagatttattgattaaccctcacgcatttccttcaagaatgacaatggggcaaataaaagaaatgggagaaaaagaagttacaatgcatatacatgacataacttgtaaaaataaaataatagccggtgagtgtttatatatggctttaagacatcaagttgcagataaagttcaatttagaaactcagggagagtagacttgataaataaacaacctgttgctggtaagaaaaatataggaggaataagatttggtcaaatggaaagagatattcttattggattaggatgttggaaaactataaaagaattatggtcgatagataaaacaaatatatacgtgtgtcctaagacaggagaaataaacactaaatgctgtagaaaagtgagagagtctcatcaatattttaaaatatgtttaggttatttgagagcattaggatatgacattttaataaaagataataaatactctataaaggggttcaaccatgataaactacctaaaactgatactttaaattttggagatttagatccattggatttaagaatgtatgaaggaaatgtagtactaccatactgtctaagatcagagttactaaatagatattataattataatcataaaaatataaataaagaaattagaaagttattaaagagtaaaagtggagtttatcatacattagtagaaggtcataggatagataaatgtataagatcagtaataactcctaatccagaactcccgattgacacagtagaaataccatttggagccaatataggcacaaattatggcatccttaacagacaaccatcattgaatgtaaattcattaaagatagttaaattaaaacagagtaataataaaacaatttcatttaatccattattgtgtaaatcatttaatgcagattttgatggagatgaaatgaatatctatggaatagtagattcagtagatgaattgaaagaaaagctaattgtaaaagaagacaaaacacaagattatattttaggggatttagttacagtaacagaagaaggtttgactgcaaataaagaaggagtaaaaagaatgataaaaaataaatcaaaaggatctgattttaactataagcacatgtttgaagaaataggagacgtggctattaatggtaaaatacaaggccacataacagaaggttacaatggaaatataacagaagatgattggtatttattatgtatggcagcaagagagagtactgcgtctattggagtaaacactcctgttacaggacatttagaaaacatatgtaaccagatgtatatctaattacataaagaatatcttctcactaggcttttctatctctttaaaaggtatcttttcaatcttattatttccttttatacaagctacaggactcatcttttgagacaaagctttttctattaatgtataacctttagatgtgtagtaagcaggttccattattctactctcttcaacaatatcaaaagatccgtctgtaaaaattcttttaaattttttaccttcatattgaatagttaaaacctttttagttttagcatttgtaacaaatcttttaatttcttccatctcctctactaaagtaacatcagtaccagaaacgtgaaaagcacttaaagttttctgagttacttcagaaaaatattccaaattatctaatatatcttgattcattttcagtttccaggctatttgacatcacatactattttaaactcagcaaactgttcaaaactatccaaccaccgtatgggaggtaaaataaaagggccctcttgtatcaattgctttccaggttttaatgttaactttaactcacctttcgaatcacaagtagaacccaataaaaactgttctaataaatcttttgtcacgttatttgaatagtattccaagaaatttatatggctaataacatacatattatagagtataaaatagaattcagatacaggattgacgatatattactatggtgcgatcaatttcaattaaatgaagaatgggaaatattgagaattaaaacaaacaggaaaatgcagaaaacttttatggaccgatctccttcagttgaacctcaaaaagactatgacatagctctttatacaaaaaataaatggatttgtttaaaagataatacaggatatgtagtaagtaatctaaataaaaaaccagaaataccgaatctagaaataaaatcgtttacagctacaccattcttaactgtaataaataaagaatttgattttcatacttttatgacaatacttcatctaaaagataatataaaagtattagaattcaaacgaccttcattaaaggagggactcattacttacaataatatgagaatagaaatatacgataaacttatagtatataagggtgaaaaacagaaagaatttctaaaatttgtaaattcattaacttttgaagatgaacagatatcaaacataatgaacatgttagataaagatgatacaaaaactcataaatctatagcatatcttacatggtacaaagctaaaagagagagtcaaaatgaatggccgttgataagtacagagagaaaagaaaatagtattgagttccctaaaaattcaggaatttattactattatccaaataaatatgttggattagcaaaaagaaatgatgataatcctcaactatttataccaaaaatatataaattagaccacttaaagaatgaaaactcatttttatataaatatacaaatgatataccattagaaaatagaattaaaatacccaatatattaaagagtgtcaaaaatatgcctaaattaaataatcaaaaatatatagaattatcttatgaaaacaaaataatagaaatggataaaaatccagaatattatgtttatagaaatattatattaagacctataaatgaagaaatagagatagaagattttaatgcacagatattagacaaaaacaatgaaagagtagagatatatgtaaacaataaatggaaaaatgactcaggaccaagaattagaaatataattactataccgtggcattataaacaaataatacatgattataataaactaaatagacttaagaaaggacctataatggacctaacacatataggagtaataaaccctaaaggagacgacataataacatggcctgaaattgataatctatatgtctcaaaaacattagaaacaagacgacttatgaccttcaaatatcagaagaatgttaaaatagaaatattatatgataagcaatgagtagatacaaatgagtaaaaaagaagttaataaagccataagcatcctaaacaagtctattattaatgatataatcattaaaatagaaaatcttgatatagatgataaagataaacaattaattaaggatacaattactagttacaaacaaaaacctaaaagaaaagcccctaagattcctcttgaaaaacaatgtagagaaatgactaagaaaggagaaaaatgtacagttcctaaatgttacaaaggcgtgtgctgggcacacatgaacaaagatgaaagagaaaagtacagatcaatgaagaaagtcacagaagtttaaatgatggatggagataaccatttcgaagagaatggttagtgttcttttttaatttttgggatgagtctaaaaatgatataaatgatccaaaaaatttccttctaaatttttatttttggatctaatagaactctgaaacatgatgaaagggtttgttttggggggaaatagatctaaaattcccttttaagtgtctaaaaattgaaaatcatctaaaaaaatttttttgcgtgatgaaaatcatctcaaaacatgcgaaggtctacttctttttttttttattat

SEQ ID NO: 82 - DNA, 1007 bp, Pichia pastoris
atttttccccggggatcgaacctagtccgtcacgggggtagattgttgacatatagtctctgagtaatcctaatacttgttttaagttttcgttttctgctgattgtatatccgtatgtttatttaacattaacaagttttatattgttttgactattaattttatttaatatttcctcataaatagaatttaatctattcataaagttatattcatctattttaaagatatttctctttgaaatcttagtattactatgattcaaaatattatttaattcttgagaatttataatatatctctgaggatcaaacaaattagatccacagaagattaatagtaaatataaacttaaaaatatagtttccagcatatagtcaaattcataattattactcatcaaataagagtataaccctatatttgaggtaatattatgggccatttcttgaccaattacataatatgtatcatggaatgctatatctaaacttgcatttgataatactacccctgataatcctcctactgtaaataagaataagaatgcgaatgcatataacataggtgtagtatatcttattgatcctccatataatgttgctaatcaactaaatatttttattcctgttggaactgctattaccattgtagcacttgtaaagtaagctcttgaatctacatctaatcctactgtatacatatgatgacttcatactaataatcctaaaaatccaatacttcccatagcatataccatacctatagctccaaatactggttttttactatatgtacttactatatgtgagattataccaaatcctggaattattaaaatatatacttctggatgctatttatattaaattataatataaattggactattttttcatccttattttttatctcatttttattaaatgataatcatgctttataattatcgaatctatttctgatttatatgcttttaattctattaaattataatataatttac

SEQ ID NO: 83 - DNA, 952 bp, Pichia pastoris
ataattatactcatcaaataagagaataaccctatatttgaggtaatattatgggccatttcttgaccaattacataatatgtatcatggaatgctatatctaaacttgcatttgataatactacccctgataatcctcctactgtaaataagaataagaatgcgaatgcatataacataggtgtagtatatcttattgatcctccatataatgttgctaatcaactaaatatttttattcctgttggaactgctattaccattgtagcacttgtaaagtaagctcttgaatctacatctaatcctactgtatacatatgatgacttcatactaataatcctaaaaatccaatacttcccatagcatataccatacctatagctccaaatactggttttttactatatgtacttactatatgtgagattataccaaatcctggaattattaaaatatatacttctggatgctatttatattaaattataatataaattggactattttttcatccttattttttatctcattttttattaaatgataatcatgctttataatttatcgaatctatttctgatttatatgcttttaattctattaaattataatataatttacataacataagtctattaaatttaatagttctagatggattatttttaatatattctataaaatttaatatatcttttttactttgtatacttcatttataatagccattttgagatttatcaaaataaatattacctccaaataaatttttatacatttctacatctattaataatttattagttacactaattgttaattgtggataattattttttaatgaatatgttattgtaccatctgcatcaaaaaatccacttaatcaactattatttaaagttaaatttattggatattgtattggtatatttaatatactacatacattat

SEQ ID NO: 84 - DNA, 4997 bp, Pichia pastoris
agagatatattataaatctcaagaattaaataatattttgaatcatagtaatactaagatttcaaagagaaatatctttaaaatagatgaatataactttatgaatagattaaattctatttatgaggaaatattaaataaaattaatagtcaaaacaatataaaacttgttatgttaaataaacatacggatatacaatcagcagaaaacgaaaacttaaaacaagtattaggattctcagagactatatgtcaacaatctacccccgtggacggactaggttcgatccccggggaaaatatagataaaaagttctctttaaatagtacgaaggacgaattaagttcgacctatcggagaaatacaaaaatagaattattaaataaaattcaatcaataaatatagatgataaaattttaaattgattcgcagggatattagatggagatggatattttcaagtaaaaaaaataaatggaaaaaataaattaaaaagtatagaaataaaaatacataatagagatataagaatattaactcgtatacaagataaattacatataggaagaatttatagatataaaactaaagaatattcaaaatgaatagtatctacacaattagaaatggaatatattataaataaaataaatggattaataagattaaaagtagaaacttttaaaaaaagttgtgattgcttaaatattgaatatattgaagctaattataatatattacctaatgatccatatttatcaggattaatagatacagatggatcaatagtttttaattattcaggaaatcgtatagaatgtaatttagaattaaaatataatatatattcatcaaaattaaatttaaataatgtaataccaaattataaaccaagtgtattattaagaacaaagaaaataactaatttaggagctaaagaatataaatcaatagcttttaaatatcaaacagttagaggtatgccatttttatatgattattttatgaagaatagattatattgtgatatgaagttttatagaatatcaaaaatattaaaatttatagaaatacggaaatatgccaattcattatattctagtgaagaatttttaatttattcagaatttttattagattgaatacaatatgataatcctaaatgatataaagtattatttgtatcaaaattaagattgaagagatagtccactatataaagcatttccattatgtattatcattaggagctgtatttagtttatttgcaggatattattattgatcacctctaataacaggattatattataataataatttagctaatattcaattctgattattatttataggaactaatgtaacattcttcccaatgcactttttaggattaaatggtatgcctcgtagaatacctgattatcctgatgcatttgcaggttgaaatgcaataagttcatttggatcattaatatcaataatatcagtaatcttatttgcttatgtaatctatgatcaattagtgaatggattaacaaataaacaattaagtactaatagtttatttaaaaaccctgattttattgaatcaaatattatctttaatgataattcaataaaatcatcttcaatagatttcttattaacttctcctccactaccacatacatttaatactccagctatccaatcttaatttatttatataaattatttttggtaagaattagtattaatcggagtatatatctgttctggttattcattgaataaacaaagttataataaaatctccgagattgtatatataatattattatttttcccggaaatagggttaaactctgttttcgtgatataattaaaattgtattttccccgggacactctggtccccggtttattaaacataactagattatactctagtaattattaataattatatatataatattataattaatttaatctttaaactagtattatacttaagttttattttatagttaaactgtagaaggattatttttaatatcaccccggggacggactacgttcgatccccgggggaataatattataatttatatagatctctggacaaaggtaatattttgtttcagggttaaaatatatcgtgaaaataaaataaatagaatgccacaattagtaccattttattttttaaaccaattaacatatggtttattattaatatatttaatattagtattagtatcaactaaaatattaccttacataatagaattatatattataagaatgacaatatcaaaattataatataataatagtttgcagattagatttgcaggaatattataatactgaaattagggttatactctaattttgggataaatgaatttaataaataataggacatttaactattaagttaattagtataaaagttctattaattttacttggcgattaatcgtgagggatatattaaatattagaatataaaaaggaataagatttaaaaaataattaaaaagaaaatgtttattttttctccattagatcaatttgatatgaaattatttataggatttgcatcacctatagattttatatcaaatttaaatataacaacatttacaatatatacaatattagtatatttagtaatatattatatatttaaattaagtttaaataataaaaaaataataggatcacaatgattcttatcaatagaagcaacattccatacaatattaaatatggtaaaaggacaaataggtggaacagcatatggaacatatgtaccatttatttatactttatttatctttattttaattgctaatttaataggtatgataccatatagttttgcattatcagcatgtttagtatttataataagtttatcaattataatctgaataggtgttacaattttaggtttagtaaaacatggatttgtattctttagcttatttgtacctggtgggacaccattaccattagtaccagtattagtattaattgaattattatcatatacagctagagcagtatcattaggattaagattatcagcaaatacattagcaggtcatttattattaaatattttaagtagtttaatatttacatttatgtcaatctcatatttaacatttggtataggaatattacctttatttggagtattcgctatagtaggtttagaatgagtaataggtatgattcaagcttatgtatttagtattttaacttcatcatatattaaagatgcagtatacttacattaaatatccccgcaaagacggatttcattcaatttctggggtcataatattattattttttaatactctaattaagtacccttttattaaaataaatctaacctaaaatttaaattttacttgaatttctttataattaagtggaatatatatatatatatatatatatttataaatatataagtaatataatagatttgaaaattaagaaaaaaaagataaaagagattattaaatgattgaaaaaactactaatagaaaaatggttaaaaaaagataaattaagcatttataaagagaccaaagggaaactgtaaaaaaataaactgagtgaactgaaacatctaagtaacttaaggaaaagaaatcaacagagattttgtgagtattggtgagagaaagcaaaaaagtttaaataagtatattgtgaaaataatagaaaaaggataaactaattcaaaaactaaatactattagtaagtaagaataagtaccgaaagggaatatcaatttattagtaattttataagcaattaatgattatgtaaatataatcaataatgtaccttttgtataatgggtcagcaagttattataattagcaaaatatattatctctactaaagaggctaagaaaatatattataatgaagatgaaagtaattacaaataatggaagttaattataataaacccgaaagtaaatgatcttaccataaacaggtgttaaaacgaccgaacaggttaatgttgcaatattatctgaagatttatggtatgcagtgaaagacaaatctgatttacaaatagctggttttttgcgaaatatatataagtatagcatttacaaattatctagccggtaaagcaattaataataattggggtactatcaaagtattatcaatattatttaatctcataatggttacgtataatcctaaaactataatggtggaggggataatgtaaatagtcagactattggtgataaggtcgatagtcaaaaggaaaacagtccagattaatagataaggttccaaaatatatattaagtgaaaatgatatttaagttttattttatttcaattttattaatgagaataaaatataccaatgagcgaactatgttcaatcatcggggttaatatacaattagtagataggtttgatagtaactattctttaataaacgtgtaacaacgtactaatctataactttttaaccttaaatagataataatcggatctaaatatattaccgaatctttaattattattagtaaataatgatattaataataaggtagcaaaacatttaataattactataatatattaattatattatatatatattaaataatatatagatatattaaatatttatatatttataaaaaaagaattaaatagagaatgctgacatgagtaacgaaaaagtggtttaaaccacttcactttatatctaaggttttactataaaatcggtccataagagataattctaaagagaatatttcgagaggtaattaatatatgttatataaagactattagattatatttataataacaatatttaagttgggtattataaatataatatattataatagtactggaaaaaagtataatgtcttggatcagagttagactttgattcaaggttaataataccgtaataaaaccgacacaggta

SEQ ID NO: 85 - DNA, 10254 bp, Pichia pastoris
ggtggaggggataatgtaaatagtcagactattggtgataaggtcgatagtcaaaaggaaaacagtccagattaatagataaggttccaaaatatatattaagtgaaaatgatatttaagttttattttatttcaattttattaatgagaataaaatataccaatgagcgaactatgttcaatcatcggggttaatatacaattagtagataggtttgatagtaactattctttaataaacgtgtaacaacgtactaatctataactttttaaccttaaatagataataatcggatctaaatatattaccgaatctttaattattattagtaaataatgatattaataataaggtagcaaaacatttaataattactataatatattaattatattatatatatattaaataatatatagatatattaaatatttatatatttataaaaaaagaattaaatagagaatgctgacatgagtaacgaaaaagtggtttaaaccacttcactttatatctaaggttttactataaaatcggtccataagagataattctaaagagaatatttcgagaggtaattaatatatgttatataaagactattagattatatttataataacaatatttaagttgggtattataaatataatatattataatagtactggaaaaaagtataatgtcttggatcagagttagactttgattcaaggttaataataccgtaataaaaccgacacaggtagaaaagttaaatatgaaagtgaatgggataattctggttaatgaactcggcaaaaagaactctgacgttcgtcaataaagagttataaaaaaagaagattatacgactgtttactaaaaacacagcactttgcaaaaacaatagttgtagtataaagtgtgaattctgcccaatgtttaataataaataaatttattataatggtaaatttactaaagttaaataaatggcggctttatcttgagagtcataatgtagcgaaattcattggctactaaatatagtcctgcatgaatggagtaacgatataataactgtatcaaccagaagcccagtgaaattgaattcgcggtgaagatgccgtgtacctgaagtaagacgagaagaccctatgcagctttactataattaaatagattgtattaatttttttaaattttagtcgcttattttaagctcataaagtaattaatattaataatagtgaaatacttttatttaatctaattaatacttaattttatataaaaactatagatttttatttttataaaaatatccccccggggacggactatgttcgatccccggggtaataattattgattaatatctaattattaattatatttatctcaattcagggttatactctggttttatataaatatatatagataaaatgacaatctttaattgatagtttgaatggggtgttgatttcatataaaataactgaatatgtccaattacatattatagaattattgaacccttgggacgaactttgttcgattttttgagggattataaaattaatgaattagtcattaaaattgttaaaaaagaatcctgaaagggatattctttattttagaataatttaagtacagtacatttggcttgaaaccaaattataacaaaggagttataaaataaattagtataatagtggataactgtgctataatttaacacttacaagtgaaaatgatacgtaagtatggtataatgaacagatcatgttgatagtaaaagtgatcgataacgaataaaagttacgctagggatttattatctaagtccctataaaattgggtgaattgcatagatcattatattagacatctacctcgtttaatataatcaatatgcagcgaagcttatcttagtatattatcataatcctatagatgaattatattctatctataggaagataataaagagatttgaacgttcaacgactagagaatgagtactaacaataatttctccacgagcgcccaaagtataattataatagaataagaaaaattaaaataaataaataaataaataaatgaaaattaataaaacacaattaataggtttaagtcctaataataaattattgaaagaatataaaaaacaattaaataataatttatctcaaatacaatttgaaacagcaataggattagtattaggagatgtatatttaagaaatcgttataatacaaattattgtatacaatttgaatgaaaatctaaagattatatggatcatataaataatatatttaatgaatatattatatcacctccacataaaaaagtaagaataaataagaataataatgaagttataacttgaggagctcaaacaataagtcatgaagcatttaattttttaggtaatttattttataaaaataaaataaaaacaatacctaagaatttagtttctgattatgttacagcaagaaatttagcttattgatttatggatgatggaagtaaatatgataataataaaaataatacaactaattttgctttatgtttaaatacacaagggtttacctttgaggaaataaatcatttagcaaaagaattaaatttaaaatttgatttaaaatgtagtgttattaataataaaaataaacctgtaattaaaatagatagtagttcttatttaacatttaaaatattaatagataaatatataataccttcaatgaagtataaattattatttaaatcttaatctagagttaaactttagattggaatatataatattattttaataaataaaatttgttataatatactatgatatagtctgaataatgcgaattattgaagttaaatataaacaatttaacgataacaaaataaattgaacagggtaataacatgagagagtagatattgtcaatgttgtttgccacctcgatgtcgactcaacctatcctattggtagcacacgctgataagggtttgactgttcgtcaattaaaaggttacgtgagttgggtttaatacgtcgtgagacagtatggtttctatctgctttagggaaatgtcaataaaggattacaacttagtacgaaaggattagttgtaattaatctatggtttaactattgcgtataattaattatatatttattaggtttagagttatactcttacctcagtatataatttaaaataaaattaaaattatatgcatcgtagtcaagctaaattaataataaataagtattgaatgcatataaaatatgaaattgaccttttgagacaataaatcttcccccggggacggactatgttcgatccccgggggtattttatcaaagttatactttgatattgtaagactcagtatttacctatggtttagtactgagctaatatattattatagtatactactatataaataggtttataataaaaaactcttaacagagtatttatataatactaattaataataatcttttttatctatctaatctattatattaattttatttatctaaatttaattaaaaaaagtattttattcttaaaagagtaggttaaatatgtaatctttgttattaggattatatatttaatttttgaggaatatataaggttatagtagcataattggtattgcgtttgttttgtaatcaaaaggttatgggttcaagtcctatctatagcatataataccagaattctggattaaaattttaactattatctagtggatgaatttttaattggagcggcaatgtttgattccgagattattataaatatttaaaatgaaggttaaatttatattagagggagagataatagatcttttagtctaatggttatgacattggttcttcataccaataatatcggttcgaatccgataaaggttaataataactttacataaagatgtgaagattaaacccataagatgggacatagtccaattgatggggaaatatataataacccagaatttaatggagttattatataaaataaaatattgaatattataataagaagagataaaaaaaagaaaaagaaaaagaatgagaattcaaaatagagaaaatttacaattatttccatttcatttagttacaaattcaccttgaccattaactacatcattagcattaatgtcattagcattaacattaggtttaacaatgcatggttatataggaaatcatttatgattatttttagctatatcattagtattaagtagtatattcttatgagtaagagatgtagttattgaaggtacatatttaggtgaccatacaatagctgttagaaaaggtttaaatataggatttatgttatttgtattatctgaaattttaatatttgcagcattattctgatcatatttccattcagcaatgggacctacaattgaaataggttgtcaatgaccaccagtaggtataacttcaataaaacctacagaattacctttattaaatactataattttattagctagtggtgcaacagtaacatgagctcatcatagtattttatataaagatagacaaggaacattagtaggattatttatcactacattattaattattttatttgtaggatgtcaagtattagaatatacttgagctacatttactattgctgatagtgtttttggttcaatcttttatgcaggtacaggtttacattttattcatatggttatgttaattgttatgttagctatttgttatgctagaatgtatttttatcattttacaagtaaccatcatttaggtttagaaacaactatactttatttacatgtattagatattatttgattattcttatatattgtattctattgatgaggttgttaattatactttataatattattatttcccccccccccgagacgaactatgttcgatctcgggggtttatttatatttaattttgtttattccttggtatagggttacactctgatccccggattatataagtaatatatattaaataatttgcataatagtgtaattggaaacacaatagtctcataatctattattttacgttcaattcgtaattatgcgtaaaaatatataaaccccgggtattaaattaggtttgttctcgggtaaatataaaagttaacataataaattagttttatattagtgtttttatatatataaatgatgaagattattaatattttattcttgatttaatattatatactagaaataggtataattataatagggaaaaggaattaataaaaatcctaataaaagtcttaaaatacctctgggattgaacaaatttagtccaggtggtggaaagataaggaatagaaagaaataaaaaaaagaaaaagatgaatttaaatttatgaaataataatataataatgaatgatgtacctacaccatgaggtatattttttcaagattcagcaacaccaaatatggaaggtataatagaattacataataacataatgttttatttagtattaatattaacatttgtatcatacatattatatacaataatatataattatagtaatgcaacaatagtacataaatatatgaatcatggacaattaatagaaatagtgtgaacaacattaccagcagtaatattattaataatagctttcccaagttttatattattatatttatgtgatgaagtaatatcaccagctatgacaattaaagcaataggattacaatgatattgaaaatacgaatattcagattttataaatgatgatggagaaatagtagaatttgagtcatatgtaataccagaagaattattagaagatggtcaattacgtttattagatgtagatgcatcagtagtagtaccagtagatacacatattagatttatagtatcatcagctgatgtaattcatgatttttgtgtacctgcattaggtgttaaagtagatgcttcaccaggtagattaaatcaaacttcagctttaattcaaagagaaggtgtttattatggacaatgttctgaattatgtggtgtaatgcatagtgcaatgcctataaaaatagaagcagttagtttatatgaatttataaactgattagacgaacaataatattattttttatcaacctatttatgaattattttaaatttatagggttaaaatatatagaattatagcttaatggtaaagccgctcactcataatgagctaatcagagttcaattctctgtaattctatttaatataatattactaaaattttatttataaattaaacctcgggaacatactatgttttataataaataggtttaataatatcaaggattaagggttatactttggtttaattgagattataagtaattttaaggtatattattctgagtacagggttatactctgtgacttggtatttattaagatacaaagtaagagaatattttgtattaagataatgaacctataggatcaaagataatttgatattaagggaaaatagattaatgtaatttaaagaataaaaaagaaataaaatggatttaatattattaatgttagtagcagtaggattaaatataatagatatatatataatgatagaaatattaataatgggttgtacagtaaatacaatatatagtgcaagtttagataatgatatgataggattaatatatagtttaatacaaataataatagcaggagtagaatcagcaataggtttatcaatattggtaaattataatagaataagaaatagtgaagaaatagaaaacgagtaatgattttattatgtatatttacaccttttttagggtcattaataagtggattttttggaagatatataggagttaatagtagtaaatgaatagtatgtttatcaatatttgtatcagtagtatcaacatatatattatttatagatgttatatttaatgaaatagagtatacttataatataatgaattgattaaatgtagaatatttagttgtagattgatcatttactattgataaattatcagtatcaatgttagttccagtagtaacagtatcatttttagtacatttatattcagtatcatatatgagtcatgatcctcatcaacaaagattctttagttatttatctatgtttacttttgctatgatagtattagtaacaggtgataattatttaattttatttgtaggttgagaatttattggagtagcttcatatttattaatttcattctgatttacacgttttaatgctgtaaaatcaggtttaagtgcattattaataaatagatttggtgatgctttattagtattaggtttaagttatttagtactagttacaggtagtgttaattataatacagtttttgctttaggtagttatttagatgtaaatatgattacagtaatattaatatgtttcttagtagcttcaatggctaaaagtgcacaattaggattacattcatgattattattagctatggaaggacctacacctgtatcttcattattacatgctgcttgtttagttattgcaggagtttttttattaaagatcatctccattattagaatatacacctattgtattattattaattttatgattaggtggtttatctacattaattagtggtttaatagcaatggtatcaaatgatattaaaaaaataatagctttatcaacaatgagtcaagtaggtataatgatgatagcaataggagtatcatgttataatttagcattatttcatttaatatgtcatagtttctttaaagcattattatttatgtcagcaggatcagtaatacatagtataatatcagaatatcaagatattcgtatgtatggaggatttagacaatttataccattagcatatacatgtatatttatagcatcattatcattaatggctataccaggtttaacaggattttactcaaaagatataataattgaatcaatgtatggagaatatacatttagtggatttattatatattgatttgcattaatatccgctacatgtacatcattatattcaataagattaatatattatacttttttaaataatcctaatagtcctaaatatatttatattaatttaaaagaaaatgatatagttttaattactcctatgataattttaacaattttatcaatatttggtggttatttattaagagatatttatttaggtatgggttctccatttaatgaattatttatacatcctaataatttaagtttaatagaaacagaatttagtttaccatctatattaaaagtattgcctttaataacaggtttaggtggtggattaattttattattaatatatgaatttaattattcattatttttagtatataataataaaaatttatcaaaattatattcattctttaatcaaaaaattatgtttgatcaattattaaataatttaattttaagatcaggtttaaatataggttgattattaaatgttcatatagatagaggtatattacaattatttggtcctttaggattatgaaaattatctacatttattagttctaaattaaataaattagtattcttaaatattggatttattttagaaattatagtattaagttgattattaattgtatttaaagtatctttattaaaatatattcttttattaattatatttattattttataaattaaccttgggtataactataggaataaactatattatattcccaatataatattattttttttatatatttttcttaataattatactctaaataggagtattatatttttgaaaaataaaagtattgtatattattttttcgaaagaagataaattatattttaattaaagaatataagtaatatatatatatatatttgcggatttaagtcaatggtagacaatttctcttccaaagaaaaagtgtttgttcgaatcaaacaatccgtattattattattataattttaacttccattaggattatattaagaagtaataatataattatggttaaagataaatatagtattcgtgaattaaataaaatttgtatgtgggagaaataatattaagtctataatttaacggttaaaatatttctttgataaggaaaaaataggtgttcgattctccttagacttatatagaaatataaccctggtattacactctggtttagggtaaattctataatattaataacggatgggatatcttttaagagtgaaataatttatattgaggaggattacataatagtaaataagtactagaatataatatagatgggaaaatatatgcttctatagcttaacctggttagagcaataaactgaagctttattggtaaaagttcaaatctttttagaagcatgattcgtaaagaataaataaaagaaaaagaagttacgaaatagtaatgtaaattataaatataaaataaatgcaattagtattagcagcaaaatacataggagcagcaatagctacaatcggattaacaggagcaggaataggaatcgcaatcgtattcgcagctttaattaacggtacatcaagaaacccaggattaagaaatacattattcccatttgcaatcttaggatttgcattatcagaggcaacaggattattctgtttaatgatttcattcttattattatacggagtataataaataaatttttaataatattatttttaatagatttaatagaaaattactttctatatataaattcaaataaaaaatttatatatatatattgattttaattaaatgaaattaaataataatttaattcgaaagaataaagattaaatcttgtaaatggtattatataggtcaattgggattatatataagaaatatatatatatatatatatatattctatagattataatttaaatataataaaaccaagtcaatgaagcatagtttaataaaataccacaatctaaggttatattataattttgggttaatgtataacagtggcgaaattggtaaacgcggttagtttaggtctaatttaaatgtgggttcaagtcctgtctgttataagagaagatttccaatgttggtaattggtattgagctgtaaactcaacgattaagttcttcgtgtgttcaattcacactcttctcatt

SEQ ID NO: 86 - DNA, 1179 bp, Pichia pastoris
gtctctcaaccttcaactatttccttgcaaactggagaagcgaatgccctgaaatggtcatcgttctttggagcagctttggttccactggttaacgtgtttttcgtttaaatgctcctttttatttttcattttcatttaactttatttacttctaaacgtttttcttttttattgtgtgcttttgaaatctattgaaggcttcatattgattttcaatccatcgtaggacttttgacaacttggaatagaattgtttaaaccgattgatcacccctgttagaatcacgaaactttacgaaaactttgctgccatcgcgaacgatcccttttgcacacctttttttcgaaactttccgcgcttaataagagagagacacaaatttgcccccttgtgcgtcgaacatgtttgttcggaccatcttagacatgccgtgcatggttatacgtcgcatcagggtatgtgatttcattgaacttcgtcaacgtcaatttattgctggtaaacattgacttgcacatgaaatgatacagtcacactcaacaatgggtattacaaaaaaaaaatatgatgcgaagcacgaaataaagcttagaatcgttggcgcggggtacataaacattattctttcttgccagtttgccagtagtttgtatctaaagggcacaacatgaaggtggcatattgaggagtatctgagactgtgtttctgaacttgttcataattttggagcagacactgtatcaaagtgaaggctatttaaattgtcgaagtgatcatcctatcgaccctaccctttgttgagtaacttcaacactggcttatcttatctgcactgttacgtttagagtcattaatcgatgaacccagcgatgttccacacagagacggttagatgaaggaatttgataatcgtagagcaaaagtctgttgattccagatgttctcaatactcaactactgatagaaatggaaattttgctgaaatacggcgaaagcaggccataacttctgtcgtttgtactgaaaccatatcgaaaaatacacaaaaaccactcgaacctgctaaccgggaacgtgcatcccaaatcctgagctcgaaagagcttggaaagaaggtcactgtacttttcaaggatttgttagcttcgctcgctcacttgtattccaagaggtt

SEQ ID NO: 87 - DNA, 1003 bp, Pichia pastoris
aatctaacaccataaagtacgaactaaaagcaacgatgtaacatttgtatataatttatataaatataaattatatattctaataatggtaagatttatcggggattatcgaattaaaaaacacaatccactgcctttatctgtaaccgtctattgtcttggatttcatccttgcgaatatactcaccaggcggaatacttacgttttcacttactacaaattttatttatagaagtattcatcgtttactgcataaactaatcgggtatcgaatccgttttgctacttatgccttcatccctcaacgtcagttttatttttgattaatgttttcacctttaacagtctaattattatcataattatttcatctttactataattattctttaatcatacttaaaactctaatatatttttatttatttcctcctcactttttaactttaagttaaaatctcagtttattaggaaattatatatcgttctacggatcctttaagccttaatgattaacgttagccttcatagtgtaaccgcaactgctggcactatttttggttaagactattattatagattatcattattttttctataatttagattttatttttaatcaattttatctttattcaaattcccttcaaggtaaaaacatagtccctccttgaaagatgtatattgataattcatctttctaagtaactagatcaatctttcgatcattgtctaatattccttactgctgtttctattgaaattgatccatttcagaatcaacgtgatcattataactttcattattgactatggatctttggctaggttggtccttatccaaactactacctaatccattattgacttgactattaacgaatttttattctttttatcttttctcctagatgaacatagttcaatctacgatatttataagatatttataaagtatttaactttattaatagttcatatttcaatctcttactcacgttt

SEQ ID NO: 88 - DNA, 1005 bp, Pichia pastoris
atatataatttcctaataaactgagattttaacttaaagttaaaaagtgaggaggaaataaataaaaatatattagagttttaagtatgattaaagaataattatagtaaagatgaaataattatgataataattagactgttaaaggtgaaaacattaatcaaaaataaaactgacgttgagggatgaaggcataagtagcaaaacggattcgatacccgattagtttatgcagtaaacgatgaatacttctataaataaaatttgtagtaagtgaaaacgtaagtattccgcctggtgagtatattcgcaaggatgaaatccaagacaatagacggttacagataaaggcagtggattgtgttttttaattcgataatccccgataaatcttaccattattagaatatataatttatatttatataaattatatacaaatgttacatcgttgcttttagttcgtactttatggtgttagattaagttcgctaacgaacaaaactccacatttattaaaattctaactagagttatactttagggaattataaaataaatggttttttcttgtaaataagaatataaatggaattaaagcaaatcctgatgactttaatataatgggctaaagacgcaatacaaaattttatacaaagttatataaaaattatatttagatataattttaataattaattaaaataaaatatccattgaattatatttaattcataaataaatttggattaatatctgaaattcgatattatgaaaaaggaattagctagtaatcagttcttcataatagaacggtgaaatttatcctctgtttcgtactaattactcatcattcgcttaaatgatatttaaacttaaaatatataaaatatattttatattaatataaaatatattattataatgtatataatatatatcttgtttaatatcaaataagtgagaagttgaaatacagttaatcgttgaggaatcagcggtggg

SEQ ID NO: 89 - DNA, 1076 bp, Pichia pastoris
gttaaatactttataaatatcttataaatatcgtagattgaactatgttcatctaggagaaaagataaaaagaataaaaattcgttaatagtcaagtcaataatggattaggtagtagtttggataaggaccaacctagccaaagatccatagtcaataatgaaagttataatgatcacgttgattctgaaatggatcaatttcaatagaaacagcagtaaggaatattagacaatgatcgaaagattgatctagttacttagaaagatgaattatcaatatacatctttcaaggagggactatgtttttccttgaagggaatttgaataaagataaaattgattaaaaataaaatctaaattatagaaaaaataatgataatctataataatagtcttaaaccaaaaatagtgccagcagttgcggttacactatgaaggctaacgttaatcattaaggcttaaaggataccgtagaacgatatataatttcctaataaactgagattttaacttaaagttaaaaagtgaggaggaaataaataaaaatatattagagttttaagtatgattaaagaataattatagtaaagatgaaataattatgataataattagactgttaaaggtgaaaacattaatcaaaaataaaactgacgttgagggatgaaggcataagtagcaaaacggattcgatacccgattagtttatgcagtaaacgatgaatacttctataaataaaatttgtagtaagtgaaaacgtaagtattccgcctggtgagtatattcgcaaggatgaaatccaagacaatagacggttacagataaaggcagtggattgtgttttttaattcgataatccccgataaatcttaccattattagaatatataatttatatttatataaattatatacaaatgttacatcgttgcttttagttcgtactttatggtgttagattaagttcgctaacgaacaaaactccacatttattaaaattctaactagagttatactttagggaattataaaataaatggttttttcttgtaaataagaatataaatggaat

SEQ ID NO: 90 - DNA, 2633 bp, Pichia pastoris
accgcaacaacgctggttggtggacgcaaatctccaccagtcaacgcccaccgagcgtaccaagcaaccgcaacaacgctggttggtggacgcaaatctccaccagtcaaccacgccccgtcgtaccccgacagaccctccttgttgagtccaacaggcggccctgtcctgctccgctcccgtggcctgccgttccattgaccacctggatctgtgaggattgtcctggacttgagattctccttggaagtcctcacgtgacacctccacttccaaaactgtcccacctggacttgcacttgcacttgcacgcacttgaaaaactataggaacttgagaccttcacctgacctcaccttgactcccccagcctctccgcccagctgcgctccgctcgccggaccatctcccgcggttggacttgccatcatcttgactccccccagcatcaccgcccagctgcgctccgcttgccggccaccctccccgcatgatctcccgcggttggacttgttgtttttttctcttgccgcagagttttctccagtttttaccatagtcgctggtgatgagaaggagagatattggtcttttttaggtgggattgaagaggtgatttggtttggcaaatattctgtcttttttcgatcacaaagtccatatgaaagttttgcaaggggtttagtagatttgtaactatttttaatacttcgagagatgagcagtgctcaccattagagaaaaaccccgtccatcgagcgtattctgaaaagtttcttataagcgtcttcacagtgatttcaagtcagaactggtacaagcgaagtacatacataaatttataaatcaccaggttgtttgcataaatataaaggcgaaatatttatgggtagtaaaagtatttgagtataattcacaattagtcaacgtgtattaatttggttattgttcaatacggagggataacattaccttacttatttacaattatttaaatagaatagtaataaactacgtttagtatactctcccataataccaaaatttaactctgatatttagatagacccagaagacaaatttataataattctaaccatttatatatgtttgttacacctacgatacctacctatggctttctttatcataccgctctcagtcaaaatgatccccatctcgtttctttggattggaagaacctacgtggataccattgtatgtacccttatcatagcaattgaccatgttgttatccaaatacaaataagatgtcagtaatagtgatgtgtttcctcaaggttaaatacagatgaaccaaggagattacactattgaatattgcggatatgacattataccactgtaattcctattccctacatacttggtcaactggtcaaagactaaataaaagttagagttgtgcttgtgtattagaccacgttctttcataaacaatccaaatggcagaagtcacaaatttagccgaccatcttcagaataaatattctacgacaccaaaatgaaactttgtttaattttcggtctttgtgattctcttgtgtatatcattgtatgattgcggcattacctttattaactcttaacctaaatgtttgagacataacaatttctgacctcaaaacacatggctttcttaaatgtaatgcaggatttctaggtatatttgttttcttcgtgcattaacacttagtcatctggtttcatacttggatatgagactaccttcagtcgtcttctatttgacagcactaatttcaaatcactaacggaaattgaaaatataggcccaaagtttaactatcaatcttttagtttttgctaatctatttctgtcaatatagcagcctgaattctttcaaagactagttaactagatattgtcgagctaaaagttaacctaataaataacttcacttcgattaaacaagtagtctgtctagctttacgtcacccttactacctatttctcatttgtatttctattgatgacattactccccccataaagataccaaaccttaatgtaaaaatttcaacttactcactctcggatcaatataaatctgtatccttcacttgaaggaaatcacttactcatctacgcttaatccacattctgattgcaaaggtctagttgctgcaaaatctttcacttacatgcgaagagcctatgtttccgatgacgtcttgactgtaggaaaagttgcatcttccaagtccaactttgaaagaaaatgtcatcctaccaaagattgcaaatcccagacctgatgttggccagaagaaagaccaagcgctgcgtactactgcattgagcgtgatatgttattctttgctccattcgtatacattttcaatccaaacatactttgagatggattgccagctagtgtcattcattttctcttagttggttagccttctgtatgctgcaatcctgttcgcgttagtagcctttcgtgcaagcaaatactatttgaagcctgcagagagttccaggttccactttgcctcgctgttggtgttgtctgtgcctcctgctctgtaagagtttgcacagccatgcaaaagaaaagtaactttagagttgaagatgacagagtgtt

SEQ ID NO: 91 - DNA, 2230 bp, Pichia pastoris
accacctggatctgtgaggattgtcctggacttgagattctccttagaagtcctcacgtgacacctccacttccaaaaaactgtcccacctggacttgcacttgcacttgcacgcacttgaaaaactataggaacttgagaccttcacctgacctcaccttgactccctcagcatcaccccccagctgcgctccgctcgccggaccatctcccgccggatagtctcccgcggttggacttgccatcatcttgactccccccagctgcgctccgctcgccggatgatctcccgccggatagtctcccgcggttggacttgttgtttttttctcttgccgcagagttttctccagtttttaccatagtcgctggtgatgagaaggagagatattggtcttttttaggtgggattgaagaggtgatttggtttggcaaatgttctgttgtttttcgatcacaaagtccatctgaaagttttataaggggtttagtagatttgtaactattttcaatatttcgagagatgagcagtgctcaccatttgagaaaaaccccaagtccatcgagcgtgttctgaaaaatttcttgtaaacgtctttccattgatttcaaattatgaactggtacaagcaaagtacatacataaatttataaatcactaggttgtttgcataactataagcgtgaaatatctatcgatagtgaaagtatttgagtataattcacaattagtcaacgtgtattaatttggttattgttcaataaggaggggtaacattacctaacttatttacaattactgaaatagaatagtaataaactacatttagtatactctcccataataccaaaatttaactctgatatgagatagacccagaggacaaatttataataattgtaaccgtttatatacgtttgttacacctacgatacttacctatggctttctttatcataccgctctcagtcaaaatgatcctcatctcgtttctttggattggaagaacctgcgtggataccattgtatgtacctttatcataccaattgaccatgttgttatccaaatacaaatatgatgacagtaatagtaatgtgtttcctcaaggttatatacaggtgaactaaggagattacaccattggatattgcggatatgatattatactactgtaattcctattccctacgtacttggtcaaagactaaataaaagttagagttgtgcttgcctattagaccacgttctttcataaacaatccaaatggcagaagttacatatttagccgaccatcttcagaatagaatattctacgacaccaaaatgaaactttgattaattttcggtcgtttgtgactctcttgtgtatatcattgtatgattgcggcattgcctttattaactcttaatctaaatgtttgaggcataacaattatgtttctgacctcaaaacacatggctttcttaaatgcaatgaaggatttctaggtatatttgttttcttcgtgcattaacacttagtcatctggtttcatacttggatatgaggctaccttcagtcgtattctatttgacagcactagtttcaaattaccaatggaaattgaaaatataggcccaaagtttaactactactcttttcccatttgtatttctattgataaaattcttcggcgccacccataaagataccaaaccttaatttgaaaattacaactaattcactcccggatccatataaatctgtatccttcacttgaaggaaaaacacttactcatctacactcaatacacattctgattgcaaaggtctagttgctgcaaaatctttcacttacatgcgaagagcctatgtttccgatgacgtcttgactgtaggaaaagttgcatcttccaagtccaactcgaaagaaaatgtcatcctaccaaagattgcaaatcccagacctgatgttggccagaagaaagaccaagcgctgcgtactactgcattgagcgtgatatgttattctttgctccattcgtatacattttcaatccaaacatactttgagatggattgccagctagtgtcattcattttctcttagttggttagccttctgtatgctgcaatcctgttcgcgttagtagcctttcgtgcaagcaaatctatttgaagcctgcagagagttccaggttccactttgcctgcctgttggtgttgtctgtgcctcctgctctgtaa

SEQ ID NO: 92 - DNA, 1200 bp, Pichia pastoris
taggatgatagaaactttagaagaagctgcgtcttatacagatgtagatagggattatactggttatatgtattttagaatatttaccaatggtatatccgtagcatctactagatctataagtgtttatttagacaaaatagacttatcaatagatagactttttgatgctttcgaggttgttattgaacaaatttctgctgttaagaatgggtatgaaaatgtattttcaactgagaataaaagtaatgtagtattttattttacagctttatattttccttctccaaagtctattttgaaatggggagataattttcctcctattatcaaaagagattcttttgatatatttactgcaaatgatattaatgtagactgtgtcacacaatgttctaatttcttgtctgagggtttacaatgtaagaatataaaagaaatatgcaactattttaatgatcaagtatgtattctcactttagtagatcatttaaaagacataagggacatatcaggttacactgatctcaggatacttagagaaagtcctattcagtctatatcagtacttaatccagagattaaatatcttcttaaatataatggccatttaggggttatttttaatttaaagagacaaaagaatataggttttacttcttatgaccctttatctgttcatggtagagttgaaagaattacagtgtgctttgatatagagacatactttgatcctcaagaagagaaagatcagactcatatcccatatctgtgctgtttctgttttacatataatgatgtagttggagatatattagaatttgaagggagagattgtgttgcacaaatgatagagtatatatctaaatcatgtaagaagctaagagttaaagaaatagaacttgtagctcataatggtggagcttatgactttcattacatattaagcagtatgcataatccttctattataaataacattcttataagaaataattcatttattagtttcactttcattcatgaaaatgtaacttttaatgtaaaggactcatacagtttcttattgtgtagtttatctaatgcagcaaaagcttttgatgttagtgtgggtaagactgatgagttttccactatcatgagttaaacaaaggaaaatctattaagagtttcaaaaatggctaaagtgtagataatata

SEQ ID NO: 93 - DNA, 7933 bp, Pichia pastoris
atcagactcatatcccatatctgtgctgtttctgttttacatataatgatgtagttggagatatattagaatttgaagggagagattgtgttgcacaaatgatagagtatatatctaaatcatgtaagaagctaagagttaaagaaatagaacttgtagctcataatggtggagcttatgactttcattacatattaagcagtatgcataatccttctattataaataacattcttataagaaataattcatttattagtttcactttcattcatgaaaatgtaacttttaatgtaaaggactcatacagtttcttattgtgtagtttatctaatgcagcaaaagcttttgatgttagtgtgggtaagactgattttccacatcatgaggttaaacaaaagaaagacttacttaaagtgtttcaaaaatggctaagtgtagataatattatagatagtacaatagagaaagagaaaatgattatagatgttagacatgtaataaattatcagaaggacggggattctagaaaacttattgattgggctaaagattattgttgtaatgatgtaattgttcttgctaatgtatggttaaagtttaaagatgcggtgtttaatattttcggagctaagattgtagatcaaacttatactctagctgctatgagctttagattatttcaagctcatgtaagtcctgacataagattgtatcatccagttaaagaggattatttaaatatgagatcctctttagttggaggcagatgtataagtcttaacggaactcatgatgatataacttgtttagatgttaaatcactatatcctgctgctatggccttttatgatcatccatatggaaagtataaaagagtcagagatcataaacatataggtatctattatgttcaagttattataaataaaaatatatctaatggattctttcctataaagtatgataaaactgttaattattctgctaattatggtttcacttatagtagctggtatactagtgtggacattgatataggtttagaggaaggtcactcttttacttacataccttttgatgaacaaggtcatgttggatacgcttgggaaagtaagggcaagatatttaaagattacgttgaaaacacattatataagttaaaattaaaatatgagatagaaaataataaggttaagagacaggttatcaagattattatgaatagtttatggggtaagtttgcacagaaatgggtagatgataaatatcaaatcaaaaatccagaagatgttaatttagatttagaggaagcgtataaaatatgggatactgattatatgcttataaagtctagtactaataaacaaactggaacaaaacccattcaaaatggtgtctttgtcctaagttatgctagaaaacacatgaagttattatgggatgcagcatcttatcctgattctaagtgtatctacagtgatacagatagtatgtgtgttaataaatttaattttgatgctgaattacctagtggtatgaaagtggtaggaagtgaattgggacaattggaaatagaacatacatttttcaacatgatatgtgttggtaagaagcaatatattggttcttattatcaggatggagagattaaatataagaaaagatttaaaggggttcctatccagtatataactccagaactttacatacatttattaaacgataaaactgcacagattaagtttcttaaattcagaagggaatggggatcagtaaaaggttacatagaaagtaagaatgtgaaagctacttaatatatattaaagatgaaggtttacagggttgacaatgattttataattgatacaaatgccgatttagaatatatagactctgaagttgtgcatatagaaaatgaaccatatttaataattaaaaataataaatttacagttgtaggtgggaaatttcatgccgtttttaataaacattctataggagaggtacttaataatatgattgatttttaccaagaatttaacttacattcatctcttgaaataaaccataaagatatatgtttctagttataattataagaataaaaaataatctgaaattgtttgactttttatatagtctaaatccaagatatatagatgtagaaaacgaacaagaaggaagaaattacttggttaataatgatttaacagcgtgtttaagtgaatatattgttattaaagataataaattttatgtaagaagtttaaatttaagctatgaatattacgctattttaccaaaagaagaattagtacaagatatttctaattattttataaatgacactagattattagaagagataaatgattatcaaaacttgagtatagatcctaatataggacaggtatattatttttgtctggatgatgtaaaattggatactaaaaatatagagttaaatgttataaaaattaaagaagaaaatgaaatcaaagaaattatgctatatagaaataaaaatattttatattttgttcaaaagaaaaacagaatttatttaaaatctttaagatatagttttgatatagaaaaagaaataaaagatttagaaaatacttattctagaatagaacaaattgggtttgaaaattcattagaattcgaatcattctttgaattgagctgtaagtaaaatttatttatatgaataatattttatatacaaaatgtttttatttggaacgttattgttgtacttaggtatagtgcaagctgtttacttttccaatactactagcaggttacctgatagtagaggaataagtgttatgtctacttctgctggatgttctggtgctgatgaagttgctagaaatttagtttatgcttggtgggatggtcctaaaactgatcaaaataaaagagaggttttagaaggtatagagtattatagaagtgctattctaggtaacactggtatcacctctcgtaaatggacaaatggtagagttcatgcttttatatggattggaagtatggttcaaactagaggtatagctgaaaatattcttcctttgattaaagaagatgttgaaaatagtggtgctcctaatttagtatacttagagtatgttgatcctgatggagatccaatgaaaggttttggtattgcttttgaaactaccggaggcggtgaaggttctatgcaaagagctgtaagagagtggagtaaaggtaaatcttataatactagaactggaagtaaaactatgagtcaaaaatctatgtgttatctgtcttatgccaatagaagaagaattgataacaatgaacaagctggaaactgtgattatgttagaatggaatctggtatggatttgactgctagaacaggtgttaatggtgaatccttagaaggttacaacagaaatctagattttaccaaattacaagctggacaacctgtttgttactctattggtaaaagaccagattttagaccttctcaaaatgctgatggatcttgtaaagcttatcaagtaaaacaagacgaatcatgtgcttctatcgcagcacaatactttcctttgtctgtaaacgagatagagtctttcaattcagagaatcatcaatggaaagggtgtgacaaacttcaaaaagactataaattatgtctttctagtggtactcctcccagacctactcctaatccattagctgaatgtggtccttatgctccaggagatctttataaccaaccatgcccattaaacgcatgttgtagtgagtgggggttttgtggtttgactgaagaattctgtgaagcgaatatttgtgattctaactgtggatatggaagtttgccttctataaaagcttctagttttaggaaagttgcttattggttagatactaatggtccaatgcattctgacccacagaatataaaagacttcgatattgttcattattcttttgctgatataaatgaagatatgagtatatctgttggaaataatttcaacgtttttaaagaaataacacttaaaaagattattgcatttggaggatgggaattctctacaaacccaagtacttatcaaaggttcagagatgcagtttctgatggaaagagagatatatttgctcaaaacatagttaactttatgaatgagcataatctagatggagttgattttgattgggaatatcctgaagcacctgatattccaaatatacctgctggaacaaaaggagatggtttaagatatgctaaacttatggaaagagttaaagaattagatagttcaaaaactgtatctgtagctattccagcttcttactggtatctcaaaggtttcccattaaaagagatggataaacatgtagattattttgtattaatgaactatgattatgtaggacaatgggattatggtaaacctaacactggtattggttgtcacagtgatagatcaacaactgaaagagctattaaaatgattgtaaaatctggtatagatactactaaagtccatgggggtctagctaattatgggagagcatttagattgaatgataagaactgtaaatcatattggtgtggtttccaaggtccatcttctcctttacctcctggacctatcacaggtacccctggtttcttagctttatcagaaatagaacaactttcttttaatgagaaaacttttgattctgattctaaatgttacattggaacttataatgatggacaagattgggttgcatggatggaccaagatactataaaagatactgaaaattggtatcaaaatactctaggatttggtggatcggctttatggttatacaattattatgaagaaaatagtgaagaatatggatcacttacttgtgaactaagtgcaaatgacaatgatgattatgatgctgcttgttacgagttagatgataatacaggtataagaccttttaatgtccctgttccaaaaataaacataagaaatatattaagcataatatcaagaacaaaaccagacaatgataataaaatttatttatcaatactcacctttttaagtgcttggaaagacataaattctgatccttccacttatgacaaagtgaaaaatgattttaacatgatagccaatataataggaattttgagttataatttagatataaatgaaggatcaagtgcttcagagataagaaaaagagaggattattattctgttataagtataataataggttctacatatacaagcagatatttccaacctggttttcattggggaaatacaaaaagtaatgatagagattatataaaaagcgtgaattcaaaaccaagtatgaatatgtatatagaaggtatatcacagactttgctatatactgaacaaacaataatagatgattggatattttatgaattttttgattatcaaaatgatataccatttgctcaatcttcagctcctttcattcctgcttgtaatgaaagagagtatagagctggggaaacagccgtatataacgaagaaaatgtcagaaggattctacaatatcaagctgaagaagctggatatgatgatatatgtgaatttattgaaaaagcagactgtttgaagcctgtttacatagtaaacataaatggacaatcacctggagtagcatgtaatgctttaagatatgtaacaagagtcgcagatcatggaagattaccatataatgaattaaataaactaaatagaaatagtatagaaaatcataaaatcaagagacgtagaattgtaaatgcgtacaaaacatctgatattccatccaataataaccttaattacaatataggaaagccatgggaaagagatgaatttcctccagcttcaacaactaattttgaggtatattcaggtttgtattttaattctgtagcatttgttgaaatctctgacaactggatagacggacaaaatttaaatagatttttccagagaaaatctccgggtgtaagtaatactctagcttctaggcaatacatacaaaatgattggactgaatggttcccaaattgtaatgatgaagagctaaataatatgttaggatgtaatattccatacatatgtaaaaagaaaacatgtagtattgccacagaggggcaagatttctatttccttataaatatacgagactgggaagattgtataaaatatttaagaaaagctgattttgcctcaagtaccagttttaaatacaatttatttgatatattagataaaccttaaatttaaattataaacacattttgtttaaatagaattatacaaagaaaatattttatttgaatattttatattgtattacaaaaatgaactatatatatttaataaataaagacatatttccagaagcggaattagaagagtattattataaagtatcttttattaaggtaaaaaatgaagaagatataaaactaagccttataaacttagaaccatatgaaggaacttatgattactactttattataagaaacgaaaaagaagtagttctaaaatgtagatcaaagagcttctacagagaaaagaatataggaaatatagaaaatataaaagaatatataaaaaagtgtgaaaatggaagtataaaagaagaagttttagaattagtaaacaaaccgaaacattatcaagaaaatgataaaataagaatatataaccaagaagaaagagagaaaatgatgtatgaatatgttgaatacatagatacagaagacattgaaaatgtatatttaaaggaattagaccaagatatacaattttatttgactgcatataatatagaatcagttgttttgagaactaaatgcaaaagtaaacattggatcataagaattgaatggtctgataaaatgattaaagaattgtacgagaacaaagaattcaacttaaaaatatgtgaaaagttcagagtaaatagaaaaagaagatgtatttaatgttcttgattaatgtcaacataccgaatatggaattcttttattgtcctgaaacaaatactaatagttattatagattatcttttattaaggtaaaaaatgaagaagatataaaactccatttatgtaatataaacacagttatgaacccatattattttgtattaagaaatggaaaagaagtagttctaaaaacaaagaatatggctttctgtagagagtatgcgttaggggaatatgaatctatggaagaatatatagataatgttgaaatgggtaatactagtccagaagaagcaacatatcctaaaaatccacctattgaatatcaaaatgagagaagactaagaatttataatcaatcagaagaaaagaaaatagacttatactttttatcatattttaaagctaaaaataaaaagaagcatacatgaaagaattaaaccaagaccatttcaatgatggtacttttgtatatatagaagatgataaaagctatataatgtgtgtgaataaaacagtagattgggaaatagaagtgaaattatcaagaaatcttctaattataatgtttgaaaaatatgatttcgaagaaaaactttataaagaatttagaccataattaagttagaagaatgtttttggatttttgtgatttgaaatataaaataatttttgtttttattgcaatgagggggtgagttgagaaagtcatcaacttttatgcgaaagtcgagccttctattctccacttttcatgatctaaatggaataaaaaacagctcattgttttggttctaaattatgatgagttctccatggagaatttgttaaaaaaaattgaactattggaatatgttcccagcaatctaaaaacacccttttaattgggtggggtatgtgtaaaaatatttt

SEQ ID NO: 94 - DNA, 7612 bp, Pichia pastoris
acatatgtttcacagtttgtatctcctggacagcaaatgttctcacactggcactcttctctttttctgaacgagaatgctgttagaaatggtccacagcaaacagcttcacaattgataatctccggagtctcaataatgacggtacctggctcagtgccggtgggtgggacagtgtaagtggtctcgtaagtaccggtccatggctgggtggtagtcacgtaactctccggagtctcaataatgacggtgcctggctcagtgccggtgggtgggacggtataagtggtctcgtaagtaccagtccatggctgggtggtagtcacgtaactctctggagtctcaataatgactgtgcctggctcagtgccggtgggtggaacagtgtaagttgtctcataagtaccggtccatggctgggtggtggtaacgtatgtttgacaactctgatcccatgaacaacaaaaattttcacactgacacagttctctttttttgatggccactgatgcacaacaataagcctcgcaatcgacaatctctggagtctcgatcacaacagtacctggctcggttccacttggcgggacggtataagtggtctcgtaagtaccagtccatggctgggtggtagtcacgtaactctctggagtctcaataatgacggtgcctggctcagtgccggtgggtgggacagtgtaagtggtctcgtaagtaccagtccatggctgggtggtagtcacgtaactctctggagtctcaataatgacggtgcctggctcagtgccggtgggtgggacggtataagtggtctcgtaagtaccggtccatggttgggttgtggttacatatgtttcacagtttgtatctcctggacagcaaatgttctcacactggcactcttctctttttctgaacgagaatgctgttagaaatggtccacagcaaacagcttcacaatcgataatctccggagtctcaataatgacggtgcctggctcagtgccggtgggtgggacagtgtaagtggtctcgtaagtacccgtccatggttgggtggtagtcacgtaactctctggagtctcgatcacaactgttccttctgttcctgttggagtgattgttcttgttgtttcgaatgttccagtccatggcgtagtatacgttgtccattctgtaatttttgaaacagttgtttcgtaacaggagttttcatctagcgctccaaattggtagatgtaatcttgaaagtcatccaatactgttccgcttggaattgtaagcttgaaattgaaaagcgctcgttccaaagcatttacaaagacgattcttacaggatagtactttccagcctctaagtactgcgtggatgaaatcacctcagagtttacctgattggatggtttgatagtaaacagcgaatagtctgttggtgcttgatccacgggaattgagcctgtatcacaacattgaaaggcagtatttttcccaaagaaaagcatcgaactatcatcaatgttgctcaatgttagtttgtagtctcctgaaacagcagctttgaaatagccttttaattcaaggaccatgttataatagtttacgttctggaccccatataccgttgcagtcctagaacgtggattccagatgttaaacccaggaacagtaaccccagatattttattcagtacgttgcgtcccaggtacccagtactcataaaaactgggtcgcgtataagtttcaaatcatttgcattgtactcatagatggtagcatcaaatccgtcaaaagcattgctagtgatatcgcatccataagcagtatcactttcatcaccatttccactctcatctccttgtgttgcaataataaagaacagctgcagtagaaacaaaagtggcacaggaaatttcatcttctgaagacaagcacaatgtcaaaagttactaaaacagaaaagtctaggaatgggcgagatataagtatacgggattataacgccgaaatgtgacgcaaactttgcatggctaggtgatttaaaacggcaacatatggtaaaagatttcggacaaatgttcgtactagaacaggattgcaatcttaaatatcttaagtatcatcgttttgggtttcgaatcatcacccaactgcatctattcgatttcacttgcactgggcagtggcaaatatatcgatggctcctaacattgatgtttccagtatatcatcaatgctgatcgtgttcatttcgtctctcgttttccctttttttttcttccttatgtgatcacctgcagatgcaggtatgattctcttgccagttgccgaaaagacaaaaatacttggcaatttttggaactacagacaaacaaaaaaaagtcgcaactgtcatccgagagtgctcgtatttgcttttccgcttttttattgtgcaatgctttatcgatatgttgaatgggctaagttttcaaaatcggcccgcaattataggtgataatttagttggtttgcatatgtatgtccacaaaaatacgcatcgattaagttagaaaccatacgaagaaacttgctgtacctttgtcagtcaagtccgaaaagaaaaaagaaagcatgcatttcactatcgggtgtcactcgtcgcattctaccttagcaggtggccctagcttattcaaagctgataacctctgtgggttaaacaaacttgccgaatttggaaaatacaacacagtggtagaaacagaaactatgaattattttatcaggcttgacaagttttatttacttttagcacaaattaaggcagctatgagaataactctgaagaaaaattattatgctcgtcttgttgcttttctttccatattagtctttctatactgaacgtacattcatttcaggtgaaaaaagaaacaaaactaaacgcctccttctatagacgcacaggattaagcgataggcagacatgaatgctgcttatgaatgctactgatagtagagtgaagataattttttgagaaaatcgatccttccgaggtcactccatggcaacgatgttctaaataggctttgctctcgccagatttgtctgcatgcataagtagtatcactctccgtgaagcaatgtcatgtatgaaaaagcgggacaaggatcaatttttcgcgcaaagaatttatgcaccctctcgctagaaactactaaaagaaccaacattgtgggcccacaagattgctgttagtatatcctttgcctcagcatatcaaagagtgagtattttgtcagcttagattcagagtgtccaatttcacccaacaaaatgcatgaataggaagtttacttatcatccagttttgtttgacatgttggaatcagaatttttgcatgtgcgcttgcaagcgtgtaaggcacagatgatgttcgagtcttggccagaccgccgaaatagatggttatagagaattgaaccattcttattgatctccactatcctggttttattatatactatctattagcctttactaatacattgattagtggctctgatttttgtgtgtatgaacagtattagttcaaatctaaatagaggcatccttcatttcaaaaaaatcagaatgggcgacttcgacattcattttccggatgtatcactagttccattttcctattgtctttttaggtgacaagtttgaaagatgcaaagcagagatgtaatttgttgccgtcgttaaccgtctttaacttgcttatcctacacagtcagacccatgcaaacctctaagctactggatagtgtttacccgtaatatttgggcaaccgtatcagcgatactcctgtctactgatattaatccaaggtgtcctagggctaaggtttctttgttattatattcgggtgctttcagtccttcaagttggagaacattatctgggtcacccaaaaggacttttcccttcagttctgtgaagttttcattgatcacattcagtactctttgtccactaaactttcctgcaatagtaagcaatctcttttgttcaagtgtgggatttgtgaggggtagaacgtggtatacagcaagatctctaacatcaacagccaatgatatgggtgcgtcgtgcaaatcttgaagagtagagcctgagctcaataaactcaaaattatctctgccgatccagaaaggacattttctttagccttccaatcaaatctttgaggtccaaacacaaacggaggaacaatggtagtcagtttaaagaaaggcttctcgttttccaaaaaatcccatgcagctttttcagctttctttttggcgacggagtacgccaagtacctattgtcatcgttaatatcttcccattcgtaactattccaagtcgattcgtcaatgacaagtgacttgtcctccactttatctaaattccagcaagcagataaagatgatgtgtaaatcacatttttcactgaatcattggcatatcttttgattgcacgaagcaaattcagagttccttccaccgtgggaaggagcatcgtctcctctaaagaaccctcaccaactggcggggtaggacaagcagtgtgtattgcatacgtcacatcagagttacttctgaacacatcgtcaaatgatccactagcactgatatcgggtatgacaacgtagagcaattgtccatccaaagtcgaaggaaacgcccgtgcaaaatccttaagcatttgatccccttccttgtgcgttctcactgttccaatgactgcataaccccgagacagtaactccccagttatatgaagtcctataaacccagtagctcccgtaactaatactttagggagcattacggacagaaattaaactgtacgtgtcccagttaaaatagtttagcaaaaacttaggctcgaaccaccctaacacgcgatacgcacatcactttgttcactactccacaactgagaggcacaccctgctggaagtgaaacgttgtagaggtagtagttcgctcgacttacaacactagccaacagccaagtatgttaacgtagaaacgcatgctttgttcaccagcttgcgtcttatgtatccattccctatgatgttcaaatattacgaagaagtaccgagataacttctgccaccaacttctggaggtactcgcaaggttgatcaaagaatcgacaactaaaataaacagatagatgtaggatggaccctgattcttaacaaaaaaaaaaaaaaaacttcgttcaatcgatcgcataattgcatgcgtagactttattgagcttgttgcttgtttaaagaccttttgaacgcagatatcgctacagagacgtgattcacaagtttaccatcgtgaagttcacttgatccagaaatgaaccgagcaaattgttaagatatgggcgcgaatgtagcatatcgcacctgtaagtaacagtgctgacaaacgcaaagtgcgtcgaacagcctattaagaatcagttttttggcaaacaataaaaaataagtaaaggctagttaatgtaaatagctagaagagaaaaaaaggaaataagcgcttaaatgaagagcacattcagcattggaagcaatgcagttcccaagaaagctgacaatctcagggtattagctcctccggtttgcaaagaaatagatgaaggagcttggagggcgctagcagatgtagccgaagtactctgagcgtcaaactcggatacatgaacgctgctttcagttacgtcctcactgtggcgtgacgattgagaagtttgaactgttacagttggtgctcgggaagactgggtggacttcaatctggtttcgagagtactagcttcgactgacagttgaggagtatccaatggaaccacagttgttgagtcagaaacagtggtagtttgcaaaaccttgcccgacacaatagtagcctgactgcaagagtaagcatcacattgttctcttgtaattgtaacagctgaaggatgggcatctggtgcaaattggctgggcactgctgaatgtgctgtctgcactacttcactgcgatctatggtagttgttgtcaaagagacagtttgagttggcaacggactgttaggtgtgatgaccgtggttttgacacaatcctttgtatcacaaatagacgtggtaacagcaacagttgagatgctagtgtccgtcgaagttgtttcaatcgctgtaggattgatgacagagtgaggtgcatcagtacttgaagttatgatcccaatggtgctgctatgagaataaatggtagagttggtgaatcttgaccacgatgtctcatgagcactgcttgtagctgattcaatcccctcgtgcgcaaagttgtaaacgtacccttgatattgatccaggacccttccatctggtagtgtgatttggaaatccaactgagcacgctccgacactgctgcaaggacgattcgcaaggggtagtaaaggcctgcagaaagatattgtgtcgtgctaacggtctggccggcatccttaccatggtcgaaaaacaagacgtattcagaacttgtttccggtttcaaaaactgaacttcacgcttcgctaaagatgaatccgtagcaggactgcccaaaaacaaaatcgcattgtaatcgatgttgctgaacgacagttcatagtttccatttgccggagcttggaagaatccaacatactctatggttgcattcacgtacgatcctgtgtttcccaaagcattgctctcaatgtaataaggccaccctgaacttgtgtcgaagttaatattaccaacactagtggctgttgtcacttgtcccagaccttcatagcctgaggtcaggaaaccaaggttgttcgcaagttcataattgtctgcagggtaatggtaaactgcaacattaaacgcgtcatatgggatagtgtcaatatcgacaccagatgttggaagcggcgttggaataacatcactgcttatactggtccctgaaggaatcacttcaatcactgtccctgctgcatcggttgtccatgtggtataggtgccagtccataccgaagttgtgtcggctgacggagttggaatctgttcaataacggatccgtctgcgtcagtggtccaggtggtataagtaccagtccagattgaggtagtatctgccgatggagccaaagtggtgtcagctgacggagttgggatctgctcgataacagatccgtctgcatcagtggtccaggtggtataagtgccagtccataccgaagttgtatcagctgatggggttggaatttgctcgataacagatccgtctgcatcagtggtccaggtggtataagtaccggtccatatcgaagtggtgtcagctgacggagttgggatctgctcgataacagatccgtctgcgtcagtggtccaggtggtataagtaccagtccagattgaggtagtatctgccgatggagccaaagtggtgtcagttgacggggttggaatctgttcgataacagatccgtctgcatcagtggtccaggtggtataagtgccagtccatactgaagttgtatcagctgacggggttggaatctgttcaatcacggatccgtctgc

SEQ ID NO: 95 - DNA, 7916 bp, Pichia pastoris
cgacgccgatggtaacttcgctcatttatctcgccaatattgattgcacaataggagctctcaccatattctagatttttggttcatacgcctatagcgggagacaggcagtacgttccttaatagctttagttgttggacttgcagtgtggaataaacgggaccaagaaaatcctaacaattcaaattgagtacgtacacgtttggccatcgctgaatgatacgcaaactggcatcagcaacactttaatcacagttttggtacatgttgcttgagacactacagatggtggaccatatggggtgatcgatgtttctatttccgaagaagacgtattgagatctttccgatatgtcgaatttactgatacagcagattatttgaagatgccagctagaactgcttgcaaatttccaatttttgaaaatttgtgaaaatgatttaagctaatgcttcttatagtagtcatagaatagatgccagagaggccatagaattctagaactatggatcttgctcgctaacctttaagggtcaatgggttataaaattctccagaaatgtacaataaaaagaggggcaacattgagtaggtatttagtttatgcagtcaaacaggagctaatttctcatccagccgatcactatatttcaatagcggctattagcttggggttagccagtggtaatttttttttagtgtttaagagaaggatctcagtagtgactttcaatcagaacttcattcagggaccgtagcaattggtagcttgtgaccaagtatgagcctcactggcttgatagtgttttctttctttctacaggctaaacagttgctcactacaaatgcaagcttcatggtattctatctatgtcctccttatttcacgttgagaatgaatgcagtatagtatcagtgaagagattttcgtgtatctctctatctgtctatgcgaatgagaaaatctctctttgtatccatttgtattcaaatttaaaccaactatggttggtgacttaaatctgaagaagtcttggaatccaaagcttctgaagaaccaagaaaaggtttggaaaagagagcagcacgcacttgaagaacaccaaaaaatccaacagcgcttggaggagataggcaaagagaaagaaaaaagtgcaagtttaagctggcggcatccaggtcaaccagagaagttttctcaagtagagatgcgcattgattggatgtacaacgaacaaaactataagacggatgattacagtcgcaatggagttaacaaaaatgtcgtgaagcagaatgcaaaagaacatgaagaatttctgttgggaaaacgaagaaagggtaaaggagtgcaaaaatcacaaaataccaagagacagtttatacccaagcaagatggtgaaactaaaatttaccctgaggttaatgcctctgaaagcgttgtgaataaaacaatcggcggcaacgatccattgcttgaatttcaaaaagctacaaaggagagagagagacaaacaaagaaacagatcacacaactgtgaatcgtaaatttcccaatcttaaattcaaaaccgaagaaatctcaaagatggtatggtatgtattattcgagtggattcttatttagtgagtagtccgcagagcaaacttgaagccttgaatatgtcagaaaaagaaaaaccggaaagtacctatacaagccatcattgccagcaaagtagtagactctgtgaacacaagttacctcccacagacatagagcaaaactaaaatagagtgatccttgtaagagcatacaaattggtcctaacagaatcagaatccatgaattttgatgttcttcttttgaagagctagctgagaggtcaaaaactccatgactttcactctctgatctccttgcagctggatgacctgaccaagttcatcatcttttacaatattcccattacaagcaaaatctttcttcaaaaccttgaggatcttctttaggtcatattcttctggtaagccctgaacggtggttaatgtctttctaccatttctctgttggatacggatatgaatgtagttagtgggctgtgtatcatcatcgcctgtatcggcgaacggatcaaaagactttaggttctctattgatgccataaaaagtggacaagtatgtcgattatcagagaacaaatatagtccgaaaaagaaaaaagagaatgaagtagttgcgttgcaggaaggcaaaaaaattgttgcaaaaaacaaaataaaaaactactcgaattcgcgaaagaataattatgggatttcagggaaatagtaggcagaaggggaggacgggaagggaagggtaatgggagatgacaggtacacttgtagaagcagaccaggtgaaggtaattttgtgtgactttgacagtagattgaatgttattcgagagaaggagatgaggacatcaaaaatgtgagggagtgaggggagggagtcggaatctaaataaatgggaagaggaatcacgacttcttgtgttccgcctgacgctcaagaggattgtcaccttccaggggggttctatcggtaaaaaaaaaaaaccgcccgccaccgaaaatttcgactagataatgagccgacaagaggcagatctcaaagttagcatcaagaaggcctgttccaccgaagaagctgctccaaaaagaaaacatgttagggcgtgtattgtgtttacctgggaccatcgctctagtaaagcgttttacaacggattgcggttacttcctattcagaatgacgagataccgcttttcaaatcattgatcacgattcataaagtacttcaggagggacacccttctgcgatcaaagagggaattaagaatagagactggattcaaagtcttgggcatgtgtttcccggtgacggaatgaagaggtatggccgattgattcgtgagtacgatagatatctcattcgaaagattgatttccacaatagtcacaaaggattcaacggtacgtttgagtacgaggagtatgtatcactgaagactgtaagtgatcctaatgaaggttatgaagctattatggatttaatggtactgcaagattcgataaacgaccttcagcgacttctgtttgcttccatcgacagctctagtcattctgaattaaaaatcagtgctttagtgccccttattgctgaaagctacggaatatttaagtttattacctcaatgttaaggggaatgtgtcactctttaggtcacgacgatgaagcattgcaacctctgattgaacgtttcataagccagtattctgacttgtacgacttttatgccgaatgttcgtacgttaagtatctcaccagtttggtgaacatccccaaactgccgtttgaagctcccgatctattcaattgggacgaaactgacgagctgaaacctcgaatcctagcggaagaaccatctcttcaggtttctagtaaggcaccatctgaagaatttggtacgccaaccgaggtgattcattcacagccgactgcaggcacggatctttgggctcagtcaaatgccctaaaacagcaatacgaacaagaacagcaactcttggagcaggaacgtcagcaacagctcctcgagcaacagcatcaacagcaacagcagctagaatattgggagaaacaaaaggagcttcaagagcaacaacagttgtatgcacaacagcagctggaaagtgaccaacttcagagacaagttcaaggacgtgttggtgagctagaacgtgatttactgattttaagaggacagtttgacagagatcaattaatgctgcggcagtatgatgagagggtaaaggcccttgagacagagctttctagcactacgcagaatgcacaacaacaactgggggcgaaggaggagctattaggcaacatacaggagcaggctgcccaatggaaatccaaatatgattctttagcaaagctttactcccaattgagagaagaacacctgaatcttctttcaaaattcaaaacggcacagttaaaagcttcgtctgcccgagaagcaatcgataagagagaaaaaattgagagagatctcaaggctaagaacatagagttggcagatttaatccgtgaaagagatcgtgccaggctagatcttgaacgatcaaagagtgacaagaatagtgaaactgaaaggctagaggctcggcttcgggaacaggaaactaagctggccgacatcgagaaattacactcttcggagctcaaatctttcttgagtcagcataacaaggaaatagaggaactgcaaaatcaactgcaagcttcttctttgtcagaatctgcaaatgaacgtctcaaagcactggaagcgcagttacaagaaaaggatgacgagttagcaattgcacaccaaacaatggaggcaacaattaaagagttgacagggcaacaaagcattcaaaattctgctatagacgaacaaattgacgctattctactggagcatattgataaactaacggaagttatcgatgcgatcctaacaagtggagtgcaaagaattcaagatggtcttttcgagctggattctccaatgcaagcaggaaatcagaattcatccccggagtacttgtcttctattatcgagaaatcatcaaatttggccactgaattcacttcaagttttaatggtttcatcgcagatggccctaacggggatcatgtatcggttattcagacaataaccgagtttacaacatccattgtcgatctattacttaactgtaagggagtcgtaagattggcttcgagtgaccaggaagcggaagcacttcttaattcggcccgtgatgtagccgaagagtctgagtcttttatcgtttcattgtattcttcatcattaaaggggctcagcgaccaagaaaagacagataaggctattgagggaaatgtggacatccagcaggaattgcagaccctttcttccttagtagagaaattaatatcgtctcaagttaacatcaatgtcaacgacaatgtcggagaactagttgacagagagatggcacatgctgcagaaacaattgctaaagcctctgatcatttaacggatttattaacgaatgcgaaacaagatatttcaaccatcgatatgaagattaacaattctattctatcagctgctattgcagtgactaaagctatcattcttttaattaagactgctactgattgccagaatgaaattgtcaatcatggccgcggttcaagcagccgcacgtctttttacaagaaacacaacaagtggactgaagggcttatctctgcctccaaatcggtagcatactcaaccaactctttgatccaaattgctgatggtgttttatcttcaacaagttcaccagagcagctgatcgttgcctgtaatgacgtggctgcatctacagctcaattggttgcggcatctagagtcaaagctagtttcatgagtaagacacaagacaaattagaacttgctagcaaatcggtgacctctgcttgcaggtctttggttcgtcaagtccaggaaatactctcacaaaaagataaagaggaactagaaattgactacagtaagttatcagcgcacgaaaacaagacggtgcagatggagcaacaggttgaaattttaaagttggaaactgctctacagaatgcgcgaagacgtcttggggaaattcgacgctttggataccatgcggatgaataagcagattattaatgaagtatagaaacctatttgctcacaaaactgtgtctttcgatttactagtaatgaagttaaggacttgtcttttttatgtgtcaaatctctattgaagatctagaaaaacgtcttcgattttatttctagtgctgagtagctcattccaggatatgaaagacttcgtaactgttgatgtacgctttgaattttttggacctttggtctgtagccaatcgacaaacggaatattagaattggagctattatagagaagtgcatatgatcgccataattccttgttttcatttttccatgcgacagataatagtctcgatatgctgatttgtttgttgtagtcgttaacttgtctggaataatatgatcgaaatgcgataaatgcgtttattcgcttagacatatacgaccttgaacttttagttctcttttcgctgtattgattttcaccagtacgctttattccaagagtagtttcttgcagtaaatgtgattcaatttgttgcagacttctagtgcgaggagtttctagctgataagttaccagctctgggtgtttggtatgttgaagcatatttccattatccaaggtgctgtgggcgtattgggaacacttgaaaggtttctgaatgcctttgaaagatttgggttgcgggggtaacatattactccgattgccttttgtagaacaggttataccgttttctttttctggttgaaatgagagaagtattgtcaatttatgttttatgaaatccccgagtcccagattggctatctatcacatgcacgcacgcgtcagatgatatgtttgcatcatcttacctgaaacatagcctcaaaaataagaacacaaggagaggccacatacgtcaattttaaattcacaatagctaaccattcaataaattatttatatttacgagggtgatttgtttaatgcttgaagtagctctgtagaaacagttgaagatctttcctttcgtcttttgtttgagatccaatttctgatttgagttttgctaagagatgtcaggtgcactagctcatcaaaatcttgctgcgtcgcgtatggatgttggaagtgatccgcaaaccaattttcaagtattctaaccttttcccttggcaaccttctttttctctcagtactattactatctaatatttgttgcaggataatttccacgtcgttcttgagcattctcttattttccaacattaaagcgatcgctctgcacatcctattaatttggacaagaatttcacgtaaagtttgatcattttgatcaattccttgctccaataatgaagagagttttctttgggaggagcctatttgattacagatagatgtccaattggaatgtaacgcattatgagatatcccttgcaagattctcatcagagttttgtgcacacgcaagagtctaatgttagagctttatttgagttttgattgctattgatgtttttgattaacttactgagaaatcatagtttgcgaagaaaacaacgacacgatttaattgttggcaccacttttatacaatctttcaggtgaattagaattgtttcaagttcttgttcgcttgagacatgaaaactgataagaatcgcggttttctgtagcaaatgtaagtaaaccaggaacatcatcaatggtttagcaataagtgtcaatcaataaatagctaatttatatttatatctattactatcagaaatggaaccgactagccaagtgatagtctacatggcaatccgccatgttctcaattgttccaaagctacaaaagtcaaaattgtatgaggacccaggcgaataaaggatggaaaccatccgcgaaaaagaaagcctgggccctcttttctcatggcagtggttaacacggttataattgattgatgtttttctgccgaattcataatccgtgtcttcactacatcagcaggagaacacaccgtcgtggcaactaatcccgccattaaggatgccgaaaaatgcgtagctctcgtagtttcatcaaaggaaagcttttttactagaaacttcttagctacatcgtaagaaaccacttgagaagcagtcatcaatacacctcgagtaagatttggtaacaaccctcgaaaccaagagccaagcccttcttc

SEQ ID NO: 96 - DNA, 908941 bp, Pichia pastoris
tcagcccccaaatttctaccccgccccctcagattacccgctgaacttaagcatatcaataagcggaggaaaagaaaccaacagggattgcctcagtaacggcgagtgaagcggcaaaagtccacctttgaagtattgacgtggttgggagaggcaatgtgcacaagtcgcctggaacggccgccaaagagggtgatagccccgtagcacggtcaaccttcccagccgacagagtcgagttgtttgggaatgcagctctaaaggtggtagggtccatcaaagactaaatatcagcgagagaccgatagcaaacaagtacagtgatggaaagatgaaaagaactttgaaaagagagtgaaacagtgcgtgaaattggggggagggaaggcaaggccacgacaagtggtcctgcgcccgtcttgaaacacggaccaaggagtctaaccggggtgcgagtgtgcggacgaacatccaagcgcgaagcgaaagcgacactcacctttggtggtgagtgagccagcacccctgttgggacccgaaagatggtgaactatgcctgaatagggcgaagcctgaggaaactctggtggaggcccgcagcggttctgacgtgcaaatcgatcgtcgaatttgggtataggggcgaaagactaatcgaaccatctagtagctggttcctgccgaagtttccctcaggatagcgggggggtggttgtttagttccatgaggtaaagcaatgattagggggacggggggttgacctccgcccattctcaaactttaaatgtgtggcgaagacctgctttagtgaggcttcttcaaatactagaccccctcagtgggccatttttggtaagcagaactggcgatgcgggatgaaccgaacgcagggttaaggtgccggaagcacgctcaaagacaccacaaaaggtgttggttcatctggacagccggacggtggccatggaagtcggaatccgccaaggagtgtgtaacaactcaccggccgaatgaactagccctgaaaatggatggcgctaagcgtgctacctataccctgccggagaacagaaagctctccgagtaggcaggcgtgggggtggtgtggaagggtgcttgtgaaggtgcctggaaccgcccctagtgcagatcttggtggcagtagcaatattcaacggagccgttgaagaccgaagtggggaaaggttccacgggaagggagatcctccgtgggtgagacggtcctaagggcgcgcgtacggtagcgtccgaaagggaagacagtcaagattctgtctccgggggaatgagtggtgacacgagacggccaaagacggtggcggaaggcgtaggaggagttttcttttcttcttaagggcgttgtgcctggatggtttagccggcgaagggcagtaaaacccgaagagcgtgcccctagttggtgcgtctacgcatctccgacatcccgtgaaaatttggtttatttatgttattcccccgcccgtactgacaaccgcagcaggtctccaaggtgaacagcctctggtgatagaacaatgtagataagggaagtcggcaaattggatccgtaacctcgggacaaggattggctctgggggtcgcttttatcgaccaacccagaactggtacggacaaagggaatctgactgtctaattaaaacatagggtggtgcgagtcccaacggatgtgcacaccacctgatttctgcccagtgctctgaatgtcaaagtgaagaaattcatccaagcgcgggtaaacggcgggagtaactatgactctcttaaggtagccaaatgcctcgtcatctaattagtgacgcgcatgaatggattaacgagattcccactgtccctatctactatctagcgaaaccacagccaagggaacgggcttggcgcgtcagcggggaaagaagaccctgttgagcttgactctagtttgggccgtgggggaacatggggggtgtagtataggggggagccgtttcggcggcgcccgtgaaatacccccacccctatagttcctccactaatcgcagagaaacctccaggcggggagtttggctggggcggcacatctgttaaaccataacgcagatgtcccaaggggggctcatgaagaacagaaatcttcagccgagcaaaagggcaaatgcccccttgattttgattttcagtgtgaatacaaaccatgaaagtgtggcctatcgatcctttacaccctcagaccctgaggctagaggtgccagaaaagttaccacagggataactggcttgtggcagtcaagcgttcatagcgacattgctttttgattcttcgatgtcggctcttcctatcataccgaagcagaattcggtaagcgttggattgttcacccactaatagggaacgtgagctgggtttagaccgtcgtgagacaggttagttttaccctactgatgagccccacggcagtaattgaacttagtacgagaggaaccgttcattcggacatttggtttttggggctgcctgacaaagcagccccgacgctacgtccgtcagatcatggctgaacgcctctaagtcagaatctgtgctggggtggggaggagtgtacaagaaggatatatttcatagcagcattccacaatctcccgcccacgacttgaccccgacagggtattgtacgcagaagagtggccttgccgtcacgatctgctgagattaagccccggtcgagcgattggagtaacatccaccgaaggaaacacaccgagcgcagcgaggttgtgtttccgaagacgtaaccgtatcccaccaagcggtaccaagcggtaccaagcgagcgcagcgacgctggttggtggacgcaaatctccaccagtcaacgcccagcgacgctggttggtgaacttgtattcttccaccaccagtcaaccaccagtcaaccaccagtcaacgcccaccaagcgtaccgcaacaacgctggttggtagacgcaaatctccaccagtcaaccacgccccgtcgtaccccgacagaccctccttgttgagtccaacaggcggccctgtcctgctccgctcccgtggcctgccgcccacaaatgcattcccggcaatgagccgttccattgaccacctggatctgtgaggtatcctcctggacttgggattctccttggaagtcctcacgtgacacctccacttccaaaactgtcccacctggacttgcacttgcacttgcacgcacttgaaaaacttgagaaacttcacctgtggctcccccagcctctccgcccagctgcgctccgctcgccggaccatctcccgccggatgatctcccgcggttggacttgccatcatcttgactccccccagctgcgctccgctcgccggatgatctcccgccggatagtctcccgcggttggacttgttgtttttttctcttgccgcagagttctctccagtttttaccatagtcgctggtgatgagaaggagagatattggtctttttcaggtgggattgaagaggtgatttggtttggcaaatgttctgttgtttttcgatcacaaagtccatacgaaagttttataaggggttttagtagatatgtaagtattttcaatatttcgagagatgagaagtgctcaccatttgacaaaaaccccaagtccatcgaacgtgttctgaaaaatttcttgtaaacgtcttcacagtgatttcaagttagaactggtacaagcgaggtacatacataaatttataaatcactaggttgttcgtataaatatataagcgtgaaatatctattgatagtaaaaatctttcagtatgattcacaattagttaacgtgtattaatttggttattgttcagtacgaagggataacattactttacttatttacagatacttaaatagaatagtaataaactacgtttagaatactctcccataataccaaaatataactctgatattgagatagacccagaggacaaatttataataaatctaataatcatttgttacacctacgatacctacctatggctttctttgtcataccgctctcagccaaaatgatcttcatctcgtttttctggattggtagaacctgtgtagataccattgtatgtacccttatcatagcaattggccatgttgttatccaaatacaaatatgaagacagtaatagtaatgtgtttcctcaaggttaaatacaggtgaactaaggagattacaccattggatattgcggatatgatattatactactgtaatttctattccctacgtacttggtcaacttggtcaaagactaaataaaagctagatttgtgcttgcgtatttgatcactttctttcataaacaatccaaatggcagaagttacatatttagccgaccatcctcagaatagaatattctacgacaccaaaatgaaactttgattaattttcggtcgtttgtgattctcttgtgtatatcattgtatgattgcggcattgccttgattagctcttaatctaaatgtttgaggcataacaattatgtttctgacctcaaaacacatggctttcttaaatgcaatggaggatttctaggtatatttgttttcttcgtgcattaacacttagtcatctggtttcatacttggatatgagactaccttcagtcgtcttctatttgacagcactaatttcaaatcaccaatggaaactgaaaatataggcccaaagtttaactaccaatcttttaatttttgctaatctatctctgtcaatatagagcctgaattctttcaaagactacttaactagatataatcgagctaaaagttaacctaataaacaacttcactttgactaaacaagtagtctagctgtacaacaatcacccttactacctatttttcatttgtatttctattgatgacattactggcgccacccatgaagataccaaaccttaatgtaaaaattacaactgatttactcccagatccatatagttctgcatccttcacttgaaggaaaataacttgctcatctacacttattccacattctgattgcaaaggtctagttgctgcaaaatctttcactttcatgcgaagaaactatgtttgcggtgacgtattgactctaggacaagttgcatcttccaagtccaactttgatgaaatgtcatcctaccaaagattgcaaggcctagacctgatgttggccagaagaaagaccaagtgttgcattctaatgcattgggggtgatgtgttatttttgtttcattcatttacattttcaaatcaagcatacttcgaaatgaattgccagctagtgtatttttttctattagttggttgtccttctgcatgctgcaatcctgttcacgttagtagcctttcgtgcatgcaaatactatttgaaacctgcagagagttccaggttccactttgcctcgctgttggtgttgtctgtgtctcctactctgtaagggtttgaacagccatgcaaaagaaaagtaactttagagttgaagattacagtgtgagctagctatcttggcaaaataattgttgtcccagtgcgtacggctgctgcgttaaaataggctattgcctcggaatcacagagctcaagacacagtgttgaatctatgggaaatattcaacatgattaactttcttgaatattttgtttcaagaataatgcaccctggttgcatttcataataagatcaaaaataaactattcacaccagttaattgtttgcatcagacacagatctccagcattgctgacacgtgcagtctaatcgaaccccaaataaacctcttggaacactgttgagcgagcgaagcgaacaaatccttgagaaatacacaagacagatgttatggcctgctttcgccatagttcatcaagatttccgtatcagtagttgagtatgtgagagcatctggaaaccacagactttcaccctaccgttatcaaatctgcatcactgtgggcaacatcgctgggttcattgatcaatatgactctaaacggaaaagtgcagataagataagcaggttttgaagttactcaacaaagagtaggatgatcacttcgacaatttaaatagccttcactttgctacagcgtttgctccaaaatcatgaacaagttcagggatacagtctcagatactcctcaatatgccaccttcatgttgtgccctgtagatgcaaactactggcaagaaggaataatgccactgacccgattctaagtttcatttcgtgattctcatcatatttcttttgtaagacccattggtgtgtgtaattgtatcatttcatgtggaagtcaatgtctaccaacgataaattgactttaacgaagttcaatgacatcacatagcttgatgtgacgtataagcatgcacagcaggtgtaccatgatccgatcctgttccatgcacaaggggtaaatatatcattttctctttaggcgcggaagatttcgaaagaaaggtgtgtccaagggatcgttcacgatggtagcaaacgtttcgtaaagtttcgtgattctaatctagtatagtcagggcgatcaatagcatcaaacaattctgatggtcttgtcagaaaatactcgaacgctgtaattgatgctgaagataaataatgctgtcacatgtactggaagataccttcttcttggcggcagttcaatttggcgtggttggcgataatgaaagtaattatagacattagagatactaagacaactccaatcagaattgctgccccataattgctccaatatatgtacataaaaaaaaaatgagaatgacttcatattcttggaaaggccaatgataatttagactgaaaaaaaaatattgtacaaaatagtaactaagaaagtacttcttcggagtactaaaacgccagcaattgaactagaatgtacatagacgtgtttgtggtaagatgcctcaaattggctataacatgcaaattctttctgagagtcactagaacaaggttgtgcatactgcataattcccaattgagatatatgatctaccttgcagcaaggctgagaacactttatataggatattccaatattatttactgttgttcaaaattgaaactcttttttaactctccttcatctttaggtatacatacatatctttgccggctttcaatatccaaaccacagaaaccgcctattcaaacagtacttaacttcgtttccaaggctatattttccaacaacacttatatccaactttgatcacccgcccgcaatgcggttgtacttagcaacattaggaactccgctcactggtacaacgccagctatttctaataacgaagagaatatcactgcacacaataacattgccaacgatttcagttatgactgctatgaaacaaaaacgttctcgggatatcttgaaaccttaccattttgatccttcaattgatgatacaatgctctgctccatgctaccgcctacaacaactgctgaccctgaacaactacaagaaccagagcatgaacagcaacaacataataatccgttcaattgctgtcaggaagtcaaggttaagatggccgatcagcaaaagttatatttgttgcctgagaaacgtactaacaatattttcaattcaaagtctgctatgttcgtgtattgcaacatcccacaaatgagcttggttcagtcgttcctggaccttaacacttctcttcttgccactgacgtcactctagatagaaattcgttttctttagactcgacaattgatataccgtttgaccaatctgttcaagatccatactcttaccggtcaaactctccggaggtagcacctcaatccacagcatgcttctcagtaaattccaatttagcacccgtggaaacattcacaaccttattggaggcagccgtcaattctaaaagacaaatgcttcaatatagacaacaaatcaaaatcaatggtcttaatttttcagaatcaacgttccttgaccattcatgcatactgctggtacgtgggcgtagctttgggggaaattgcagcagacctcccaagacaccattaattcctggaactcgctcggtatgttactgcccatctaagactggagaacaatacaaatgaagatatgtgtttgccccaatggaacgagcgagaacttaacgactcaagaagaatcatttgtattgagagaagataccactccaatgaaattgtagcatcctttccatagttggatcggccatagatcaaacgttcatctgaaccagacgtgaaagtttaggaagtttcgtgtctaagatgtttaatcaacgacaatgaatctgaggaggggcgcattgtcagtgaatgtacgtcatatgaagcacgagcacaaagtgcctcgacagaaccgctaacgtcaagcttcaattgagaaccaaatgaccgtaaccctcaaatggctgggaattcaattggatgcaggtattatattaccagtgtcgaagtcatcaagataatagaactactgattggaagctattcaacctcagaccctctgcaaagaagaaaagaacgaggtcgtatgagatcgaacttgctgcaattctggtccaaacacctggtgtctttctccaagaacactatgaagcgccgtcccgtgccaacatgcaacgatgattatcttgcggagctggaacatcgtattaacacatacgacgtgagaaaacctcggttatttgacaagagcgttaagattctggaatggtccggctagacgaatgtagcaacaaagttgcaataacaaatagctaggtttgatcataactattggtacgaagagccaaactcttaagcggaaacgagtaacaacaaatggttccttttgcttcaatttttaaagttccgactttctttgaaaggacccagaaaattggctgtattcaagaatcagtgaataacaagatgtgtatatgtacatggtgtagaacacggctaggttattgagataactctcccttatgaatctcagtttaggtgaacttgactagttcttcttgcaagtgctttcttcataagtacaaagctgcccacagtgcatacagatagatatgcaccagatacattctacagggacgtactagcatgttagcaagcggctgcgcgcttgattgcccacaaaccatgtaggaactgatatgtattttaagaaactaagctaacaacttcaacacgaataatctgttcttcaacacgtcaacgattaagctggggtaacaatccatctcatcgcgtggaactgcatctcatgtggatgtgcgttcaccgaaaaattcgcgattggtgagaactccaaagtcgaacttgaccgataaaacgatatgtttagattacttttagttttcgcggaaccagcgatcgactgagacattttttttcgtaaactactatccatgataagagacagagctatcgattacttagggcataatgcacctataaaattcaaacaggtgttcgatcaacgactttaaattgtatacagctggctaacagtagttgactgactgagtttagttcagcataattataattgccggaaaacaaatcaagatgtgggtggtagcgttgccactttcaagctcaaagagaaaaactcccccgaacgtgtaacgcaccaagtacccgctattcaccagggaaaaggagcgagaagcgagcaaatgacattcgtgtgttactgtaaagctgacttgccaactgaaatgaaattgaaggctggagtcacgaaaggtaggtttggaatttatgcatagtggttctatcagacgcagcctgtaaatttcagtgataaaaattctcaattcatttccatttattgaacttcatgccctgataatcaggtattatcatccagaactgaaaatgaaaattcacagtctactactttggaaccttttttttattccttccattctagggcaaaactttacgttaaaattatcggcactggctccagttagttcaaattatgtgggaaacacgactgaaaactatgaggttgcaatctacaatcctgaagttggcggtcttccaagccaaagtattggagtttggttcaaagatggcaaactgcttcgaagtacgctagaacaaagagtttgggatatctattttacacctcctgactccgaaggccgagtttatgtctaccgcgcaagcgacggccagtactacggtctcttgcgatttctcggtgaccgcacaaacgaagtaccgtacctaggtcaaaggcatcaactgggagttgtttatggttcagatgacagacgttacgctagtgagccaacacgttttgctttagaagaagacggtcagttgagactcactgagtatgcgggtagtaccaccaacaataacacaattagtgcttgctacgccttcagtgtttacagtaccgatgaacagtatgtaattattgcaggcgaaattacatcaacgctcttctatcactgcgagccaattgttctcagtgccgtttccacaaatctgccttcgatggacgcaaaaaacccaaaacgtttatttcagcgttctgagtctccttcgatgacttcttcgcaaaatggaggagcaagtacttcaagattttcacggttcttaggagcagccgcagttttactgctcaacatgtttttcatttaagggctctttattttatagttcactaactttacttacatgtaggtgttttttgttttccttagtagaaattctggttgccagatactggagttctcaatccttttttgatatcagcagtgctccacgtatacgctgaaagatgcaccagatgtatgaccagttattaaataagcaccgttgtgcaattcgctgagtgtgcttgcgcaaaatatgtaaggggacgatttttgaaacccctgattcatgtccacgtcttagccagtaggaaatttaatatgcaagagctacattgcaaattcgtggcaactgggtacgatttgaagattactaactagaatgcaataccacagtatttgacttacctttgtttgcatgatggctcagctcacttgtatcggaagtgtgtcagcctatgtcgggggtgtgctgtcatgtttctttttggaacaacattctgatggattgggtaggaagaaatctagcgtttcattgatcatgaccaggcttgtgggtgctattctacaaagtgtttcgaaaggcgatttgctgcttgttattgatattggcaggtttactgaaagacgggtggaataattcgacaaagtttccacgattgtatcttattgtcaggggaatcgatattgaaacggcaagaggcgagttcacgaaacccaacttgtcgtagaagaaaaaagacaaagcttgttgtgtctttaaacctatggaaaaaatcacaaaagaagattacaattgaaaaacgtattttataatgcttactcaggatgctgggggtttgtggtagccaatatggctgttgaatcaagctagcgttccggatattagcacagtttcacaaatggtagtcatcagtcatcatagtgtttagagattagattttaccctacgcacagggtggaatctgggggatgaattcttgattacataggctcttgccttttttttgtttgcttgtcatggtatcatccacactttgatctgacgcattttcgatgaactcgtcattctgtttgatatccaattcacctgattctgcctctttaacatgtgcgataccagagttgtcaggacacagctcggcaccgcggcgaccgattaaataccatggcaagttgaacaggtcttccattgattccaaagatcttccagcaatctctggaaggaaaaaaaatgcccatagaagaccaagtgcaagcacaccgactccaaagaaaaaagtgcccgctggcgtcaaagaaatgagcatacttggcagggctttggtattaccatattggttagcaaagtgaaatgccatgatagttgcagttccgatattacgcacccttaagggcaacatctcagcattgatcaagtattggattgagttccaacccaatgtccaaccgacaccagtaatgtaaagcatcgcaagggcacccagtccagcgtgttttctggaaccagtcaactgaacatcatcctctatggcgtctggtataatttgcaagaaaatggcaaaatacagtgtggccaacatctgaatggtgatgccgatgtataaagcttttttgcgccctaaaaggtcaatgacgaaaaaggcccccaaataggcagaagttaacttaacgactcccaagatagatgaatatagcagcctatctgtgcctctcactccggccaatgctaccaattctggaaaatatacggtgatacttcctgcaaaagaccattgactgagaacttgagcagatagggccaaaagcatacgatatctgatggatttaaccataatgagttccttaaaaacgtgccatttagacacagattgtgttgcctcgtcctcgatgtcgatttgctcttgaatatcacctacctcacagaggatatatggatgtgttgatggcaaatgtctgattttggacaacacggtgcccgattcattgataagcccttgttttactaaccatcttggagattcatggcacaacaatgaaccgatggccaacaatccggcaatgacaatctttatagcagtaggtacgatccattgttttggggagtctgtaggcaagtgtaatgcacagccatagttaatgaaattggacaacatcgaaccaaggtacactgaaccggcaaaaatacacgtacacaagcctctgatgttcttgggtgcaatctctgacatgtaacagggaccaataaccaccgtttgaccgatagacaatccttcgatcaatcttccagcatatagctgacccacgttcttcgatgtgatttggataacagaaccaacgatccatccaacgcagacaccttgcaaagttctgatgcgtccgaacttatccacgagatacattgccagcaaacagccaccgatggaccccagttgcaccatcgcggcaatgtttgatctcaggtttgcaagctctgtctctgactttgttaggtcgtccagtccgaactgactttggaacggtgccttagcttcgataccaccaatataaccttcatcatagccacgagcacaaccaaggacgccgaagataaagacggctaagtacagcgttttgttaaaaatctgtggcggtgcgtcgcccgcgttgtagaacttgtggaagaaggacattgcaattttgattatctgacactaactataccacttcgataattgcggaattgctctgtttataagcaaatttttattagccaaattcagctgagcctcgtcaattggatgattctggagtgaaatgctgggatacaatgccaagcttggggcactaataaagctagaaaaatagaggccgaaatcagtccttgaaggtcattcatattgccttctggagctgaggagactatttcaattatgggttgttgtataagatttggaattacggggttcaatgccacactagttgaggatgtatgtctttgacctgagagacgatctgaaatttatacaatgtgcgttcactttatacaaattattgatataattgcttatatcgaatacagaagataaaatcaattcgttttcgacagaaatgttaccacgtaaatagtaaactgtttgttttttcctttggtgaaacttcttccacctttaattgattgtgaccagtacagaaaacttgcctacgaactagtaaccacatgcatgtcgctgtaatcgagccaagccggaaaatcatggataaacaaagtggagtgggataaccggatcatactccgagctagttcgctgcaacataatttcaaatcttaagtcgaagtcttacctcagattacttgctatttcaaattttttctcatcaatttcaagctttcggccttggcacttctggccaacgtccatgcactccacgattccgattttttcaagtcgtctccgctggacagcaaagttgtccaaaggaaaagtgaaaacttctccactatatatgcttaccccacaggttagttttcgaagatggttgcaaatcttcaccttgctcgcacttcacttattgactagttaaataccgtttgctttgaaacactaaaactaagtatggttgacaagctggtatggttgtggggtccttttaaattagttgattagattattgttatcgcagatactgttgcctgtagaactactgcgaacgaagtacacatctgatgacatgttgtttgttgttcaaggcaatttcaacgcacaaagaattcttgatatcatcaagggacatgatcttgaaataaagtgtaaaattgctgtaagcctaaggaaactgcaagtgcagccctcaaagccccggagaataacaatagcgtcactattgcgttaacaagagttgactcgatccctttggagaaaacgatgtagattctgttgagcagatatgcgactcagtcaatgaagaagttatagagcagtatatttggtgtctcaagatgataacagattttactgttgtgtgattcttctttaaatacttctcaattatttgaaaaatatcagcatcgtaagacaaagcttgcgtgtgaggttaccatttgggttgagtatggcgagaattcaattaggtgataagctaatcaagtttattggatgacaatacggcgtagacatgatcaactacgtatgaacgaccatattagtgtgaaaattactgtctccacactaacttatttgataaatgattaattcaataaaaccttgttttgaggtattatttaggtacgtcagatggtacggttcatcgatggatttccttcacaatggacctttattcttcttttcaattttgcttacatagtaacagaattcatagctgacatgtcgcttttcttgatggaaggcatgtcagagttcatggccgacatgtcgctcttcttcatagaaggcatgtcagagttcatggccgacatgtcgctcttcttcacagaagacatgtcagtttttttcatggaaggcatgtcagagttcatggccgacatgtgagaagaacttcgtttgaaaaagcgtcggaaaaaggtcatgaaacaaaaagtcactgcctttcttgatcatgggaagcaaatgcatttagatattttcgtttcgttcgtactacatgctatttgaaacttggaagctgttccaaaaggtcattggttcacttgatgtgaaattgatgtgaaatagtaaagacttttactccttttgcagaccttgattgcagaaaagtgatctgatcccataaacttcaatcgcgacttcgtttcaaaaattaggtaatctggagtgagaattctcgtttttatgttctgagcgttctttcttcttgacgggtggataaagagaagacctgaattacagagaagagctaaaattccaagagcaattattattatctttttaaaccgcagttccccctgacatggtaatagaggtattcacaaatttggcgccttgtcagttcttcttgaattaccatttacggactcccaactcctcatccggtgctaagcctcaataaaaaaagaaagactaagttttgctcaaacctttctagttgccacctgccttgtagtccgaagcaaagtggctgaatatcacttcgcgcaatgctttccagttgccaccggctgagaatgaggttcaactctgtttaaacagtaattgtttcgaaatgactaattggaaagctatattgactccagcacaataccgagtgcttcgtttgggcggtacggaaacaccacacaccggacagtatgtgaacttcaaagaaagtgggacctacttatgtggtggatgtcaaactccactttacaaaagcagcacaaagttcgattcatcttgtggttggcctgcattctatgaagcgttacctggagcagtaacacgaatagaagacaactctcttggaatgcgaggaattgaaatcagatgctcccagtgcgatggacatcttggccatgtttttgagggtgaggggtatgacactcctacagactcgaggcattgtgtcaacagtatcagcctgaagtttcaaggtgaaggggaggatgaggagaacactactaagtaaaacgatgattttattttttgtgccttatataagttgttattcagttttttaagacagctttgatttggaatgttcccataggagacccatcagagtccttgaaaatggtaaacttctcattgatttttcataacgaggcgacagagatttatgctagttgtattcaacgatgatgagcttggagtgcatcggcaaatgaatatcagtttctttagttttgtcaaatttaatagaaaatgtgaccgttgaaagtaaaataagattaaacgaaagacagaaagagaaaaagtttgtaaagggaaaaccgttaaggaacgcacactggcaccacaattgtagatccggcgtccgcggctatggtagtcagaagaatcttttcagtcacaatattggcctgtgtgccagtgcaagcgtcgcacaattcccttctgacgttagcaatcgatgagcaagcatctggttcaaccggactttgtcttgctataaagactgtttccaaaacctcacttctaccagctattgccatctttatggtgcctaggctagctggtagcaaacagtatcttattgtgcaaccgtgcttttagtcagttttgctgtatgttgtctcaaagtggatctatatgaactatttagtacatctagttagtggtcctgccatttttccagggtttctcaactgcctacataaactgaaaaatagtaaagcacaaaagtagaatgctcgctagcctccagtagtatgcagtattattggatattaaacattagctcactgtttgtcggcttggctatatttttgaatttatcaattggcactgctacgtaatagctgtggagagcccgccgcagagctggtccaagctttgaccattccaaaattctgagatccttattgacctttcgaggtctccgaacttcatatgtcttgatacgatgggccagctctgcaatataattctcgttagatgctgtcactgaacggcgcttcatggtgtttgtggttgacgagatgagatgtttggaccagaagggcatcaaatttgaccttatgcagcccctttcttttcttctctgcttgcgatcttggattaaatggcttcccaccagtaactcaattatcttgatgacttcgacactagtaacgtagtactggcattcgatggaggtcccattcgacgtacaggcataactgctacgtttcccggtagattcttgtttccgtatttcggtgaattcagactgaacttcgtgtaaaaggcttccatgcactgtttgtttgtcatcaatctcgtcgtaattgactagacaccgtaagcacgagacttctaatacttccacgtcaggatccagtgtaggtttggtgtgtgggttctctaaagcagacccaactattgaaaaggaagctgcaatttcatttccctgttgtcttctctctatgcggatgattcttctattgtccttgagctcgttctcgttccatttcggtaagcaaatgtcctcaatggtactgctttccagtctcaaactggcggcaacgtactgtgttccagtaattgatcgctttttcgggggtttgttgttgcctccagagctacatccacgaaacaatggcaagtagtaggtaagaaacgctggtgccaatagatcgaagtcagaaaagaggttcagattgtcggttttgctgtgtcgttcgggttgaatcttttgtcttttgcggtcaacttgtgcttccaatgaaattgtggagtctacctctgtggatgattctactgacaagtactcagacgatgaaactgctagttttgcagaatttagcttataagatggtgaaccatggaatgattggtcaaacgatgtaacttttgctgagtccacaaatgataaacattgattcggagcagcatcagcaagaagagagcttttggcacctataaacgagtgaacagaactaatttgtgggatgttcggatatgcgggaccagacgattctgaattgaaaatgttctcggtatgtatagaggacgaaaggtccacctgctcctgttcctgtgtttgaaacatagatatttgtagccgctgaactgaacctgctgttaacattactcatgctgtggggatcttgaggctaatatgtgtttatccgacaagaagtcatgctggatgctgaaagctgcagaataagaaactgcatagctaactcttggcggaattggtcttcggttgttgaagtggccacttttgcatttgaactgataccaactcgtagatacatattgtcacgtttaatccagcttgatgtcctcatttattatgttttcagtgtcactcaatatgcatttaaaagccaaccaccgtgtttccagcatgaagcagaaccatttgccatctgccctccccccctttcggcgttgaaataactgcatggtaatataatacgaaaacggacggcatatagaaacgggttcgaaataggcctcaacaaaataagttgcgaccttctttcaggtgctaaatttttttccacgcacgtttaaaacagaagccaaataatttgggggccaagcctcttttttatgcatcttcaaaacataatactgaataaattacgtacagaatcccaatcttacatgcaggtttaaaaatagagactaactaaatcatggcacgaattccaaattcgctatggacggttataaccactcaagtattatgtaatgccaagctttgtgagggccaggaactattatgcacagcttgtacaggagtacggactttcagaatttgcaagacagacaagcccggtcataatactcagaatgactagggaattcaattgtggaaaaactgatctccatttgttaattactgtgaggctctagctaaataagtgagacaagagcttgattcaaatctatcacttaccgtttaattctaaaacctggcttcattcccaaaaaatgtactatgaacaactccagtcatacaaactgattgtctgggcatgtttccacctagaaacacaatagatttgccaataaaacacttgccaaacaattctgagtttagtgaaaacactgctagccaatccaattatctttcttggcgccatgttgaatattgtattctcgattcaacgtttttccaaagctaaattgaaaggttgtcgtatgtgtatgtatatataagcatgaaagcattgagtgggtaatttcgaagcgaataagcaaagaaagggaaaaaaatgcttttatctgttggttttatttgttcaatcactttaccttggtagagccaccgaagctggtagaagcccattaaatttgtttcttcagccgcgagacccttctccgctctccatgataccaattttggtggaccatatttttattaccgtcgtttctgcgactagatgtagtaagggcagtgtaccatagccacaacttagtcgaagcaaaactgaaagcttttacgaccaaagatacaactggaattgtaacagcgtactgtctttgccactaaagtttttacttcggaaacaacaactgtaagtgaaagtgaactttgcagacagcctatgcggcagaacaaagtcaggaggttgtaccaaatgtaggcccatcgaccgttgaaatgggaagaaagttgtacattcttacacttgtggacagactattattgtgaccaaaaaaatcttcagactaacaatgtcgcagacacagagtctgcaacggtattttgggtctatatttcagttaatttttcaacctgcagctaaattaggcttctttcaagcaagccttgggccgcgtatccgatattgaggcccttagtatatataccatagttttcctacccccttcaacgctctatttgctaactggaggaggaaatggcctgaactggtcacttttcttgcacccgaaatagtttgatttctaatgtgtgtttcttatccagaactttctttctttttattctttgcttaacagttttttttactactaactgccggttttattgcagttggctaaatacgaaaataatcggaaatccactgctgcacccagtcttaaattttgacaactcgaattatagtggcgtggcgtataccccctcgtcgctttacacagatacctttgcagtcaaatcagttgaacttgttcaccacaaaaagttactgtaacaattactctttcgactggagctggatattcaggtgtaggtttgatagtaccgttcacattttcacacgcaaagaaaaaagaacctgtgtatccacgctatgtgggttcatgatatcgtattgattgcattactgtgttattctaagattggtggttgttgtgagaattaccagatgcactcttaaaagttgataaaagggccaacgttttgatcaattaacttgagaagctagaatcaaaatcaagcacatctaagtcagtctattatcaatgtgatctatctcagggtcggattgaaaagttccagtaaactcggtaaccatactattacgatgaaaatgaaagagaaataaaaatagatttaatgattaaccctcacgcgtaaataaaactgacatattgattggttcttgtaaaattttggtaaaactatttggttccacttaatgacagagtacccttcatagacggtcttgattgaattttccagaaatgatcatgacccaaaatgataataaagctggatacacagtctagcatgatcttggttcttaatgtgagcttcctctgaagttaatcactgctacttctgtattcggaatcttactcgataatttttggcccttaacaaaaatgctgccttaagaaaagttcaagcaaaaaaaaaaaaaaaaacgaaaggacgaaagtgaaaaagtacagctataggaagcacaaattgaataatgaacaattgctaccagaaggccggttaaatcatgctgttagtccatccatacctaaacagagactatcgcagaagacggagagtagttgcaagaaggactataactctgaactgggtacctgagcaaaagtttcactaaatcgctggtctgctgtaatgaaatgtcgagacgatcaaatttcgtcctttactaaactcacacggtgtgattcaagcatcgtttgaaggatgctccattcagtagctcgtgatgtgtgtgcactggaacacatactggaacacatactgtaaccacggctctatagtctccacaacacagttgtagttctgcagattctttatctggtgagaatagtagttaagtgcaattgcgagcttcacgcacccccgttgtaattcgaacagtcgaaagttgcgcatctggtacaacgtggcctggcgtttgcggattaaaatctccgcaaaactacacttttaaagacgccaatcaccttcacagaaataatgtttttagcaaaaggacagtaagtcgttatgactctcatcatgctctccagcttgaaaccccatgtgaataacgccagggatagaaatatttagtacacctgctcatttcattgcagattatgctttataatctgcgagatccaaaatccttgttcccactttctcggtgaaatacctatcgtgtgttgcagcaataattatgcccgggaaagttaacagggcatcttcgatgaattctaaactgggaaaatcaatatggtttgaaggttcatctagaagaagaattgaacttccccgcaggataagttggcaaagctgcgccttacgacgacaaccgatgctcaaggttctcaaagaattcttcaaatcgtgccacgtgtagattccaaagttgcgcaaatttgttatagcgtttgcgtcggtagcattgatggacgaatctttcttcagcagtgaaatcggcgatttgtctaaaggcaaactttcttgctcttgatctaagtatccaatctttgcatttccactaatggtaacactgccctcatctggctttatcaagctcataatgattttcatcaatgtactcttacctgatccatttggcccttggataataagcctatcacccttactcaaagtaaaggatatattttcaaaaagggggctttcaaaggatttggaaactttggaaacttcaatattcaagatcgaagcgctaaacgcggggctatcctcaaaatcaaaagaaatatgacgtctctcgggaataacatccaccaaatcatccgtcaactgttcaaccttgtcactgagctgcgcaaacgccctattgacacccttttgcgctctttgctccttgttattataactaagcttgtccctgtctgtgcctgacctaacgatcctactttttactttgcccttagcctggttggctttcagtgtcagcttttttaattccttttcctggtgctttctctcttcaatttgcctttgccaccttttgtcctcttcctctacgtaatgcttgtattgtcctttgaaatgagtgaatttcttcgtatgaggagaaagttcagaaattcggttcgacacagcattgatcaagctacggtcatgcgtaaccataacaacaccaccatcaaagttcttcaaaaagctttccagccattcaataccgcgccaatccagacagttagtgggctcatctaacaaaataatatctggctccaagatactgagtgcgcatagcataacttttgttttctcaccaccactgagaaacttaaagggcattttgagcaagtcggtagaaagtccgatatggttggcttgcttgaatgtttcatggccacccaaggtatttaattcttggagccactcggaagcgaatggtttgtggggtttcgttaagaattcatcaatgtctgggtcatatagagatctcagtaacgtaacgattgccaagtcgtcaccactgacatcttcaaagtgctgaggaagatatgcaattcttccctcgatgaccactgatcctgaataagtgtattcttcaatcccgctgatgagtttcagaaaagtcgtctttccggacccgttgtcaccaacgattgtcaccttgtcccccaaactcagagaaaaatctaaacccgcaaacaggcattttttctcaaaggataaatccaagttgcacacagaaattccaattgtcccgctgcttgaaacgaaatccctataataaataccatagccatgaagtggcgacaaggaagatttgagtaattgcttttctaactccttctcgggaagattttcttgcgataccttttcaacatttacaaagggcgaagcattcttgcaaataacgagcttaacaggctcaccgtgcttgtctaagcacacgtcaacgtgcaatgtctgcgattcggggcctagagagcgtacgtacgacaggtctgccccatccatactcacatccaagtccttgtaatgttttccgaccccctgcgcattgttcagaatgacctctgcttttagtttttttgcctcattgtaaataattacattatgtccaccttgtactatcaattcggtccttgaaagtgtctccgtgttcatagacagcgtcaagactacatgagttgattatattagtgcgggtaaaagttgggcagaacacgccagctgtccagggtccaaattttctcacatacttttcattccttttctgacactgaaccagatctgtccatcaaaagtgagaaaatcaaactgaacacgagtcaatataattagtcaccaaacatgagagagtggttatgagaataaaatttgggttcaaggtgaaggactagttttggaccgatcattaaaggattgacaacaatttttgaacgctgcccgttgacacagcagatatttcttagaaggatgaaattgtagaaataagactttgtattcagaataactgctagaacctgtcaccagtctaggaattggattcaacgtgagtaatggtgccggaaagagggtcaatgagtcttcccaaaacccaagcaagtctttggttagtagaagcgtatgaacagacccagctatctcccataaacaaaatgtgaaaagagaattgtcgcttgcctttattgcaagctggttgatgtggttctggctattttcaccacgctttttgtcgatacaaaacgagaatgagacctcttacactcactggaactcagattttatggatgaaacatactactgctgtaggagactatcatgtaagatattcatcgtgcacagtttggtagtaaactttttatatgttttttcggttattttgctaaaattgtgtattaggattgatggcaagaagcaacactaactgagaaaggtgaagaatgtgctcaattctaaactcttcgagcccacatgaaacgatgtgagggtcagatagtttgatcaataaaattattgaagtaacatttgccatgcttgacaaaaaagttacttgattaccataatctgacagcctcagcgacgctaaatggtcttgaaactttttgaattttctctgagactcggacactttggcgacctagagatgattaaagtctctaaagactgattgggatctttcacattgaagctggagatattgtgcctgtctagaaaattttttgagttggcacttattttcttttttcttgttgctgaagaccagtttgctctcacttttctcgttgaggattcgttcaacatgttccttgatcttttcaatgctatgatcagactagaaagttctttctaattagttgaaatcgggagtcgtatcggctgcatgccaaggaacgaatagctttcaaattggactattttttgctttgagaccaagatggtcagatagcccaatctattgattttgagagcgatgttgaaactaaatatacagttatttcagaacatgaacttggatagcctttctaaaagcattttatatattacttgcgctcaggttcagtacttagactgttcttctcttttgaagcggcgctagtgccatctttctcttccgacagatcagaagcagatgaagaagaagataagttagaagatatggtatgaaactgtggtccttcaccgttctttccagtagctgtcctcaataccacttctccattgtcgtcaacattgacagatgttctctgtgttggatcaaaacctttaataaaaaatactataatgagagctggtagaaggaacccgagtgaaatgtatccttgtttctgcaaaacctccctgtacgccctatcgatagcctccctttctggagtcccttgtttgtatccaagtgcaaccttgatgcttccaaaaatacttgtagcactacttttagacccttctggaagatactgtgtcaatcttttgatcacaagttcgttccaaactgacgctgcgatcgagtttccgattaccgcacccatttggctaaacatggtaaacattgcaatggatggagcaatctgtgatggatctgagttagcttgcactgaaattattgttggaatgttgtagaaacctcttccaaaaccttcgaagacttgaattacagtccaatgaagttctgaaccaaattgaccattgtgatcagaaagataacaaaagaatccctgagtaataacaatcaaagatattccagaaatcataaaaatttttgctgtccttgtgtattttatcaaaataccgaccaggaccgaacccaccagttgacagactcttgaggctctggtgattctggcagcttcaccaactgtaaagtgacctgaaacttgcaatacggaggaatagtaagcccccgatgtcgaactattaatagtatcaaaaagtggcaatgtgcatgccatcagaaccgaaggatttttcaatatactcacactaatgaatggtctttgtgggaatttagagagaacccagaaaacgaatatccctaaaacaacaaatccaagaaccaaaaggacaatagtggtggcttcatcccaatctaaaatcgatgcagaacctgtgagggtaaagggcaggaagaagagggagagtccagcaagcatcagcaaacctccaacaatgtccagctcaacatacaacaagtgggccagtttcttgtaccaactgccctcaggaaggtttaaagaggccttaatgttatgggtgataccatacttttgggctttcctatccaatctccacataataaagatcaatggagctagagaaacaggtgtaataatagcccacattccataaccccatctccaagtggagtgatccaacactttctctgccacaatagaggagatgtaaagggtaggaatggaagcaacagctgttggcagagcggtccacaatcctctattcaagatctgagtggtatcagccacaaacaccttctccatcatgacataagaaactttaccgatgcccaagaagatttcggaagccaagtacattccaacgttcttagaggcagcaaacataatgtaagtagcgattagaaagattagggcaataaagaaccctgacaccctgctaaagcagtctgctattcgggcaacaaatggaagcgtaatgacacacacaatcttgtaaacgactgctgccgtagttaacatagaatgctgtctgaacgaggatgtggcgtatggagtgtaagatttaacggtgactccgcagaactggaatacaaacgcagcaaagaaaagggcagcgtaggcgactataagggacttttttgaccaagcatgacgaagcatttccgcacgagcaacaccagggagtactggtatgtgggcttcttcatcagtagtttggctttccggagaacttgacgggctctctttccgattcttgttaaaaatattaaatttcatttgctatataagcagattgacctagtcaaacggtgatgtaaaagccgggtcgtggcattttatagtttagcatcaaaggaaaagtttcttacttgtggagttagagcgttgtaacctgcagcaatatcatgcaagtcgctgcatttttcggcctccaagattcgaaacagccaaagaggaccacgcgagaaaaagaccatttaagcataatcagccagtatcaattaattagactctaataaatcatatgttttatgacggaaagccccttaatatggcatacacttatcacgtacttgcttggcagggaccccaaaaagtatagtcccattatggtgtctgattatgtgcgacgtgggagtgctgtctatccaagtgtccataatccgcaacccaacgacttgatccaaaggatgtcaataactcagaccggagtatgccatgtgaccctcggtgaacttgaataaagttttatacatgtaaggatacttttgtccagttcccgtgactttgcaatctaggagtggaattaacggttcccgagaatgccaagaagatctgtcggatctgatctttaaattttttgagagcagcaaatgaaagagcattaattcctaaagcgcgaacaatcagccaaggtaagtctaaacattagccaattcttgcagataaaacaatgcagggacattcgacacattttgctttgcattaaattaattggtattattttattaagcaatgacgcctaaaatttttgattgagggaggaatgaacgagcaagacaaaaaaacatccatggttattctggcctaccggaagccttaccaatgtttagcataactgaaactctgcatctaaaagtttcaactaacaatcatctgacttagggtcgaagaagatttcgtacacagtaaatattgcctaaaaacgatcttgattattgtctccggagtaagggaagaagtcttggaacatttggagtcaatctgaatccgtatagagtcggtaataccttctcgtcccatgggttgcaaagaatagatttagcatcactgaatttcctctacggtagatcgattgatcaaagttatcagcaattacaaactgagataagatcgaataaatgtagacatgtcctgaaaacaagtttggattcaaggctgctccgggaaccccacaaatacgaagtagatgtaacgaaggtaatattgatgctattcaatgttaataagcgtgtttctaactttgcaggagttgtaatggcggagaaaagttatgcaagttttctatcaatttactctcattcttacccaatgaccttttttcatgaaacttacagaacaagtaaccagtagaaatggaagtgactgcaatgatgagaacaaacttttaggacgcaacgatagatcatcgcacttgtccaggtactcgtgtctcaagtttgcaacagtttattcacatcatcacttttattgcaaatgtttcttcagttaattatcataaaacgaaacctggggtgtacgcaatgcaatgagccttcaagtaatagaagttaacgatgcattagaggcagattcaaacagcccgttcttgaatgtacgtgttggtagtttcaattcaaaatttagaatcttttgacttaaaaactaagaagttatgttccttgatcatcatacctatgaaatcagggccttcaatggtgaatctttagtttcccaaagcattaacattttttcagccgtaattccatagcatttcaagtccagaaggttcgtgattgatttgtctgtctttacaagtatactatttgagacgctaaaaggcttgaagcgattcggaggaaatggtcatttagtagctaaagatgataggttttccacaagtgctctttagtacaaaactaatcttccatactcgtcaatgtgaaatcacttttgttctgagagttgttgcacgcttcgatcgttgataaaaagcgaaaaagaccatagcatatgtgacaacacaacaaaaaatatacaaaatacagggagctacttccagattacagctgcaacaaggcaacagcatttatgttaatccaatttcggatccttcttggcgtttgctgagatagtagaatatacgataggtgagcttccatggcagcgataaactgtagcgctggaaggatggatcttttaatgaaatacattggacagttgtaaccaagcttcagagaaattagaggtctttgaaactggagaattgaacttttttgtggggggaagaagttcaaggtcaactacctatcctaacgtatcactagcaatcttgaccccgaaattgctcaaatgcaattgagagaagttagatcagtgaaaaagtttctaacctgtcttcaacgaagttgaatgagaaaagcacaataaaacgtaaatctcaaagaagtctctttttcacaattagttaagtcctttggaacaattgttgatattccattctcttattgaagacagggatagttcgtagaacagtttggagcttcccaggcagtcgtaaacaatgacaaaaattcgatcatgttcctactctaggagatagtggagtacatttatgcgtgtctcgacctcttcaataaatctcaggtatgctcgaaaggactatatatcaagtagaagatgatctttgcttcttctaccgaactgcaaggatcgcgctgcatacagtttttgagactgcctgacacgaccgttagacggacttgagaatcgcgtgtcgtaaactaacaaagatcccctacgttgcaactggaatgttagccaggccttctaaactttcacgatttagttccctagataactgttattgtttgtggcagtctgtattattcgtaaatatccctggatgagcggtagcgtttcagtcggcctccaaatttttggtcagtgagcaaagctgtgggctacgagcgtataaagcaatcttaataatcaaactgaaagcctccggttagctacctgagaatgacccatctaatgctgttttgaattatggtatgctaacttatttaccgcttgaacagcctcagacagcaaaggtaaagataaacatcatacagaatctggagtactccacgcgttgcgtttttcagtctagatcagcaaattcaattgacaaatccctagaattaaacttaacaagaacgatacgagaacaaaaccttaactgcagattcatacactatgccatcatcaaccttcaagattgaatcactcagactccaaacgatttcatggtattaccaaagtgatcaactaactaaggtacaaaaactaatccaggtttcccaaaaagatttccttcaagtttggaataccgtctttatacagatcctcccattcttcaacagttctttcccttccattaggagaccaggattcatactcttcttttgaacctactggcctttcagcaagaggggtgattcggaaacaatgtcttgcaggatcatcttcgccgaagtcattgacagctgagtgaaatactcttctgttatcccatgcaaccacggttcctggttcgtatgatgcacgtagttgcaggtccaaggcagtagcaatgaaacgctgaatgaaattcaaaatcagatcactttcttcctgcttaagtccaacaatttttgtaccgaaagctttagcaaagatagatctcttatttaaaacagggtgatacctaattaatgggtgaactgtttcagatgtaaactttttccgttgaatagaaccctttttcaatgaatcctctgcttgggcgcgggcagagtggatcaaacggaggccatccaaaaatttctggaaacttggcgacaatcgttcataggcctcgatagcgtcggcaaacaaagtgtctcctcctgcctctggaccttctatcagaccaaaaaaagtgattccagctggctgtaactcgtaggtaacatccgaatgccatccaggagcggaaattttatttctaaacgtattaggagggcctgctctcttgaaagtgatatggaattcggggtatccttccggagcgcctgatgtttggtgaatatgaaggggaccaaagtgttgcccaaatttcttgacttctcccaaatccttatcccgcaagtcctgatctctaaatacgacaactcctctctgagcaacgaaaagagccagatcatctttctgatcaggggtcaattgtgagagctgcaccccttccactttagatcccaatttcggagtgatgttgctgatcttgtgggctcctccttcaggaaacaatctcttgaggccagggtctgcaaaaaatccacggtcaacgtggctaaaaggaggctcatcttcaaaactcaacttcggatcccaggtgggtaaccattgaggataattggaagtctcctgagcctttttcgacactgttaacactccatcctctctaacgatatctgaagaaggtgagaaatggatcgcatcgtcaaaacgccaaatatttttttcgtacttaacagccttgcctttgtcttccactggagaaggttttatggatgcagacatgatttctttttctagtaaaatgtactgtgattgaggaaattatttcagggagtatatatatactcacaatcctaccgttgaattcggatgccatatcggctgggtgcaccttctgataacgcaattatggcttcaaggtcctaatccgtcctaatgtttgtaaatcgagccatacttattatcacaaaaattacgtaagaatgatgaaaagccgaccgtttattgacttctcttacttagccaaacaccgacactgtggtgtcttgacagcttcatcatctgactttgaatgtggggagtggaccgtcgggtcagaaaccatccagccgtaggtggctcgttctgttctgcttacgcaagaaagctctattgcgcatgttaagtgccataaaagatacttgcggtaccccacaatagataactgtaactcaaactccttttgaacttaatgatcgcttgattcagtagaaccaatccaaacccaactgatacaacgtcggttttcaaggagactagcgaattatgctattcttgctatttgtatgttctttatggccgatgagctaatcgactttgtaattctaggaagactgataaactattgttgaaacttttatttgaagaaaagtacacacagttgtttgctgtgtcttaattgcaccgcaatagtttatctatttatccaatttcttgtatggaatacagtatggatactctagcaccaaaaaattatcatttgtaaatacagtcctggtattagatctgtaaatgagataaattctcaggcgttgatgtgtttggtattaagtaattgatgttatgagataattgctcatcaaaattttggttgcggccatatctagcagaaagcaccgtttcccgtccgatcaaccgtagttaagctgctaagagcctgaccgagtagtgtagtgggagaccatacgcgaaactcaggtgctgcaatctctttttttgcatttggtgacgatactttcatcgggatctagtccaaaactgctacatcttgtgttcgtttctgagagatcattctactcaatgcgacaagatcgttcggttaaggtaattgatgttcagtttttcaacttcagatttacggttgaaagagattagagaactatcttgttttgatgcttagatcgaagaaacagtccctagagctgtataggaaggcttagagctgtatcgagaggcacagaccttccggggatcattttatttgccttcttcgcaagggaatgacaggagtggagtctgtaagtaacctactagaattgctagttacattgaaatgacgaccatgaaataagcaaacaatttcaatagcccagtgcatgttcattctttctccccgtcaatatcaatgaatgaccaaccggatctccaccactaggtacagtctgtggtatctacattcttcttagttggcttcttcgagacgaacctgtacgaacttatagccatgggtttgggtgtgcctggtatacgtgaacaccaacgttgcaagtgcggaattatcaccaaaacagtgtaacaatttatccccaaagagatcaatctacttaatagatgctctctagcttgaaaaaaccctctggttgataatcattccaagttgttaaccagggaagaacgcatatatagtaatatgcggctcttttaacttaagttcaaatactcttaatattttcaaatttggtgttagatttataccaagcacaccgctgataccgaaccgtggtaaatgacgaatgcaaggccataatagcaaactcgacggtttcaccatatattggcttttgctttcgtcatacagcaccctggcccaaaaaagaaaagaaaggcggtataggccaattgaatacgccctatgaaatcatgaagatcttcctgctgtttttacccgtgagatgttgtaatatcaattattaaccttatttctgttgtcgtaataaacatctggtatagtgattggtcttttttgaataagatctacgtatgtactaatagtgctgttcctagcatacctacagaacaagtaccgtatctttatatgttgaaactctgcatccaacagtactaggaaggtgtacctttttcaacccatattgacaggtttcgtggacttaaaggtaccagttagtggaaacaccgaagaacgatatgaagatcaatttatatatcatttgacttgtcaaaattattctattgataacacgtaagctgagctaatatcttctacttcgtcttcctcatatctatcatattacaataaaggtcggcaggtttgaaaacgaactaaacgaactacagcagtgcccccacctccccctcccagaaaatccgatgcctatcccacaacatctcatctgtacacattagggtccattcaaaccatttagcttttatttttccgcgttactacaggccggtagccaagacggtgaattcatttcccttcaaatcatgaggtcaattacccttgcataagcggatctcagatatccaactgcccacatttgacatccaaccaacttcgggattctcccgattctgtctgctcgtgaaaaaaaaaaaaacttcgctatcgcgcactgatttctgggacatgtcctattatggcgggcgtggctatcccgtgtccgccaactttgtcaggctatagggtgcatttttttagaactataaaagataaggaccctactcaagtgaaaaccatcaacaaacaataatggtttcaattccttgcgatctctgcctattcgatcttgatggcacgttggtactcagtaccaaggctattgagaagggatgggaatcagtcttcagtgaatacaatgtcaactataatatggaagaatttctgcaaaacaaccatggtgtacgaacgggtgactcgtttgaccgttggttaccacagatagataacacaaattcgaaggcaggagatgagttcgaaaagcgcatttccatcgagtatgcagatctcgcagaacccgtgcctggcgcaccacagcttttgaattccatacccaaggaccattggttagtcgttacttcaggaactccactcttggccaatggttggttttccaaggtattagcaaaatttggcgtcacaaaacctgagatcttcgtcactggtcagtccgtttcaaacggaaagcctcatccagagccctacctcaaaggattggctctttggactgagaaatacggaaagaaacccgctcatcccatagtatttgaagatgccccaaatggaatcaaagcaggaactgctagtggatgtactgttatagggatagcatcatcatttggaaaagaagttttgcaagctgcaggggctacatatgttgttcaagatctaagccatgtgaagtttcacgacaatactttagacatcgataatttgtaatcggtcactcttccattatgcactaatttaaaatttgtatcgtaatatatatatatatagaatcataatccattttcggctaaatagcatcattgaacttcactgtagcttattggattcttaaggttgttaatcgacggaagtgctttttgaccactggcaactaattgtgtttgatggtacgaatcaggtacaactgtattgcttacaatgctttgagggtttgtagacccgttcattccaggcaaaggtgtggctaccagctttcgcaaagtcccagatctaccagtacgatcattagagaatagagttggttgctctactactggcaattgttgtgcaagtgcagcttcgttggagtttcctttaggcattgcaaccatgtaggtctgtggaaattgtgagccatcgaactgtggatgaatctggggttgaggatgctgctgaggctgtataaattgatggccttgagtgcttggaatttgttggtactgaggaatcataccgtgttgcattgtgttcacctgttggtactgagtctgcatgggaggactgctttggatatgcatttgctgatactgttgcatttgggctgtgtgattgttcatgtttttctgggagttagacatgggcactggaacagctgttgatgctgaagggtactgagcgtagtatgattggacgttgaggctgtgcgttttcatggcttgcttggctttacatgatggacagtttttctttgaagatctacgaggagtatacttgtaaccaggatatcgttcggcatgacgacgcttttcttcttcagcagatttattccagtaggatttttcctcaggagaaagattgcgccagcgacgtcccagctcgcgggagacctctgggtttgttctaataacatttccctcctctagaagggcctgatggttcttttgccggaatagaataaatgcgttgcggggtcttggaattcgattggtactatttttacaggagcatttttcatagagcttattctggtcaatctgaggaggttgaggtggaggtggcggagcaggtaccatctgcggatacacaaactgagtgctcataccttgtggatataattgtccgggcatttggggaaccgccatcaactgggacgcaacttgggaggcgacctgcgactcggtactgtagtaatactttggttcctcggggggatagttggcactaacggtatgaaagttgggactaccgctggctttaccattagcgttgttgaaactattagcatgactaccaatgtttccgttattggattcgtcattgttattatgaacagaagttaaaggagtgctagctgaggagctatgtttcgccgtcggaaccatcccgtttgtggttccaactgatgagccattttcggaggtgatctcatttttcatgcccatggagttcatgggcatgagatggctgagcggagggaggctattcgataccttgtccttctcgttcatcttcaaatggaatatgcggatatgcaaatatgtaagaaaaagagtttggaggaggatgaaggaatgaatgtgctatataaacaattatgtatgatgcatgtgtgttttgttgaatcaacaaccgtcgtttctttttctgaaatgtttactgcgatttagacgtatactgcatgaagtgtttgctatgcgccaaagaattgaggagacgttatgcattaaaaatgcatatttctgatttaggcaatatatgtgggttgctattggccaggcaattctaagcaaaaaaaaacttgctttacagtttttcttcaatagataagttgaagagaagtttcatagacaatgtaactaatattatatcatttttcagtcaaagaagatggggtagtgaagctgatttgatttgtctggtaccatcgcaccccctgggatttagcacctgacacaatagccttgcacattaatcttggtagaggctgcattattgttgtatcatacaggtacctttatgcaaagttatgtatactaagcaactacggtttaaacgaggtgaggaatgctagataataattatgagaaaaaaaaaacaaaaatcttggatgttgcttgcccttcttcgagaataatgctaagcagtgtcacatcatgtatgaggtaacatctgtgcatattgatgttcctttggtaccaatttcctaaggggaacagatgcgcactacgataatttgctcaagtgaataccacaattcttgtcccaatttcgtgacagttcttcgaaatgaacatttcttaaaagcgaacatttgtgagtattggtttgatagctttttccttcggatttcgccattttttcaatttttgatgcgcagatgaaccctcccgaggcccacggcaagtgaaaattacatcatgatcgaaattgctcaatccagcaactcaatatacattatgcatataccacagaatcactaatgcgttgcccgcgaattactttgttcaaatgagaagagtgaggctcatttcagtggatatctcggacttagagatgtttttcgttcacttgctaaacaataggtgctttaatctgtcccaggaaaagcaattgtgtttactcgattgtcgtgggaaagactttttcttttgatagtagagcaaaggaatgcgcaccctcgcgcaagtggcattcacataatgcagttactctcgcatgttgttttgtaatcgaacgaaagtgccaatgcagttccttcaatctagccaatttaccgattgttagagcagcaaaagagtggtactattgctctccgacttgaaattgaccactacaatatgtcttcttaacgcattggttactggatcggtctcgactcgtaatgtttaattccgtttgaattaacctgcattcaacaaaaatgccttctgaatgaatgaccagtcctcaacatgtaattcatgccgccgagaattccaaaggaggcaaattccaaatagaccaaatgatcgccgccattcttgaataatcttagctaagccttgtagcgggcaggactttctgacctaagttactaaatcaaatgtatggcgtcacgtagccccggcgtcctccggttcgcaggacccaaagccttcaaacaagcttaagtttctttgaagaacttttgtttagaaaggtatctcatctattctcctatgatccgtgctgggcagtcaatcttcttgtatgccaggttgtcatctaaaaataaacaggtatcccactccagtagacacttgatctggttcaaattcagaaaaggtgacagcagacattgttgatttcttcagaatactctccagtatagcctctgcaagaagagatgaatctctggatgcaatagttagctgtagagccttgtgtttgaacaaccttgaggccatctgtgttgagcaaggctgataaaattcaggaacatacccaaagcttggcactgtcacgtaggtccactatttttgaccgctaccaagtctccttgataaagcccttcgttcatggtcctttgaggccttagtgactcgtttgaacttgagttcctatccttactggagtgaaaaaaagccaagtgtccagtggatcagttttgccgagaacgaaacttgagcaaatacttcgcccacatattgcagacgtatattgaggcaaatatcacactaacaacatttttacgatccatctaaacctccaggctatccttatggcaactggttggacgatgaagacaccttggagactctcttggcgataatatcaagctgatcattgtatcacggtgattaaacttgaacctatcactttgcaaagttgtttctgacttgaatgaagctttgtccaatccaagctaagacaaaatccaacaatacatctgcgtagcaatcttgtcatggaacactttcagagttagatccatcaaacggttggcaaatgtgattctgtttgagtgacttctttcagcaatagcttctcatcttataagatcaaaaaggatctatacctgtggaatctcaaaaatagtttgaataccctccacatcttgctgctttttgcaaggatgctacgtatagggaagaaactaagaacctccaattgggttataggaatacaaccttccttggatattgtgacttcaaagaacagctgccctttcaaaaatcgtgcacagcttcattctcctttctaaaaaggaaacatctcattccagtcagtatgctattgtgtccagatactgctatgagtatttactacgttgataccacctgtagaagaagagaagataggtgaagagttttcatcgctgaatgccacttcacactatgtgtacaacgaagtaagtctcctaggtatgaatgaccattcagttttacgtcgaattctgacagtggacagctcttctcaagaggtttccctaaaagaaacccaaaataacaaccttcatgggtttcaacagtcatagtctcccaataatgactactgttcagtattcaaaagaatgtgctacacccaacagctgcgcaacaacttgaactttgaatttttccttcaacagccgataaaatgctgaatttctggggtgtgggtgtcgtccaagaaatgctgagatcacaggacagattttaagggcaacgacaacatcctcaagagccaggttattgatacaacagcacgacattcacagctagagcaacacgaagctttagaacgtgttctgggctcttaattaggatcttcataccaaacatggtcgtcctctttgctttcttcctacaaatcagatcgtggcctcaacattcatggacatgacttttctgtatttgggttgatattcccaatgaattgatctgccaacaacaaaacgtgatcttgctatacctgaaatgttgggcaaccagcaatagctagcaaaaatggatctggctatatcgcattcagttttatctcctattaaaaagttactgaagtcaaggataaattgtgtgacgcatcacagcgtatcacctgccttgccgttgcatctcagcccctagggtggttccagaaagatgcatgacggctagactgaaagttgcttccacagaaagcatatggaacggaacggttacaaatttgacgactcgaaaaccctgtgagccatcaatgcaggatttctaaacgagcctgtaaatcagcaatctcaaaccaaggacagaacaccaaaagctaccagcgtccaaactcacctttttgtaatgcgacaatcaatttagaaagatcgcaggcttctgctttaaccttccaaaactcccctgcttttgctctcatagtcttacgaagagtcaaagtgcggcagaaatgattccaaaagagggtgaatgggacccatatatgggaaggcgagaataggtcagaatcatcaccgacacaggtctcaacgttaaataaggaagtcaatcactttcggacagcctctgctcaatgactcagaggaatgtagtaaatattacactgcatcgaagagaaagaaaggcgaattgctgatgttagaacaactgtgagaacgacagaaaaagagggtggaatcacctcctggaatagtgggggactaaagaagaaagttcaagcatagtttacactctagggctgcacgatctactaacgacaagattaagatgataaaaggtgtaacaagaaaacaagagcatcgtaacacgcggcagaaaatctgaggaatgcaatatctattgatgtataggcgtaggccgtgttatttgaaacatctaatgatagacttgacaactctgacaaccagcttccaatcgatggaggagcctgaagaggcagattgctgttgtggtgctgattgttgctgttgttggttgtaaaccccagtaggaatagcatgggattgggcgtactgaggctccgacgactgttggccccaagacgcaggtatccgtgaaggttcacttaagtcaacttctatgactcctgcattcttcttggaaacctcatgatgaagcccagcctcctcacacaacttttcaacagcaggctttagtttggctactccatcagtagaatgatttcctttaccaacaataatgctcaaacgcttttccccacgctgtacagcggcactgattctttgtttgacaatgtactcagcttctctcacatagagtccgtgcaaatcgatttcgtggtcctcgctgtcagcattattctcgacaaatacatactctgcagcttgacggttgtattggtccgcctgtgccagatactccttagcttttacagacagctggtgggctcgttccccatcaccagactgatatgcctcctgggactgcttagacagctcggttcttcttttatgcgcctgatctgccaaaccccttaacctaacatactccttatctgaggagtgattgtagtcaacttgaccatcggctatggacggttagtatctaacactgaagccaaagatggctacacaaattacttacgtgatacatatatatcaggacggttccctacaactggagcgacactcatcagccttggatgaaagcaagatgtcgattaatgaatgttcaactgtaggaagaccaaaacactattgtcgcgcgaaatatccattccgtactaagattcactagcagcagcgttggagtactaattccgttttgatgcttgcattataatgaaatagtttcaagaaggattttaacgacttcttacgaacgcaacaatctgcaaggcgctatgaggtattttaacacgtagattaggatttattttgctagttacgggggagatatcattagttgaagctcgaaaggaaggatgcctagaagcgcaagtcgtaattacctgacggtgcggaagacctggcgttaagtttgaagaagcatcctaatttgtcgtcccacattgtttgtgtgatcctgtaagtgaatacctggctacgatcactttctcaggtcaaaatctcctctatggtgttgccctagagcaaatcacatgatatattttgtctttttttttttcccttttatctcgttccacgcccattttttttgtgttcgcgcgctctcctcctccatcctgaaaaatttgttcaatcttttacctgatattctttcccgtataccaacctattcacacaaaatgactccaaggtaagttaggcaacaagaaccctcagttcaagaatggtgactcgatcacatctttgccatttcaagatcaagaaatagctgaagtttgtcgaccagcttttgcagtaaagcttatgctctaacatgagaaatatgtggccatgcccaatttcttctgtcgatctcattctgcgaatgacggtgtcagttcgtagctcttcccatactaacagttttttccagagttcagaagccagagactttagtcaagaaggagaaagtcgatgagaagactgcccaagtacaagccgagtacgctaaggctaaggctgccgtaagtaccacaccaaactggtctaataattccttttcatgcctcagaagaccaccagcaagtatttgctgatgataccaatattcaatcgactagctttcgggcagtgttgtcgttttgttaaccatctttcgggactgaaagtaagctggtagtctgagaagtggaatcgaaatttgtagattgtctgaaattttgtttctttactaacatcatgtttctagttggacgaggagaagaaggccatcatttccgagagaactgccaagtactacgaggagtatgaggaagctgctcgtgttctggagaaggctaagagcgacgctgctgcctctggttcatactttgtcgaggctgagccaaacttggtccttgttgttagaatcaagggtatcaacaagattgctccaaagccaagaaaggttttgcagttgttgagacttttgcaaatcaacgccgctgttttcgttagaatcactaaggccactgctgagcttttgagattggttgagccatacgtcgcttatggttacccatctctggagactgttagggagttgatctacaagagaggatacggtaagcttaacaaacaaagagttcctttgaccgacaacgatatcatcgagaaggttttaggtcaatacggtatcatctccattgaggatttgatccacgagatctacaccgttggcccaaacttcaagcaagccaacaacttcttgtatccattcagactctccaacccagacggtggatggggtgtcagaagaaagttcttccactacattcaaggtggtgctactggtaacagagaagagcacatcaacagcttggtcaagaagatgaactaaacatagtcttaccaataaataggccttaatttgatatgtataacactattgttatcgcatttatttttgggatatccaatcgttgagtccgtacttgttacgagctatctcgatggcgtagaactgtagacggactacgaaaatagttccttcttggtcgtactctttggaactgtcagttctgagcaaggttccaaaattgaagtcgtcgatcttttcttcaaaaggtttcatgaactttctccatctctctttaccgctcagagatttcatttcgtcctcattgatcttgctggcatattctggattttcaaactctggaaagtccttcaataaagcctcaaaaatctcatcatcgtaaggagtaagcttgagttttgtgccaggaattttggtgagaagattccagtaagtttcagcttgtgtcactgccttgacagcaaattgcttctcaatatcgtccaaattttcagcttcttcggcgttaaaagtacttaaactcatagttcttctgatctggtatgaatggtgtacggaaaaagatggaacatgagagttttttgaaaatgtggagccagtcacgtgacccagtttcaatacataacctctcaagttgtgtagctcaattagaatttacgacggttggggtctaagatctgttgatcaaaaggtttccaagtagcaagtgctatctactgaacagtggaaccaaggcagtatgaatctgcttgctgaaatcttgaaagcctgataataagctgctgaacaacgtttggttcactttgagttcagctgcttcggtgcaagggtgactacagttaatattacggacgctcgtatgctggaatgaaaggtagtcttgtaaacatcatcaaaagaattgaagaggagctgagtgttttggtgaagacaagtttaaccttcggtccaagatagtttccacctggtgtagagaccactggatgcatgataccgttagtaagcggcaagagacggttcaccaaccctcctataacgctccatacctggttggtatttttttgcaatttacatgctaaatagcctacgaagaatgtccattaagtcagcaggttgtataatcatcggagacgaagtattgaactccaaaattaccgataccaattcccgatttttcgccaagtattgctacgatctgggggttgatcttagaaaaatatccataatttctgatgaagaagatgagatcattgccacggtgaaagagtttgactcaaagtttgatttcattgttacttctggagggattgggcccacacacgatgatatcacttattcttcaatcgcaaaggcctatggattgagccttaagcatgatcaatttgcctacgacaaatgcctggaaaagattggggacaaaattaagtttaacactttcacgcaggagcagattgacgctaacttgaggatgtttttactgccctatgatcctaatgattccaatttcgttaaaacatactacgcaaatgacctttgggtgccaatcgtgaatatcaacaacaaactgaatattctaccaggcattcctaggctatttcaagaactactgacggatggaattactccccatgtgaagccgtttgttcccaaaacgaagtttctgcaatactatgtggcagcccgacttccagaatctcaggtagcaccgttgctgggcagactgcaaaaggaagtcatcgagaaagggctaagtatcaaaattggaagctatcctcatgtggaaaagagaatcaataccgtctgcattactgggaaggaagaggagaatgaggtgatgcgacagttggtcgccactactatcgaagagttaggtggagaagaaatctctaaagaggaagaagagggccacagccatagccatataaaagagtgaaaataaaaatgtattggtatctataaattatttcttagcattttcaaaagtgaccagaactttcttcaagttagcatgctgtgtgttcaagtccgcctccagtttctcagatagggaagcaacctggcccagagttagtacattttcgtatgaagaatgggaaggtcctactcccagagaaacattagcgacaacattggttccagatggtaaaacatccaatttttttatcagtaattctggctggtgtttcattagagacacattgatagaattctcaatattaacgtaacgagggtctgtaggagatacagctttgtctataagctccttgaatgcctggaatgtacctgccaatcccaccttgatgaccaacatagagactaacagtcctcctacaggatctaaccagtaaatgttcaagaagtagccaccagagatggtaaccaaagctacgatggaagtcaggctatccacacggtggtgccatgcatttgcgatcaaaacttgagaatcaagtttttcacctaccctctttgtagccttgaacaaccactctttaacaaaaacagaacccaacgctaaccacgcagcgttgatatcagctacttctgtaacttgagttccttgctcatcggtaacggctgcgctcactgcatggctgtgactatgtgaatgggttaaggagcttaaagtgtccactatgctgtggggtaatgcaggcccaataatttctataagggaactccagccaatggaaacacctgcatataataatatactggagaccaacatggaacccaaagtttcgactttaccaaatccatatggatacagtttattagggacctgattactgaagcttaccgttagtagcgtcaacacgtcactgatcaggtctcccacagcatgtacagcatcggccagcaaagcctgagaatggaagtaaattccgcctaagaactttccgacagccatggaagagtttactcctaagccaatccaagtaatcctttttccctccttgctaagcattgcacgatctgcttctacgtgtccatgggaatgagaatgtgttaggctggaaaatgaactttccgtatgtgtctggctatggctacctgaatttggaccttgaagatgcgatatgggcaagtgagggttgaaaaaatctttcacatgactgaaaactgatttatttcgtttcaagggaggcaaaatctcgtcaggttctccttgactgggttgtttctctttgcccagttggtcagtatgggtttggttttgagtctgattgtggctgtggttgtgatttaaaagtatatcgtgatgaaaccagcgggtgtacatctggttgatgttgctagcacttatcccctgagaccttattagatttcgtctcagaagagtctggtctatcaccctaggcctcatcttggtgaagaatatcaagccaaggaagaaaaagataggagagagcaggtaccgaaaaattcgcgctcagctacatctacatgggtcaaagtttagattatggtctggcctgtctttataatgtctatagaaaactctgacagggtgctatacaaatatcaaccaaatatgtgggttgtaccgaatgaaatatgtatcgttctagcttatgctgtatcaagattgctcattttcaaccttaataggagattcgaaactgtcattttgggactcaaccttgattttagtagatccagtcccattggaaccctgcccttcttccgtgttttctgttgaacccgcatcgggcatggctccattttccaaaaccttgcctgcgttcccagccacagtactcttgtctagcgtggattgtttaacgacagatcctttcgatccctccttagttcttttcccaattaggtctccaaaagcttcccactctctttccatcacaaatggaccactaacgaacttgcgaatcaaaaatctagccctcggcttttcgacacccagtaaaagctctctgtttgctatctgcagaaacttgtacacttccagcatcaaaagtttgaaatggccaaacccttctggataaaagattaaagattcagaaactgtatcaagctgccttatctgctcaaattttggtttcttttcgactgccagaaaaaactcctcagtactttttctagactgatcgagatcacaaaaagggcaaacaaagatctcattgttcccgggtttgttatcattcattttgaggcattttaagtgaaaccactctttacattcgtcacattcaaccatgactccgctatctgcttctctgcaaaaacaaaacaattcactttgtccatcgtcaaggttatacatattaagatataagtttctccactgtttaaacctatgctttaactgctctttgttgatcttaagcacgttttgaacttgacttgcccattcttgagtttttttaacctgttctttaaaaaacgcaacattcacattcaaaccagaagctttctcaatgatttccttaccttcaaaaattttgggtccaaactcaaactcttttaaaaagatgttttgtttgcctgtcactttataagactctaaaagttttttttctttttcagaaagttcgatgttatttgccaatttttgttcggcagattgcttttgctttcgcaaattcttcaactgatcaatctttggttgaacagcctggagccactcatcgagtatttgctttctttcattcttctcagtgatgaatttccgtaggtcttcactttgaaccgaaaagcggtccttcctatcatacaactccttcagtttgtcaacatcgtagcccccgataggtttcaacttgataaattcttcaagttctttattgtaaagttgactgcctttaaaatacttggtcagtggttccaacttaagagctctatcatgttcgtctaaaatttgttcgccttcttgtaccaaatgttgaaggtcacttagggaagtatgcactgaaacgttttcagcagccaagtaccatttttttcttctgatgagtttctcaagacaatccaccgacggtaagttcacgctaaattgttttcctttctttaccaaagaatcaattacggaaatggaaactttttgctcttggtccaaaagtagcttgcgaaactggatctcaaattcttcaaccagctttccatattggagaagttcatcaatctctttggcttcaaatcttaaatttggaatccgcgctaaaagcagagtgaattcctccaggctgtggctagtaagctgatgtttgtcgaccaaaaggtctttggattcagaaattggatcgcttaccttaagaaatcccctgacctgatctaaccagtcgttagcatccaaaacaaaactttctaatgactcaaatccttttttagccttttccggtatgttattatggattgcaagtacttttttcccttctagatatagctcctgcaaaatggaaatatttggttgggagcttgctgtcaacttgtcttccaatttctcataccattccaacggtgtttggttgtaggttgcaaacaggcccattgcctgtatcaggctttcatctggctcaaacaagtgcagctccaagacagcattctgtttcaagagcgcattaatataatctttccgttctaaggctttttctaagggcaaggatatctctgtgttattgtgtataatcactatcttagagggaaaagaattttccaaggcatctgtgatgtaagatgacgcgttcttgttgataaattcattagttttgggaaaatgttgccgaacttcttttctttctttgagaactttattcagcaaaggtttatacatatccagtgactccttcaaaatagtcgggtcagtacattcctttgcaatgcttagtaacagctgaaacattgaaaataatggatagacgttttgctcttgcagccatttttcagcttccaatccttttgaaagccaagatggcggggcaaagttaacagattcagatgttgagaatcccaaaaatactgtagatgaataggctttgggaaatttgaagatgaattcacctggttcttggtaacatgaataaacatcaacgcccttctcctttaaaaattctggagttagaaaaaaatcttgactatacaacactttctcatcttgatccttgaggagtggttgaaaagcagcattcttgtgtgagaatctcctatgatttcttgaagtgggaattttattctcaagagtgcactgtacgaaatcgctatttttaaagtccttttgatatatctgaaagtctggttgagtctctgaaggtgtgttattcttcaaatgctcctttagtaatgcttcatactttaaatggtcttttggaggtataaaataccatactttagtgtccccaatgtgatggtaatcacacaagtaaaggtaatgatcttctgccacccagttttgagtaccaaacatcattccaattgacaatgtaggcttgctaatggaattgaactgaggtaaatatctgagaacggaactctgattttcaaaaaagttgtttaaattccacagcccatgcgtatcaggaggtgagccattttgattggtattctctttcacatggttctgcagcttttcattcttattaaaacccgactcatgaacactggttggtatccttactgagcactcgacctcataactgctatctttatctttaacaacagtccaatagagcttttccaagtcattgggtgtgggattaaaggcaactttgaaccgctcgaataataactcttgaaacttgagattcttgtcgaaaaattggcgcaaattatagaggggagagagcttggagtcatatgcagatacatcgtccacattcatacctttgtgccaattgtaaaaatcgtacgtagcgagagtttgctcatcgtcaaaagtgataccactcctattgtctgtcatcatgtcaaaataggtagggaatcctaatttttgcagtttatctcttgatcttttatattctatcgctgatccaattataatgggaatatcctcggagctttcgtcagtctttaatttctttgtaggaggatcatcagtggaagcagtttcgtgtttccttgacccactgctgccgttttgaaccgaaccattcacgggaggaggagaagtttctttatctttcttataatcaacatttttctgttcttcttctagctttgcaatatgtaaatcgtacccataaagaaccttgtgataggcacttttaagtgatgaagataaagaactggtaatcttaccgctgtagcctaactcacgaccgatttgagcccaaagtttcttctggcatacagtatcataccccccacgaagcttaacgcagactctcaatcggtaaagatcaagcgaccttttatctatactaggtagcttggaaatagtgattttattctctctgagaaagctggctaatgattgatgaaactccattctggcctccacttctgacttgtggctgttcaacagctgccggcgggccctaaaccaaaaaagttctgtgtttatattcagtttatgttcccagttttctagtatcacacggactgccccgtatttttctccttctgcccttattgattcgatgaacttgtatggattttccatctcttgagaggatatggtaaatgtgggaataggtggatataatgggtttgttgaagagtgtgtacttcgtcctttcatgtttatgctctctaaaggtggattggccctggtacgatgctgtggatacaggtatggattatagtggtgagttgaatttgaatccgagactcgataaccgtcagccaacgtcttgtagaatctagttgtttttgggggagccgttgtagaatgtgtgtagaatgttgttggaccactagaaagcggaggactgcctaattcagaaccatttgaaagtggaggctcttgttcatgtaacttgctggaacgtgatgtattagtctgtgaaatgtcgtccgaatcggcattcggagctgcgttctgctttgaaaacgaactgggcgagctaccgggatcaaccttgcttgtctggctattttctatgtccattatctacacacgggttcatataagggcagagggtttgatgctagaagttacgtaaaaatggaaactttgaacggctctttcaattcgagggatgttggatgtttgacgctgacggaggcggggcgggtgtctagtgtcatccaccatctacccaatgggcaactaaagctttcatttctcattgggcgtttagtatgttgacttcttctgagtttcgactgtattcttcaagttcacggtttctttctccgtgacttattcagccagtcgtgtaactaggaagattaatacctcttcctacttttggtcgagcaagtactatgacattagccttcctcttccctcgaaaaaaatcattatttctacctagcaatacaatattaacacacttcaaaatctctcatctcttttaggacattataatcccgcaatacaatgtcggattttcctaaagtcgaacaggcttcgccgtcagaaggaatgccgcaagttcaaactaataacgcccctgagatagaggaaattgaagatataattagagatacaccaaacgtaatggatgtgttaggaaacggaagtcaaagttgggacggaacaaatagtaacggggcagcaatgggctcattggacactgtgccggccaacaaactggtagcatacaacaaatatgataataatatctacccagatcctttacaacctctatctgatacagctttacctaattctatgggttattatagcatgataaaagctggtgataagggtctgaaacctcaatctttccggaagaccaagaagaaaccaacaccttctgggccaaagacaaggcctgcatttgtgatgaaactctggaacatggtccatgatccaagtaatcaggcttttatccgatggctaccagacgggaagtcatttcaagtcaccaacagggaagatttcttgaaacatgttttgcccaaatattttaaacacaataactttgcaagttttgtgaggcagcttaacatgtacggatggcacaaagttcaggatgtgggcaacggctctttgactgccaacgaagaattgtggcagtttgagaatcccaatttcattagggacagggaagatttgctggatcagatcgttcgaaataagtccaagccaggtgaagatgacgagaacatcgattttggacttgttttgaatgaattggaaactataaagatgaaccagatggcgatatctgaggatcttagaaggatacgacaagataatgagacgctctggcaagaacactaccttgcaagagagcgacacaagacacaggcagaaacactagaaaaaatgatgcgttttcttgcctctgtgtatggcaacaactcaaagcttctgagtgaacctaccaacgatgagtttcagaagtcttccggcgctcctcaacggcacgatacctcaaatatcagcaaacctactaatgccgcctctaagaagttactaatgttgacggaccatgcacataaaccatctactaatggctcatcatctacctcgggagctgcaactggagatgtgacacctacagttctcccatcacacaactcttcagtagcctcacagcacccattcatccaagagattgtgaaccgctccaatcagaacttggcacctattaactcaatgccatctcctggaacgtttttcccagaattgaacgaacaactaaatgagtccgcttctcagaaggtcaagaaccacagttccatgatgcaaaatgttgaagataacatcaaccagcagggcgaatcaattaaacagattcatgagtggataaacaaattagctcctactagttcaaccaccaactctaagaagacagacagcgatgcaattgccgacgatgatttcgatgtaaacgacttcttcctacctcacactcctgtggacgaaccaggggcaacttccattccaattatagaagagctcacacctacggattcacttaagagagaaaatggtgcgggcgaaggagataattctgctagtaagagggctaagaaataggaatcaggaaattataggaacatagataaataggtattacttaattactcctttagatccgcagttatcaatttcatcaacatgcttctcggcgttcgcgcaattctaccccaagcccccattagaatattactactcctattacatccccagatgacccaattctctacgaagactatacagtggcaagatgatctctaccatgatcaccatgtcaacaagattttaatacagaactctaatggaccttgttttttgattgcgcttgtcaattcgttgattttggcctctgaattgactttgaatggatggactaacgttggatctaaggcaattgaagcatcccatgtcaaagcagagcatttggttcctttgaaagagctcctcaccaaaaatgtcgtacagttggacgaactactcaacgaaatcaccaacttagttattcaagtagcagattcggacttcgatttaagccctttactggagtcacttccaagattacacacaggactcaatgtcaatccaaactttttgctcccaagaattactagtaagcaagatggcaactcaaaggttttagatattctagaattatttaatctagaactgtatcatggttggcttattgatgagcgtaccccgggttacgaattgcttagtcgattaggagactacgattctttacaaagttacattttggaaattaaaaacgccatccgtgattctgctctagtggataactatgaatatgaagatttgtctctcgagcagctggatcatctgttggataaatcagatgatgcacgtctcaagcaatttctcaatgagtaccaagatatacaaaattttctgaggagcaaccgaacagagttgtcagaaaccggcctttctaggttaatgtttgacagtcagaacactattaaaagatcctcctttgcaattttctttaggaatgaacattttaataccgtttacaagaaccaatcggattccctttttacattgttgatcgatgagggatattctaagagtaagacctatgtttggcagacattgtcctcggttgacgggtcgaatgataaattattggatggaaattttgagtttactatagagcaaatccaacccctatctcaagagccaatttctattgatgcaacagattttattatcaatgaagaagaaatagaaacggcgaacgatgatgaagctttggctaagaagttacagaaacaggaagacgaaaacgcagcgagagccatccagaaaaagtacgataagcaggcaaaaacaaaaacaaaatcgaagaccaaaagcacgattaagtcacaacctggatcaagtgctgatagtaacaacaaacgagataactcaactgctgcaggtgtgaaaaacaacactgaagataagggtaaatgcattgttatgtaagttctagattaatctttgatcgtcaatttttggttttggtttcactcgatttggttgaatgattcctgcggagaaaccgggtggcagtttttgggcttctggctctaaagttgcatttctcgatgcactccagtcaatctgaggtgtcgatgcagggattggagagttagatacagtattcctaatctccagcgtcccattaggatttggtctatctggcctgagtaccaatggagttttaggatttaagatagtagatgtgggcggagtaacgggaacgaagttcgaatgtatattttctaatgttaaattcttgttttgtgttgaacttcgtaggccatcttgttgagccaagccatgcctttgcttggagtctacaacattactgtcaaaatccccgaattctgtgtcatcctgaattctttgattgggttgtgctttcttgggtatctcctctggcaagcttgaaattgcctttgaaaaaacaaacgcctggatttgatccaaaatgctcttcaaatttgcagcttctttcttgtccggcacatatctaagtagcttccacaattcaaaaagaactcgttccatgattactcccaaatccattttttcagaaccaaaggatgtcaaagtctcagatagtttgacaaacataacatgataaagattgatcacgtttgacaagatcgacacattgttgaagttttttactgatgttgcttgcactattggcaggatcttttcaacaataacaaagtcatccaaaggattaggctcaaatgtgatgagggttataaacgcatgaattgtcaaattcttgactttgaaagaagtagttttggcgaattgttcagatatcattggaagaaatttctggcttatagtatggtaaggctgatacttgatgaaatcgataagggtactcaatactgcttcctggggttcaatttcggaagtgtccattgaattatggaacaaggaaacctggaatttagtgtaactatctttataagaggattgagaaggaagacccagttttgactcgaccaaaggtattccttttgccagggctacatttgctgaagccaaattaagagccaagacttgttccaaatatgggaagacattttcagaaaacgatagttgcgaaatctgtgatgaagccagaaatagattctccagtgacaaaacaataagacgctcttcctctgcagacaactggaccttaggagtttgatttttctttgacattgaagttgaaaggtagggggacaaaagtgtagacgtcaataatggtacaaacttattcaaaagtaacgtctttggaaactgatgtaaatgagctttcaaagttgtcaagaaaatacacttttcctccacggtggcagcctgaagttcatccacaaagtttaatatctttatcaactcactttgaaatatctggtcggagatgaccgtgtcgatggttacagaatcttctagctcaatagcattatcgctcgtcgattgttgattcagaagaagaatcatcagatgtttatgattctgggggatatgacgaaattccgggttgtttaaagcagatgaagattttaaaagatggtttaacctcttaatctcggtttcataatcctgaaatgtgttatcggtatgcagtaaagatttagcactgaataaataatgtatcaacaacccaagtgaaaagagatcatttgaataatccagcttgtggttcaaaattagattaggggaactgaatctgaaactgacattcgtgaacatgggcattctctgatcgaaggtatctagaaaaaaatccttagaactatcacatggttgtatgaaagaaaagccacttaacttccaatcaaaattctccgttatcaggattgtgttcggctgaatattcaagtgacaaagattctggttctcatgaagaaatttgacagcattcgatatttgaagcagtcccttcgttacgataatctcttcaacaggggtatcatctagtctctcttttgtgaatgcttctagatcactgatgacgtattctgtaacaaataaacacttggacttgtgatcttccatcggctccaagacattcaaaatgtttgggtgtttaaacttcatcagattggcaacgtattgttgaagcacgttgaaacagtcattcagtatttgctgcttgtttctgttattcaataatccggacctggaaagattactttcaaactgctttttgttgaaaatgaacactgagcatttctttttagtacttttgttttttgctgcgtagacactccatggaccgtttataaaggtagggttgttggagagctgatgatttccttctatgcctgaggctttgaaaaccttgaacatgtccaaatcgaagattacttgggagagtgttttgtaatgtcggtacggtagttggtccagtttcttcgatatcggaatactcgcgggtgacgaacccattggtactgcttcaaattttcctgtcattaaacacttctacaatatatacacctagcctcaaaataatatagcctcaagtcagcataacattcatatcccagtccctgatcacatcaatccaattactcttcttctcattaaagttcttacgacgccacacctccaacataatttgacgtgcgacccagtaggttccaatcccggtcttggagatgtctgtaccccatttcttgaaaccattttgtagatatactgtcatcgcttcacttccggcaataaatccttgccaaaataacggaataatcaaaatatctttgtcactttgtacgatctcctggatcctgttcaaatggactagaactttctcaacgtattcctgaagataattcggattgatatcctcaataaacctgtaaaaataaatcactaatccatgataaaatgacatcacatgatgataaatcccctcatgacgtgcagaaataaacttttcagagtcttcctgggtagtcagcttccattccaacttccaatcggaaagtttggtggacagctcgtctgctagtaacttaaaaaacagaggaagctgagtcgaagtagaatcacaatacaccttgaatcggatcaaatgaacgacttcagaaaatagcaaaattagggaattgggtaatccatagatagcatcactggaaatgtcatgatcgtcaagtttgttcttagagggtttgaaactggccttcgttatgtcaataaacagaggaatttgactatcctttctctcgtttggaatctctcctggagattccgtattttgatcatgaacaatgtattcaatacgaatctttccctgatcgttaatcttttcatgaaaaactcccttcgaagaggacgtagaagacacatggttactactatcagacaaaagagaggacggtgactttctaaatagcttgtcaattcgagatccctgattcgactctgcagagtcaactcttgaactagtgataaactgtttgtaattgctttcgttcaaaaaaatctcatccttggaaactatctccaaattcgtcgagtcttgaatcaacttcattgaactgtagatgcggtgcaaaatcaaggccttggctgaaagtttcttcttgacagtcattttcttctcgataatcttttcacaaatgtttaaatgagtcttgcagtcagacatcgtaccccatacaacatcaatcgtgaccattgataaaacggctactagaacgtccttatacttctgggtaaggacatcttccatcaaacaatgttttaaaaacacagaggcttgctgccgcaactgaatccctaagttaacgtaatatttcatctcgttactgtttttaggaaacctgctttgtaagttaaaagcactcacagccaacaaagcattcaataaacagcttcgagcataagaagtctttcctaaagatccaatttcaccaacagccatgatggccctgggaaagtaaataaacttccaagggtttttgggaagaggaattactgtcatcatatcagccacatcctcgatatagtaattcaataagtagcgtgtcattgggttaacctgcaaggctgtagtgggcagtccgcttttctcgatggctagtgtttgaggcagtcccggaactgttctggcttccattatgttgcctggcatcttcgaagtaccatctggggcatccagctgaatgctgtcaatactgaatttcatcttctttgctggaggcagatcttgctgagctcctgaaataggttgagacgcagatgctgacattgttgaggatctgacgagtggagaaccgttgctatctccaattagaacaccatcactcccaacatgcactccatgaggttcttcttcttccttgcggtgaaacaaaacattgaacatttcatcaggagcatactgtgaaagatccttatctcttctagatggatttggatatatcttttgcacgtcagcattgtatccataaaaaggagttgaagaactattggtattaacgaggggatttagtgtatcagctcggaatatgtctaaaaaatgagtgtctccatttatggcggaggctgtcaataaagcgtcgtcaatcaactcattactgacccattcattaccttgggtaaatcctgaaagtggatcaaacatgctgggagatccaaacggtagcttctctggggagaaagatacatctttttctctttttctcttctgctgtctgaatacgccaaacatgccttttattactgtgctgtctctgtctttttctgtctctaggcgataggagtgtaagccgtcaatatcagtatccaactgatcatagtctttataagcttgttttgcattgtaacgaactggctctatgtttcgccgcctcatagtttcatcatcattgggttcaatatttgtctgagacagctgtgatccaaacttgtcaaattggactggttgggaccatcgtagcttgatatcatacccggtgcagtgatacccacctttgatacaccgatcgcactcaggcctttccagcgtacatttcactttcctagatctacaagtccaacatcccgtgaaagtcttttcccttttgggcggcattacagggatggatggatcccggtttattgattattagggaaggaaaccaataaatagatgagtaaaaaaaattaacggaaagctctggcgagatatgatctcagataaacggccaagagtaaaaaagaaagtaggtgcgagcatacactataatctctaaatcttcttactattgaatacaggtacagaaactaaactctacagaccagctactccttctagtcaaacttgatcttcttagccttttggttcatatcaacgtccttaaagaaagcaccataaacactgtgttccttcctcttggtgtggcccccaaacttcagcagctcttcaggaactggttggttggcacccctaagaatattttgtaaagctccacttaaatgtttttcgtgttcagtgaaaagggtgtgagcaattccggtcttaccagctctaccggttctacctattctatggacataatcttcaaccgttagtgggaatgtcaagttgatgacaaccttgacgttgggtatgtcaagtcctctggcagcaacgtcagtagccaacaagaggctggacttgccagtcttgaaatcattcaaagactgggtcctttgctgttgtgaaaggtctccatgaatcgcagataccttgtatcctttatagtttaaagttctctccactcgtgtggcctccttcttgtataaggcgaatattagaatcttgtcgtcatttttactgtacttagacaacaattgaagtagtttcttttctttgtcgtaagggtcgatgacttcaacaatttgtgtaattttcttattggctgataactcgtctctgtccccgacggtgaccttaactggagatttcatgaaatgacttgctaactcacgcacctcctttggccaagtggccgtgaacatcagcgtctgtctgtctgtattaacattagccatgattgatttgatcgcttcttcaaatcctttctctagcatacggtcggcttcgtccaaaaccaaatagttgattcccgtcagatcaatagatccctcctccatcaaatcaagcaatctccctggggtagcaattacacactgtgattgcttgacttgtctcctttgatcatctttggagacgccaccataaatacaacagcattcaagtccacacaaatctgttaattgtttcaagttgtcgtagatttgtactgccaattctctagtgggagagattaccaagacttgaagtcccttggaattcttttgtagaacatggctaatagctggaacaccgaaagcaaacgtcttaccagacccagtttcagcaacaccaatcacatcgtttcctttcaacaaatatggccaagaaacggcttggatggtagttggcttgtcgaactgtgaaatcttgttcttgatcttctcttctatgccttgcaacatggaaaaattcaagattggcgatacttcagcattatgaggatcatcaatagaaatttcgttttccttgaggtaagcgtctatggtggcctggtctacttcagtagctggctgaggagtttcattgtgatccttttctttcttctctttttttctttcttgtctttcttttccctcttttccttcttttctttcttcaccttcttatccttcttcaccttcttctcctttttctccttcttctccttctttatcttctctccgtgtgatgcctttaattcggatcccattttttacagacttgaaaatttttgatgaagttcccaaaatggaaattgagatgagctgagaaattcataccacccatcgcacacacaatttgcatccctgctacacaaaaaaacgacttgcaattctgccacctaaacagttcagtactacggaccttagtagattgccaattgttgtgcttgctccgcacgattgatacctcatccaccgatactctttgctagtcatatatcccttggttatcagtactcctagggcaggtcgcgagcaacacaccatccataaaaggtaccctatatccatttcttggcctcctcacgttccaccgattttgatcaatatcctttaaacagaaaaattgcttacggaaatgtctaaactcaaggatagcattaaatcgctcaaatccacaaccagagaagagcctcccgactatcatccgtttgacccgccgttgacaggtctcgaactcaacgggtacaagaataccaccaaacagagacttttacacaaagaattggcagaagacttacggttgcatcttccagctagattacaagtcacacacaattggaatcttctctattctttggagcaagatggaatatcactcaacacactttacaagaaaatgcgtcccctgccgtcagaaatcaataaaaggtacggatatctgttggtcatcagagatagtcatcacaatgtttttggcgcttatgtcagcgactacctgaggccaattgagaggaaacagtattacgggaacggcgaatgttttctttggaaagcagagaaggatactgtcccaaatctggtggacctgggacggcaagaagagcttgatgtgcaatatcggctaaaggtgttcccatatacatcattaaacgactttattatctatactaactacaacagtgtctccattggcagtggagatgggaaatttggtctttggatcgacggcgacctggataaaggtgcatctgacccagtggatacatttggcaatgaaaaactgagcgatgaaagcacctttaggatcttcgggctggaggtttggagaatatgaatttaaattccaatgaacgatttaataagcctacctaggaagaaaccatcatcctcatcttttcttttcagggcatcctcgtataactccttgccaacgatgtcgatacgcttttctaacagcgaatactccacctctgtgggaaattcgggatgtccttgaaatgtgaagattctgtcattgataaggccttggatttgctggtttgaggttgagccgtaattgattgtctccactggaattttagtcaccgcatcttggtgatattctgagaccaaaaagcttcccttttcggccagatctttggcgactttcttactgttccctgtcaatgtctgaatatgaccatctgtcaagctcacttgaaccttttccgtcccaatttcccagcccacttttttagctgttccacccaaggcaattgcaataatttgatgtccaaagcaaattccaatcagaggtatcttgtggttgaagtaaacgtcttggatgaaggctataagtttttgcatccattcatattctgagtatctccatgaatcgtatttcgatccggtaatgtagatggcggcgacattctgcaaggagtcttgcgagggaaattccatattatcgatgacattgtattttctcagttcttgatcgacaattccagctttcctcattagaagaatccccatatcaccatagtctccataggctaaaagatcggggttctgctggtccagatttaatactgcaatgaacgtagattttgtcatttgtaaagagagaaaggatgagaattatcttcttagaacacttttttttcaactacagctattcgttgcgaaggacactattgataagacaaagttgctaggtaaattatgcaatatcgtgccgccgtacgtcactcgaaagggaatacacttgcgccgttttcggagtaggttacgacatatttaggttgaggacaatctccctacacaggttttctttctataaatttggcatgctttgagttttgggtccttagaaaaatgcccactacttcctgctttgcacatggataacgacgataagaaggctgcatagttcgggcatcgcacgattacaccttccacttttggccaagccgctataacatccgagccatcaaacatcatccgcttctctcttttttcttacttctttcggagagagattcgcggctacgccatctcatccgacaatcgcagcagagcttaccacttttctgcttccatttaaacccatgatatccaacctctcggcaggtttacgaaccataaacttgaacgatgaaaaggcggaagactctcgctctcagcaccagcagcagactgtgatagatcaatccagagctgagtctatgaactcaaagtctcaagactctggcaatcgcataactcaatacttcactaatttgcctaaagaaggttttactttattttcacacagttctgcgccaaacgggttcaaggtggcaatagtactgtcagaactgggatacccctacaaaactttattcttagatttcaataaaggagaacaacgggctccagagtttgtaagcgtaaacccgaatgcccgtgtgcctgcactaatagatcataactgtgacaacctagcgctttgggaaagtggtgctataatcctttatctctgccagaaaagcttaagggagacgggagtttgcgatatttactcagataatccccaggaccaagcccaaataaactcctgggttttttttcagacttcgggccatgctcctataattggacaggcattgcatttccgctactttcatgatgtgaatgttccatcagctgtagagcggtatactgatgaagtacgcagagtctacggtgtgctagagatggctctagctgaaagaagagaagcacttataatggagttagatatacagaatagtgctaattactcaaatgggactaccccattatcacaatcaaagtatttcgatcaccctgtgtggctggtaggtgattcaatatcagttgcagacctttcgtttgtgccctggaacaatgtggttgaccgaatcggtataaacctgaaatcagaatatccagaggtttacaagtggaccaagcatatgatgagacggccagcagttgttagagccctacgtggtgatacatagtcatgaacgataatggaaaaggaatagcttttatgatgtatatgcaatataatttagagtgtcacgttctaggtcttttagcaggaggcccactgctctccttgagtatatgtttatttaggttcagaaacgtgtctaacgattctagtggggaagcaataccatttgctgttgagaactcaaccaaagttgacatgatgctgaaagtatcatataactgcaacaaagaatgaaactttttgtccatatcaagtgtattctgaccactcgcatttaaaacttcatctgcaatcatttttatcattgagctttgcttgttgcttaatacttcttcctccagtgcaaagggtaaattgagctgagattctgtttccaagtcattgtgtctctcagccttcccgctttctattgtactgcgcttcaaacatttttcaaaggtactataaagtgatttcagatcaactgctcttgaagtttcaacatcctggaactcgaacagatcaattttcagctgttgattgtacaccaccctagcgatacctgtgatatcaaaatgtgacccgtctttgaatgtatactttaaacaaaacttccggctttcaatgtacgtcgacccattggctaaaatttcaaccttaatcaacaggggaaaaatgtccacggactccactcctgggctaatccacccggttacaaactgagggatcaggctggtaagcatttcaaaatgccgtaactgtgggatagaatcaggacctccatttggtgtgtccgaacttttattgtcctttttcagcacaaaagaaatagttccttcgggagtaaagtagtcttcgctgaccttttgccaatactctttgtcatgtagtttggacctcgcaccagccagctcgcaaaattctaagaacttgaggagcgtaaagtttgaaagttgtcttttcaggttcgtattcagctggtactgtaccatattgtggcgcctcagcggtggaggaccctgagtttgctcttgctggcctgctgttgcgttcggaacattaatatgaggttggactgcatccatagaggcaggaatttccattcctcccggaggataataaggctcacgaacaggtatcatgccaacgctggtgtacgttgtcgtaaagaaatggtgtgcccagctgacaggtgcaccatgcgcgacattgattgcgatagccagaactgacattctcaagaggttggatggaaggtaatatgtagttgtactattgctgccctttcagtatggtagaacgctccgggctctattttttctctagtcgcttgtcaagtatccaagaggtggagcttattcctgccggaggttgcattgtcgaaatcaaaacttcgttgcaaatttgcagcatcaatttcccgacggactaccattcacatctgatcttagaaatcatcgatgacaccttagatagaatttgaaaatgtgcctccaagtgaaattaggcctcatgtaacattgtattggatatttaccatcgtatataattacttggacgtgccaggaattccataccgaataataacctgctcatccttagaagtacatgtccatctcgataacgcaggatgaactaattggggcctcctaggccgattcaatcttttcgaaacttcgttttcatcatcatcaaactcatctaatgattttttggaacgcactttggaggctcgttttttaagcagtttattcaaggtatctctcttctcttcttctagccgcctctcgttaaagttcttccttttccgtgaattttcttctcttttgagtaaaatctcttcctctgttagctctttctttttcttgttggttgggagctccaagaacgattgaggttcttcttgttccaagaacttggctctttgtctctcagtcattttggagacgtcagtgggctctcccaactgcggcgtctcaaagttatcatcatcatcatcgtcctcttcttctacttcttcctcttcgtccaattcctcgtcttcgggaaattcgtcatcagattcattgtagcttagtcttgtcttagctctcctgggttgaagtttaacgaccaacgagttctgttttgaacgtggctggcttgttatttcggaatcaacggtttcaggttgagtacttgaatcaaggtagtcgtcctggtcttgatcgtgaatattatcatcatcatcgtcgtcttcatcatgtccgtaatcgtcatcttcctcaaaaggggtgtacccattctcttgaatctcgtcttccagctcttcatcactacgactgcttatgtttccatcgctgatttctgacaactcactaatatcttcggaagacatggctgaggttggtggaaaggcgtcttggattacgtacttgatgctcgaaaagaatcgaaattataatgaaaactactgtcattatagcttaataattataaaagtatgagatcagaagaaatgagccaatgtgccttccaaggtggatatgatagatatatgacgtagttgccttttcttccattggatattcccatttagcagttatctaaaggaccatcgaatggaaaattacaacaataatattagaaattactaacctatgtaacttttaagatccagcatttgcccacacagttttcttcttctttcagatgctgcggcaatggtttgcagtaagaccgcaaacggccgaaatggtcaccaaaactggaaacggcacttgaatgttgttctggctttgccctgctcaatttaagcttaatgcaccttgtaagcatgcacaacacctaaaaaggcaatcccccaacgcgccgtatccaagattatgtagatatgattcataaacctgataagccatacgaaatatcatcttgaaaaacttagatttcgccatataaaatcccaggcaaatacctattcttcatttataattcccctgttagctactagagatgactaagcaagttgtggctgctctacaggtaggttcgtccccaaaaggaacaaaagaaactttgaagaaaatcctctcctatgagcaggagatcaaggagaaaggggtcaagattctagttttgcctgaggcaatcttgggtggatatccaaagggaagtaactttggcacataccttggattcagacttcaggaagggaaggaggcattcaaacggtatttcaaagaagctattgacttggatggagaagaaatccgagagttggctcaattaagtaacagaactggtgcttttattacagcaggagttgttgaacgtgctggaagcacactttactgcacaatggtctatattgatccggtgaagggctacgttggaaagcaccgcaagctacagcccactggaaccgaaagactcatttggggacaaggagatggctccactttgaccactgttgaaacttcagtgggcactttaggaggcgccatttgctgggagaattttcttcctttgcttcgtcaagcgatgtacgccaagggcgttcaggtttgggcagcacctactgttgatggccgaaagatctggggtaactgtatgcaaactttgggctacgaaggccgtttgtttgtggtcagtgccgttcaatttatgcctcctccaaaggaaatgggctacgagttgaaagattgggacgaaaatgagaactgcatcaacggtggtagtttgatagttgatccctatggtgaggttcttgcaggtccttttacaggaaaggaaggattacttcatgctgaaatcgatttggataaaatcattgaagcccgttttgactttgatcccgtaggacattatgcaagaggagatgtatttcaactcacagtcaatgagagaagccgagatgttacctttaccaaataaagtcgttccttgggcggagaggttattccggccactgaataagtagtaaagtccataaaaagttacactgaatataagtattgacctcccaagtgggatcaacatgactcataattatgtccgctgtttgcactctattctgtaatggtcgaagatatctgatgtctgtatgaatactcaaatgtaaataagagtacaagatcattggataatttattgtcagactttcatacgtaagattgtactccctgctaaaccgtatgcacaatagaatagtcaaaagaaaaaaatataaatgttactgttaaatagccaaacagctcgaaattctcaagctcgtccttattagctcagttggtagagcgttcggcttttaagtcaaacaaggaaccgaaatgtccagggttcgagcccctgatgaggagcttcttttttgtttttctagctctggcctaactgaaagcaattatatatatccagtatttataaacgttgcttcccatctcatctttcttcccacacctacacaatgtctttatttttgaaccttgtctgcggcctcatgtttttcgaaatgggattgttctctgctatgacaattccatttcccccaaagattagaaaacccatactcaatatcgtgtcgttgcccttcaaatcgatacatttccaggtggcatataaatgtattttaggattcattttgatcctgttcatcgattcagtgaataaagtgatcaaagtgagcagtgacttgacttcgtttgattctgctgcctcttctgccctaggcaacaattcagttgacagaactgatattttgttacgaagattttatgctcaaagaaacatgtacatatgcgggttcactttgttcttgacgctgattctcagccgaacctatgctctggtcgacgaagtaatggttttgaaggaacaaagatattccaaggttgctaattcagcagacgctgctgatccagacgaggtgagtaagttgaaagctcaattgacagagaaggaagaaaatatccagattttaaagaaacaagctgaacacttgagtaaggactacgaggaattgattgcaaaaaaaccaaaaaatgagtaaaaactctgctaccaaatctcttatcatatgtgttcattttacatctcagtattatccaatccaaagctttagtctagcattacagttatttgtatagattttttagtgcttgaatcgattcttcgcatcgtttatctgctccaaatgacatcttctttccggtgttcatctgcttactcaaaccttcactgaagtaaagcttgatcatctgagcattttcttcatacgagtacctgttctcgcctcgggaaacctggtcaactatgcctttatcggtctttttgaacatttcatagtagtttatgcatgaactgaagttaatttcatcgggatcatcaacaagtgttcgtaagacttgttgcagaattatgatattggagtaaagcttgccaataccatgttcgtttaaggccacgatatcagaagctcctttaataaacagcttatttgcaaaggacgatactccctggaagacaaacgtcttataatcccgattagtcagtagatgatcgatttgaagtattttcttattcaatgattcaatcagcaaacttggtcggtttctctcataaggaagcagccaggtttctgtgagaaacatttgagatacaaagtacccaattttcaaccttaaatcatatcggaggatcaacttaatatccgtcatcaacttgtagaaggtatcaacctgtgaatcgaattctactaccgagtctttggagaacgtcagcagtacagttgaaataggggaaccctcaagaaataaccatttatccttcaaaaagtctaccttttcatcattgtcattactgtgatcctgatttaaggaggaccctactctcctcataggaagtagccactctagcattctatctatactggtcaagagtttgataagttgagtgagctcttcgtcagttaaaaaatctcttgtagtaacttgtcccataaaattgttggatagtagaatagatgtttctgctgcaaagtcttggatcttgcttgcgtttctcaaagaactgttcaccactaactgcacagtctttgtattctttcctgtgcctccaaaatgcttattgaagcactctgagtaaaggcttgacattttatttaacaatttcagaattattctcacgtattctgacttgtatataattgatgtgttcagaatatcacaaactttgctaaaaaaagttttgaaaacattgtgataggactcagtgtcaactgtcccatccttgaagagagactgaaagataccatctaacaagtgctgaagtctaggaagaaaagcagtctccataaaccgatcacaaagtaatgcagggtcaatcttctcattcgcaacaatggaaaccagttgaagtgataaatgaataaactgaaggagattgtttaagatgacactcatattgaacacatttggaggtattagtgtagtcttgttcactgaaaagtcatctttaatgtaaacagagttagttattggatttttcagatcataatttgggaacaaatcctgtagaatagattgcagatcaatagagaatgtttcagctttggtgttcttgaaatctaaggaattgaactgaaacatgtgtttgtcattgctgtgttgagatttgtcacttgactcactcttgctgatatacgctaacatcaaattactaatctctgctgaaaatatatcccataagtctgaaaattgaaagttcaatttgcagttgctgttttctgagactatttcactgatcttataagtgaccagtagaaactcaagaacatggcagcacctattaaagattcgactgaaaaatgactgcaagacgctgtttccaatatcgcttattccaaaagagtccaaatcagtcatatccaaattggcaacttggatatttttaccgttagaagacttgatttcttcttggatagagttgaacaggaattgtagctccgtggacaatcttgatttcaaagagttcaaggtctcatccagactgttcaaattcttcagcgtttttaaaagtaaataaacatactcataatcattatcgatgaaagcgacttccttgttaatcatgtcaaaaaaattatagttgttttcgaatttgaaaaggaagtccttaatttttttataagttttcagttcctcgtgggtctcttcttgtcgtttgatattcttcaaatatattatgctatgcagttcttccacaacaagttcaaccaaattgtttgattggacctccaaattctctttaatatgagacaatgattccagttcattgagattatactgattgcatatgtcccaagattctgctagtaatctctcaactttgtaaaaggcctttttatctatcaacgcctcaatctcaacattcttcttacgcaaaatttcaatctggtctagagtttcaatgatttgctcgtacttctgagaattattatttaattctttcagaatctctttgttgctcatgatatcctttcccgactgttctaatgtcccattgatttcctttattatattttgtgatttgccaatcttttcacgagtgacctggtacgctgccacgctatcattgaaagcgttgaaattctcaaagaccacattctgcaatccattgaataggttcctctctagctctttaaactcagggtactgagaagccattcctacggatgttcgatccaagaatggaagcgcaatatccaaggcgctaacagagtctttagccatcaatacttgccaattctcctcagcttcctttaacaaatgttccaggttgtccagcgagttactaccattgtggacggagttgattggttgttccatggttgtacctggaaggagggagattcaaggttgatttttggatgttttattttgttggatggaccgcgaccccatactaatgcttgaggtaagcactttacctgtcaaggtgcaagaagctcaagttcattacaagaaagctgcctttttctattcaggctataccttatacatacatacatgggtgaattgtcacaataatgtcttatgattagatctccacgattatctggagatggtttgttttccatgactacctgttacatctgcaataattgtcttctcagacgtatcctatcttgtattcgcctttgggtgcatcaatgagctgtaggtacttgtcacatttagggacttcctcgtcaacatgtcccaccaccaagacgcatccttggttataggagctcacaaagtctttacatcttaacacatcattttcatccatcgcacttaagctctcatctaagatcaaaatcctggggttatttattacagccctgataaacagaacaactttttgatgggaaatggataattcatcgaaagaagtgtctttaagttctcctaattgaaaatattccaataaattgttgattctattaatttgatcagccgtcaaattatttggagggagataagatccggttacgaaacctgtggacacagctttgaaaacagtcagtttctttggaaataaagcatgcaattcaggagacgtaaaaccaatgtatttattcgtgtcaaaataatttgtagaaccaatacgtctaggggctccataaacagatatacttttgttccaagattggggatgatccaaggtcagtaatgacaaaatggtggtttttccagaaccatttggtccacggatatgccatttttcgccacatcgaacgttccaattcaaatttgttagtatcttttttcccttatgagctacattgacattcctcatggaaattatctctgaattatctgtgttggcagtctgtctttctataaaggccagttccttcttttttatattctctagttctttaacctgagacttcttaaattcgtccagattcgcctcaagttcaggtgccaattcatcctttggtccgtgcttgacaactccatcctggtttacaagaacaacgttgtcaatccacgagggaattggatcttgaatccttagtcccagcaggattgctgactcgtggtcttggctaagaacattcgaaactaagtctgtagcatttggatccagtcccaaaaatggatcatcaatgagaagaattttgggtgccttgtagatggattttgctaatctagcccttctgaactgcccgttactaagtccattgatatacttgtcttccagtccgtccagcttgaacgtttttatcagattggcgatcttgtcactatcaactttatgagatgcgttgtaggagtagtcactaatgaactgatccactctgatatcaatctccaggtctttgaagaactcatatcttgctcccagatgcgtgaacccaccattaccagtcccggtagcactcttgccgtagttattattggaaaattggagcagctcgatcgagttggacgccagttcgttagccaaaatggggtattttcttccctctattggaattgctaaatgcttacccgataaaacttccaagaatgacgatttggtgtgtccaattatcgcccaacgtttgtcggaattcaaattgaggtttataggattcttaaataacagtcgtttggagcatactttggaggcagatccagtggccctttgaaacaatacattcttaagctccactaggttcattgttccattcagagattgggcgtgaggagcattgactaactctccagttagcgaataactgggggatgtatgcacctagcatcaatgtggttccgatattctgaggcataacagacacggtaagcaaccgtttattagttctcttgaaagacagccgaagctgctcgttgggcttagactgccctcaaatttgacatttttcacagacctttacctgccaactgtaagccagacgattacctaatcgtaagtttttgaggcgagccctagacacgttaatcctcgcgtatgatcactgtttacgaagctacatgctttctttaaaagcacaatgagtctcaattgtggtgattctgattcggaggtggactcctttcccagctccgaatctgaatttaatgttttgggcaccaatcttctagtcagtcggaggcagaacaatagcaaaaccacagagtgttcaagcttatctcccgacttttccaacaagcacgctgcgggccaaagcacaccaaaatctgaaatctttgtggatgaaggaagtagtttaattcttctggataacgatcatcttacagatagagttattgaaattcttgactcttcaattatggacctggaagacgataatggctctcctcttgacagatcaagttcgcaggaggaaaacaaccaagttgagctcagccttgacgaaataataactagcagccaattcacacaagaagggaccaatgcaaaggaagaagaaccgaaaagttatcttcagcagttattggaacgtgccactcctcaagagttgagacgagtcaataaagtcactagaacacaagaggagatgttatcgaaagttaagattgaaatatccaactcatttttagaacacataaagaggaaggccacttttgaatttgattcggtacagattgaggagctggactcaaaacacaaggaaatcagatggaaatacgagttggactgcctttattatccggagcaggagatagttgttccacttcctcaaggaaagattgaaattgtcaacgagagtacaatcctcttgagttacacagcagaagaaatggcaacgaatttactaaacgaaagcctcatatcattaatcaacgagtatcccgccgattcattctttatcattcttgtcgaagggtgggatacttacttgaggagcatcaaaacgaaacataatagagattttgtaaaagagataagaatgcgattggaccaagaggaacttcatcaaaaacggctcaagagcactccccgaccttccaagcccaatcctgtcgaccctgacaagttatgggagaaggttctatgtatggaacttgagttcaaagtaaacatattccctgttcacaacgtggtagattccctggaatggattaaatcatttacaagcaccttggcctcgagaacattcaacaagaaacatagaaatacaggcttcgaaagagtcggaacggtgagatcaggaagtaatggggccgactgctatttccaagcacttcagcagttaaaatacatgacaccaataacggcaaaaaaactaatgaacgaatatccttctataaaccgtttatacgatcatatttcccgacataatcacctagaaggatgctcaaagagtatcagagaggcattgattaaactatttacgtgtgacaacccaaacgagttgataaattaattattatttcttcttgctccttttaaattgtttgatgtgctccactttgacgaatgtgctattacggttagttttaggtctgaaatgcggtaattccaaaaaagatttaaagtacttgctttatggtattcaaatcatcgttgttcagactgtcctctagttctgctatagttgtcaacgattggcgaatcaagttaatctcttcatctgaaaatctgaacttattctgcactagagtggtcagaagactcaaaactttgtctatagaggtaatgtgcccttctgctttcaaaaccttgagcatactaataaccaccttgttgttgtgcaaatgttcgataacttcttctgatagtccattggtaatgatggaggaaagcaaagacagcgttctaagctttattttctcattagagttatccaaagatgtcaacagcgggcttatctcattccaaccaccttggttgctgaactcttcgtaagctggtttattatgccttagaacattgctcaatgcataaagggcctttagtttgaccgaatcatcctcctccgaattagaagagattgcaatcaacttctttataccatcagagtgcttcagaaaatgttcctgacatttggggttgttctgaactgcagtgcctatacaagaacaggcgaatctccttagagagatatactcgctatcgaggttttgaagcaaaggaggccaaagatgcatattttcaatgttattagcattgtccatattttcaatgagcatttcaaaattgtcaaaggcaacctctttgttttctaaatctgtttcggggttgttaatcaccttcatggattcgttcatcaatgtgggttcgtcggggcctccaaacaactgagccagcagttctgggtctggctgcccagctcttttcttggattcctcatcctgagagtttgctgatatcgaccatttgagtagcttctccattgtgcttatgatctgttaattggagcggtaaagaagtggaaaaagcaggaggaataatcttagtcagatgtaatgtttctcgaattactctgttcctttctttatatattaatgataagtttcttctagaaggatctatcatggatgccattgcagatagggccttccaagagaagcagcataatgtgtctcaaggtatgttgaatcagagcatttgccatgggcgtatcggttaatggaagaaggtaataaaaaaatattcttacttgatctcatttctggtagttttgctctcaggatctgaattattctggacgctaacttttttgttttagatgaaactccttcgttgctagcagttgttattgataccaatccacttgaatggacaaagctaaaaggtgtgatctgtttgaaagagctttgcaaatcagttttggttcttttaaatgcacatctctctttgaacagtggaaatagggtggcagttctcacatcttcttccctcaactcgggaccaaaattcctgtatccagatccaaacgataagacttacgaaaaaagagagtctttactatcctctgacatacatcggcaattcaaatttgttgaccagaaaataatacaagaactacagatactacttgataacgagcctttaaatccagaaaaccaggaactcaaaggaagcatagcaggtgctatgtctatggcattaagctacataaatagacttaccaacatcgaaccagagtcgacaggaaacacactaagagctaagatgctggttataagtataagtgacgactccacccaacaatatgtgcctttcatgaactgcattttttctgctcaaaagatgaaagtttccattgacgtctgtaagatgggacccgattccagttttctccaacaggcatccgatgtcactaatggcgtttatatgctcatcaaaaatgttcatgggctcatacagtacctaaccactgcacttttcattgacccctctctgagaccaataatggtccttcctaccaattcagatctcgattttagagcgtcatgttttgtgactaataaagtgatagatattgggtatgtgtgcagtgtgtgcttgtgtattttcagcatcattccccgaaataatgtctgcccaacttgccaatcaaagttcgatgacgcagtagtgaaaaagctacgccaaaaacctatcgttattccattacagaaaaagaaaaagctggaagacggagtgcaaaggacgtgaaggagttgccattatcgggactttaataaactagtttgccctttggacatgccatttttaatgacactgtatagaaactcttttgggtactggtgtttatcaatcatgtgtagacgtctcgtttgaggagaggaacagatcttatcacaagtttccagaaaacactggtagattttttctcctctttcttctttgatagaattgaatggattatggtgctcttgtatgtgaagatataagaacctttcattaggaaagttctttttgcaactctgacaaataaaagtgtgatattgtaggatgtggtgattcaacgatgagtggtctgtgaaatctgctttacatgctcccagcgtgcacctgaacaacgcctgattgcttattcgtgtagatttttgctcgtttgatgcgtcactgaaatcatctaacgttcttttcatgggctagcttaggttagtgttcgctcgttttttcttagctactactctttacatgtatatacagtcctattacaatgaaacgacagaaccagccgtatgagttgttaacgttgaagaagcaaaaggcagaacaacccgaatcttccatagaacacacacatggaccggttgacctccaatttggacagagaaaggcttttcctgtcgatctagatatcgacccttccaggctgccccagaatgaaggttctcttccacaagacgtcatgacatacctagcaatggttcgaatggaggcagaaggcaacgcaagatacaatattgacgaggatgaaaacttttatctacatgaaactgttaaaactaaggagaatatagctttggaccctgtggacaatgaacaccaagtgcacataacctggcaccatgactacacagagtactttaaagccagacaagaaaagcttagcattttaggaaaggaaatcgaaggtgacgaaaagtttatagagccctccagtgcccaattgtggaagaaatatgtatttgaaacgacccctgatgaccgattaatagtagccattccgtttgacgtcaagttcaagatgataatctacttcacacgatggcttaataagacattgaatgccaatctgatcaaatggatagaaataacattagaatcacttccggagttgttggaggggactgagatatcgttgttacgtaatcttgctaagaaggcgataaagctacgaggtaatgacttggacagcaccagtttatcggttatggatgagataatatccatagttggggatgtgtatcatcaaagggatctattagagggttatttatagggtaataagggtatataagcgagatgacttgtagtgccttgatccaagtagtgcgaggagtgttcgctcaatccaagttcaaattcctttgacatcttctgctcgtctcttattgccatcttcaattgaattaaccagtgaaacaatgtctgaagatcccagaagaccagatgaggtagtaaagtacgaaatctatttaagaaagacgaagctctttatttgaaaaatccactaacagatctaggtacgtccacgttccagctcagaccagaaatacggccgccaacgttgttggatccactttaccgatggctgccatgtttttaaggaataaagtggtttcatggtctgctcttttcattgccttgcaagcgtacttgaatgaaccaagattcaagcctcaaaataaggacggcccatctcaaccaggtttgatgacagttggatttgccttgctggcggttcttacatcgtataccgatgtactatttcctacccccggtgttgggaagaagattgtaccctcagtttagctactcaacagatccgggcttagacaattaatgactaagagaaactattgttgtttaagtttctaatatattaagtatgtaaatttgatttcagacccgattcaggaccacataatctacagccaagccaagccaagccctggcctcagacctcgatgccgtgttcttcttctttccatggatcttatcaaaaattttactcaccaatatcctcagaccaatctgccggcctctccttgatgaacttggaaattaactccttgcactcatcgtttttggcattgacaacttcaacacccttagatctaagtaattcttcagccccttggaaagtttcattttctccaaggacaactctcttaatcccgtacatcaaacaagccccactacacatatggcaagggctcagggtagtgtacatagtgcagttcttgtatgtctttcctggcaatcttccggcattttcaagagctgacatctcggcatgaaacactgacgaacctttttgaattctcaaattatgcccaacgcctaaaacagtaccatcttcggacactagagctgcgccaataggaatgcctccatcttcataacctttttgagcctccttcaaggcaagtttaataccgtcttcatcgctgaatgtcattttctgagtaagtaaaaccaaaagagagataagatactttttatgtcgaacgcaggtcgtatgttaaccaaacggttttacagataagtaacacataattacaccaagtcctactcagttctagattagtaaaagatctaggagattacttcacactgatacggaatattgcatggaagaaaggctggtagcagaccaaagttcggctgggtatagacggctagcgtgttttctggagacacagaattagtccccaaaaaagcgagaagcgggtagatgcgtagcaacggcactggggcaaaatcttctccacgagatttcaggcgatagccgccggaaacggacttccccaaaaaatctaatctgcattacataataccaaggggttgacattcagactcctcgaagtagtgcatgacactatatcttcagacctctttagttgtgtcctaaccagatctataaaagttatcgaaaaaatcagctcagcttgcttcaacccttaaaagttctcctttttcaagttttcacaggacagcattttacccatggaagagagatcatgctaataacaagtttattggtacttattctcttcaacgtgttggcgacggccaaaatatttgccaagccaagctcgctgatgttctcctgtctcactgcctctcaggagtttcagtatgattttgtgccccctccagatgtaatcccattctggtatattgcatgcaactatgaaccagcactgggatccatcgttttctgtatggactcaaatgctgatagtatttgtcccttctccaacagtttggaagtgctggcgctaggttgtcaaactcaaggggatagaacgctaacacaaacatatttgatggaatcaggaaagaatgccaccaaatacatgaagaatcctgcatccgatcctgatttcaatttcactcaactcaccactcccatcatgttcaacatgtccgaagttgtcaacaaaaaggatgcatactacaactttttcgacaatttggatgactctacaaaattcggcgacttcacaatcatatactggggtgtccttttgatcctaattggcctttttaatcatatttccgcccacaactatttgaaatcgatctcgttgaattctaggttgaaccaatggaaagctttagtggtcttaccaaccctctcctcatatcatctgaaccctgccaggtttagaggcattgcattttttgaagccctccttccactcagacaagaaacatttgttttaatagcgtacattttattgtgtgtctattacactactagtaattacaaggtcatcgctaacagcccgttatttggtagcccttaccgtcaatacctcagattcatttctgatcggactgggatttttgcattcacccaattgcctttgttaattctttttggtggacgaaacaacattctaatgaccatttcaggtttgcctttcaacacattcataattttccacaagtggatttcaagagtaatgatgctttgcgcagtggtacatgctcaccaatttgtaatatacttggaagctacaggcacttttagaagatcccttggcgaactttactttcaatttggtgagctagccttgctatgttgtcttttaattatggttcaaagtgttttctatttcagaaaaagatgctatgaattgtttttagtcctgcacatttttttggcatttatctttctggtcgggtgctacttccatgtctccaagattggatactccgagtggattcttgcaactcttggactttggattttggatagagtttggagatttgtgaatatttaccgttatggcgtccaaaccgctcagctcacagtttttcacccccattcaactgattccaatagagaagatcccacggttaaagtcagcattcccaaacctgcaacttggaaaagctacccaggctgttttgtttatctgtacttcttagatcctcatctcaaattctgggaatctcatccatttacgatttacgactcaacagaccaatttggtgatcccactccaatgatcaatatatacataaaacccaaatgtgggacaaccaaggctatctacgaccaaattatgtcaagagatataactggtgttaaagtgctggttgaaggtccgtatggccatagggcacatacagaaaattatgaccaactactactatttgttggaggcaatggtattccaggtcctttcagccatgctgcacgatcagtctctgctttgccatacaaagacgttgaaagctttaagaaagttgaactagtctggtccattaaaacactatctgcccttaattggttctacgatgaattgatccagttaaaagatactaatgtctcggtcactgtatatgtgaccagaggcgacttgtccttagcagacgatgacaattcctcaacaagcagtaataataatatagagccagagatcctaacagagacgagccatcttttgaaagatgatactaataataaatccaagaaacgagaggtctcttcgataattaccattgccgaaaagtttcataacttgtccaagttcgttaccttcattaggggacgacccaattttgagaagaaacttgaccaagtcataaacgaatgctcccaagcttccaagatcactactatagggctagtcgcctgtggcccatctttgatgtgtgataacattcgaaacttagtggcccaccgcttgagcagaaatgacacaggaaaatttagaatagaccttctagaggagctacaagtttggtagtaaaatagttccgaaataccttaaagcatatacctaatcagttctaacgcccatatccgcctcttttctgtacttctccgttcttgcctaaaatcattattattggagttcaaccggataaattgagatacagccagtcatcggatataactttttccattttatttctttttcctgatttacctgaacgtgacacgattctcgcgctttaccgatagtaaaaaaaaaaaaatctggagtagaagaaaactacttaaggacaaacgaccctcagctccgaactttacaaacaccggattctcgtatttgtcgaagatcttagatgggtttcaaacagttttgcaaggacaattttgtagctgtctctccaaagaagctgaagaagtctgatcttcataatgtggagataagcgtagaggacgaccctttcaaaaagtctgctgtcatcgaagataagaagttggatgtcgaatcttcagtgactgagagctccgaaagtttccgccctcaccgaaacttaaagaacagacacatccaattgattggaattggtggtacaatcggaactgcaatttttgtgagtatctcaggggctttattcaaaggaggacccctatcgttgttcctagggtttacgatttggtgtatcccaatcttggcagtaacggcgtcaactgctgaaatggtaagctacttgccaattacttcccctttcattaggatggcgggaatttgttgtgatgacgactttggaatttgtctctggtttgaattttttggattctgacaggcagtttgattccctacgaaatcgttggtgtcaacacaattattcactattggtccgatagctattctcctgcgataactatttgtattcaaatcgtgttgtattttttgatcaacctgttttccgtgggtatttatggcgaaacagaattttggttaagtgtctggaaagtctgtcttgctgttggactcatgtttttcacattggtgaccatgtctggtggtaacccattgaatgacgcctatggatatagaaactggaattctccttcaccgatgatggaatacatcagtgtaggtgcactaggtagatttcaaggttttatcgcctgcctgagtcaagcgtgtttcaccatttcaggtcccgactacgtgagttccgtcgctggagagagtgccaatccaagaaaaactctaccaaccgcattcaaacaagtgttttacagattgacgttcatttttattatcggagtactgtgtatcggtacagtatgctctccaagagatcctcacttgattgccgctttagaggagggtcggccaggttccggttctagtccttacgtcattgcgatggacaatttgaaaatcaaagttttgcctcatgttgtgaatggtgcattagctctgtctgcgttctcgtctggtaactcgtacacttattgttcctccagggtgttgtatgggttagcttacactggaaaggctccaaagattttcgcctactgtacaaagagtggtattcccttatacagtgttcttatgtctctttgttgggcgttcctttcgtttttagaaatgaacactcagtcgcaaattgtgctagtatggattattaacctggttacgtcgtcgcaactgctgaactacacgattacaatgctcacatacacaagattttatgcggcgttgaaacacaagggaatagaaagaaaatcactcccattctatgcgtggttccaaccctacactgcaatatttggaggtttttgcaccttctccatgatttttatcagtcagtacctgcttttctacccttcaagagagtattgggccatcagcaccttcctgtttgcattcctttcactatttgtcattatagctttgttcatagcgtacaagcttgtgttccgaacgaaatggaaatctgttgacgaaattgactgggaattagaacttcaagaggtagagagagatcaggcgtatttcgatgaattagcttactatgacaacaacgccaaaaaaccatggtacgataaactcattgccattctagtaggaaacaacaaatgaaaacaatttgttcggtttagactacttatttattcatctccctgatattaatagaagcaattatagagaggcttagatcgtagatacgcagacctcccaacatcaagtcatcacaactacagcgcgaatatctaggacatgcaatcttccgaggtaactacttatcttgagagctgaaccctttttcaacgccaggtgtcaactatggaacgccaatcacgtggcgatggtgataccaacgatccacccagaataactgatccgagtgttaccaagcctcgcaaaagaggtctttccttgagatcgcaactgctcaataagaagctactgaacaatccggccacaaacaattctgtaccagatatcgagctttcagaggtagatgcatcacatgaaggtagtgacagccaagcggtcaagactgagccaaaggagagatttgctgaggaatcatatcatgatttagttttggaggatagggagcccactagtggagatcaatcatcaagaaagacatcttttctgaaaaatctacacaataaattgttaggagttaaaaatgtatccaattcgaaaggacaaagaagagttccacttcaaataggtggagaagctcctaactatgcatatctccaaaacaagcaaggaaagtcgctgttgaaagatccgaagacaaataaggctttttgcgataacaacatcaagtcctcaagatatacgctggcgacttttgttccacgacaattgtatgcacagttttcaaaggtagctaactgttattttttgtgcatttctatcatgcaaatgatcccttcttggtctaccacaggtacatacactactattatcccattgatggtttttgttagcatatcaattgcgagagaagggtacgatgattggaaaagacatcgtcaagataaagatgagaatcacaaaaaggttatggtggtagcctctcaatctccaggcctctattcaaacaccacactcagaagtgccaattctttgtccgaactcaacactgatattggtgacacagaaccctaccaagcccaagtgcttggacgctcaagaggtagcactatatccgaatccaataatgtgtttgatggtatagaggaacgcttttctggaaaacgtttccatctatccaaatcttactggaaagatgtcagagttgggcaggttattgtactcaaacgagacgattgggttcctgcagatatcatactcctttcttctactggagattcgggcgaagttttcattgaaacaatggcattggatggagaaactaacctaaaggccaaagttccccatcctgagctttacaagcgctgcaatactaacacaggattagaagcggtccaggccgatgtttccactgaaaatccgaacttagacctttacaactttgagggctcgttgaaattcaaaggcgagtccataagttatcctcttggtccagataatatcgtttacagaggatcaattattagaaacacagattactgcttaggacttgttatcttcacaggtgaggaaacaaagattcgaatgaacgcaatcaagaatccgaggactaaggctccaaaacttcagagggctattaatatgatcgtgttcttcatgatttttgttgtcgcttccttgtctgcattcctaacgatggcacagagaatttggtatgagaagacaaaagatcagtacatttatctttacgaagaagatgttggggtagctgcgacactgatgggatacattgttatgctcaatactttgattccgttatctttgtatgttacgatggaaatcattaaagcaatgcaacttgttctcctgcaaagcgatattgacatgtatgacaggaaatccaatactccagcagaggccagaaccgcaacgattcttgaagagctgggacaggtcagctacattttctccgataaaaccggaactctaacggacaacttgatgcttttcagaaaatttacagtcgcaggaactgcctgggtacacgatatagatcttgtgaatcaacagaatgagcaaggagacgagccagaagagacagatagccccaatcttgaagtgaatggaaacaaagaaactttggaaccccgaactagtatttctcatcgtggtggtcaagctacttatacgggacgtcctagtttagcatccatttcttccaatcataatccaaaacagtcagaaactacaaccactatctcccttgaagcttcaacttcaagctctcctactaaatccttttcagatcctagctccacaggaagcctcaagtctactgttgagctgattcggtatttgcagaggtacccaagttcgtttttctcaaagcaagtcaaattcatgctattgtctcttgccctatgtcattcatgtttgccacgtagggcagatccgggagcatccgatgatgatgacgaggataatataaattatcaagcttcttcccctgatgaactggctttagtgattgctgctagagacatgggttacattgtttttgaccgcaaattaaagatgttaactttaaaagtgtaccctaatagttttgatggcgaaccagttttagaaaactatgagatattggacactgtggaattcacttcatcaagaaaacggatgtctgttatagtgaaatttcccgatggtcgaatttgcatgttgacaaaaggtgcagataacgttatgctagaaaggttcagagataaagagcttgtggagcggaagatcaaggaattaaaaaagcaaactagtgaacgtaagaatcaagaagctgatatcgttttgcaacacaagaatgaagatgcttctgctaatgtgcggacttctatatcaagtattggatcttctctagcggaaagagttagtcttcaaattggccgaacgtctctgcatgtaaatcctgacccccacaacagtattgacggcagaattatgaatgaggagcctgacgaggaagaggagtacgtgaagaatataacaaaatcctcccgcaaatccattcatctccaacaagcaaagaagtatgatatctccagtgaaccaactgccgattctccaattgaagattatgtgacatcagaaaagttagtttttaatgaggagtttgttttagagagaacgttgcagcacattgaggaattttctgttgaaggtttacgaactttgatgtattgttatagatggcttgacaaggatgtttatgaacgatggagccaacagtacgctgatgctaagtcttctcttactgatagaaaatataatatagagaaagttggagaaatacttgaattcgatttcgaattggtaggggctaccgcaatcgaggataaacttcaagaaggagttcccgaagctatcgagaagctgcgtaaagctggcatcaaactgtggatgcttactggagataagaaggaaacggccattaacataggttactcctgtaagttgattaaagattactcctcagtagtcatcttaagcagtgatgaaggaattcaaaacttatcgacaaaaatggctgcttccgaactggaaataaaagaaggaaatgtagctcattgtgttgtcgtagtagatggagccacctttacggatatagagaatgatctgacattgatgaccttatttattgaacttggtgttaaagccgattcggtcatttgctgccgagctagtccgtcccagaaagctacaatggtttctgtcattcgaaagtacaacatgaagaaggttactctagcaattggggatggtgcaaatgatattgcaatgattcaacaagctgacattggtattggcatcactggtaaagaaggtttacaagcggcgagaacttcggattactcaattgcacaatttagatttcttttgaaactgcttttagtccatggaaggtacaactacattcgaacgtgcaagtttgttttgtgtaccttttacaaagaaattctattctacctaacgcaggcaatttatcaaagatacacactattcacaggctcgtcgttgtatgaatcatggtctttgtctatgttcaatactttgtttacctcacttcctgtcctttgtataggcatgttggaaaaagacctgaagccttcgacgctgcttgccgttcctgctctttacaagattggaagaaattatgaggcattcaacttagtaacgttcatttactggatgcttttaggtacttctcaaagtctcctcatttcatttgctaactacttaggctggggaggatccagcagccaggataatacgacgtatccattgggagttgcatctttcacagctctagtcttcgttgtgaacttgaaatgtcaggttttagagatgcataacatcaccaaattctccttgattggaactcttgtatcatgcttagggtggttcctgtggctaatacttttgacaggactttatcagagcaaggattcgaagattttttttgttaaatctgggctctttcatacattcggcacggacatcacctggtggtgcaatttgctagtccttatcctaattggaccattgttagacattatcctgaccgtcattaagaaagacttaattccttctgatacagacatatttcaaaacattgaaaagattcccatgtttcggaagacatttgagatcaaggcattcccgtatatgtttcagggttggacttggccccacgaatctgttatactggaagagaaaaagctttctgtttcacctttcaaaaggaattactacaatttcaaatcgattttgaagaagggatcaaccggcccgacaatgactacaagaaagcggaatgggacactaccctccatctacgagcttcctccgggttcaccaagcgttgtccgcaaggtaacttcgaaggacggctacgaatctgagattttacccagtggtaaagtaattcaagtaaaacatggagtctctagattgaaaaaagtgacaaggatgtttaagttggacaacgtagatgaagaaactgactatgacactgaggcgattatagatagaagaatcaaagagacagagacttagatacctaaaaatagataagttcatttaagattgcatttcctgttggtggaactgttaccgcttgaacctaaaatctcaaagccgtgcgtaccccgtagcctccctatttctgcattgtaatgcacgttactctgtaggtttttcgcggtcataacaagagaaaaagaaatctataaattaagaggtaatcctaatggcaatactaaaaaacctctaagtctttgttttactttctttctcggtataaagttcaagaatatgagattattcaagcgaaagaaagatcccgagaaagagcaccttgatgagaaggatgctcagttcaagaatcctgacgatcaattgaatgaaaaattcgatcagttagacccagcaacgagggaagttctggagggacagctcaaaggcgtctctttcaaggcttcccttgctgacttgtatggtttgcttcgaggctgggaatatttaattgcatttattgcctatgtttgctccattattgccggagctgccctacctctaatgaccttagttgtgggagatatggcacaacaattcactaattatttcacaggtgtgctcggcagaagtgaatttgaagataaaataagggacaattcgttatacttcgtctacttgggtattgggcttacagtgtttcaatacttggccacctttctgcacattgtcatcagtgaaattatagcaagcagggttagacagaagtttgtatggtcgattctccatcaaaacgttgccttcttggattcaatggggtccggggaaatcaccgaaagtattacctctgacacgcgactaatccaagagggagtttctgagaagattggaatgactgttgaatgcttggctacggttgtatccgcattagttgtcgcattcgcaaaatactggaaattagccctggttcttttatcagttatggtagggcttatcatgtctgccactccaacaacgttgatgttaatcaaaatgtacatgaaatcgctggaaagttatggtaaggcctcttctatcgcagaggagacattttctgccataagaactgctactgcatttggtgctcatgaattccagttaagtagatataacattttcattttagaatccagaggttatggttttaagaaagcattatggttatctttgatgattgggtctgtctggttcattgtcttcaatacttatgctctggctttctggcaaggctccagattcatggtttcagataattcaggtattggcaagattttgaccgcttgcatggccatgctttttggtgctatgaccatcggtaacgttacaacccacatgaaagacgtctcagtaggtattggagcagcttccaaactgttggcagtaattaacagagagccatatcttgattcttcgtctgaagatggttcgaagttagagagggttgatggtagtatcagtttcagaaatgtaacaacaaggtacccttcgaggcctgatattaccgttctttctgatttcaccttggatgtaaagccaggcaatacagtggctcttgttggagagtccggatccggtaaatcaactgtcattgggctgctagaaagattttacgaataccttgacggtgatattttgttagatggagttagcgtaaaggatttaaacattaaatggcttaggcaacaaattgctttggttcaacaagaaccagtcttatttgctgcctccatctatgaaaatatctgttatggtcttgttggcacaaaatatgaggatgcacctgaagaagtcaaaagggacttggttgaaaaggcatgtaaagatgcaaatgcgtgggagtttatcacgcagatgagtcatgggcttgacactgaggttggtgaacgtggtttatctcttagtggggggcaaaaacagcgtattgccattgcaagagctgtcatctcacaacccaagattcttttactagatgaagcaaccagtgctctcgacacaaaatccgaagggatagttcaagatgccctcaatagattgagtgaatcgaggacaacgttagtaattgctcataggttgagcacaatccagaatgcagacctaattgttgtcatgagcaatggtaggattattgaaagaggcactcaccaagaattgataaagttgagaggaagatactaccagctcgttcaggtgcaaaatatcaacacgaagattaatagtactcaggtaacaaaatcgatcgcagcatctacaatttctgattctgagaatgataaacctaacgattcagaatccctgatttacgagccgtctcctgagatagcttctgatttaccaccccaaaagaaaccctctgttgggcaacttttcctgatgttgctgaagatcagcaaaggggagtatcatcttataattcctgctatgttttgtgcactaattgcaggtatggggtttccaggtttatcattgctcatgggccatattgtagaggctttccaggttagtggacccgatgaataccctcacatgagatctcaaatcaacaagcttaccggatatttgtttatgattggagtcattgaatttatcaactatattttcttaatatccagtttggtaatggcttccgaatatttgatttataaaatgaggtacagatgcttcaaacagtatctcagacaggacatggctttttatgatcaacctcaaaacaaagttggatcgttggtgacaatgctagcaaaagatcctcaggaaattgagggtttgtctggaggtacagcggcccagatcaccgtctcggtgataattgtggttgttggtattataatatccctgatcaccaactggaggctgggtcttgtgtgtacatcgactgttccgttattgcttggatgtggctttttccgcgtttacctgattataatgtttgaagaacgttctctgaagagctaccaaggctcagcgtcttatgcttgtgaacaggtttcagctttaagaacagtcatctcgttaactcgtgagaaaggcatatatgacaagtatagcaaatctatcaaggctcaagttcgaagatccacacagtctgtggccaagactgctatcatgcacggactaattcaaggtatggttccgtggatctttgcattaggcttttggtatggtagtaagctcatgattgaaggtagatgtacaaacagagagttttttactgttttgattgctattttgtttggagctcagtctgccggtcaaattttctcttatgctccgggcatgggtaaggccaaacaagcagcagctaatgttaaaaaggttcttgatacttttcctaatgtgatagacatagaatctgaggaaggggccatagttgatccttctgaagtgaaaggtgggattgaatttagaaatgtcacttttaggtatcccacaagaatggaagttcctgtattacaggacctcaacttaactataaagcctggtcaatatattggcttagtgggcgcttcaggatgcggtaagagtacaactgttggcttgattgaaagattctatgaccctttatcgggtgaagtattgttggatggagttgacattcgtaatttgcacttaagaacgtatcgtcaggctttggctttagttcagcaagagcccgtactttttggtggctctattcgtgacaatatcttgcttggaagtattgatgaagtgtctgacgatgaagtgattgaagcatgtcgagaagcaaacatctatgactttgtatcctctctgccagaaggattggacactctttgtggaaatagaggagcgatgctatctggtggacaaaagcagagaattgcgattgctcgtgctttaattcgaaaccctcgtgttctcttattggacgaagcaacatcagctttggatagtgaaagtgaaaaagctgtacaagaagctattgatagggccagtaagggtcgaactacaatcaccattgcccatagacttagtactattcaaaactgtgacgtaatccacgtatttgagggaggaaagattatcgaaagtggtaagcacgatgaactattagcactgggaggaaaatactacgatcttgtacagctgcaaggtcttgaatctcaaaactagaagtggctaaagtggttctcaacttttttcactcttcaaggtgtacaattcctaggatgtatgaaagagaccagtttctttgttggctattcaaatattacaagtgtatttttttgggtattattgactgacccaaacgatgtttattccttccgctttttcaagagattcgattgatgaagtttggagtaatgtaaataggagagttgacgaactaatacgtacatgttaatgctattttttttgaaatatttactggtattatcttaaaggcacaacgtgcttgaccttagctgatcatatgaaagcaaagaatatgatggtagtctgcctatcactgtcatcttctgaatatctcaggttccttagatcgcgaatatagacctagcgctatctgaaatcgctaactttagtctcaggttccctttgaataccgtctataaggacgattatttgatgtcagtacaaaaaagcacgaaggtattcaataataataccaaagacttcaagaaacatacccaactgcgcaacggaaaacttttagaacaaacagatgaccatattcaaaacgttaacagaagaaagagagatctcaaactgagccagatattaaattgcacagattccgactccgaggtgaccaaaaattttgacggtaaagactcaaaagaagaatctccctggtatgataactccagtagcgattttcttaaaagtgtggacacaaaagcctatcgtcaatatgaccttgcttgtgagagagtaaaagatttttataaagagcaacacgaaaaccagacagtagcttacaacttgcaagcaaggattaatttcaagaccaagaaaagggacgtaatgacagtatgggatgctttagtgaagcttaatgtgctgctagacgaaagcgatcccgacacagagctgtcacaaattgaccatgcaattcaaacagcagaagcaatcaggagagactgcaaaccacgttggtttcaattagtaggactgatccacgatcttggaaaactgttatacttttacgactctaaaggacagtgggatgttgtaggcgatacatttcccgttggatgcagattttccaaaagaatcatattttttgagtttttcaagaacaatcctgataatgacaatccactgtacaataaaaaatatggcatttactctcctcattgtggactagaagatgtcatgctctcctgggggcacgacgaatacatataccatatcgctaagggccaatctaagctacctccagaaggcctcgcaatgttaaggtaccactcgttttatccttggcaccaagatggtggttataggtatttgatgaatgaaaacgatgcacaaatgttacaggcggtcaaggcatttaatccatatgatctttactcgaaaactgatataacttacgatattgaggagctcaagccatattacctagaactgatagacgagttcttccctcaaaagctggtaaagttttgataattttaaacgtatatttttttctcctatattataatgttacctaaccatttattcccaacaccaagcgtaattacatattttcttctattttaactaaacagatcgatagctccgaaaaactgctcaatgccatacgggcctgggtctttccataggtcatcgtaggtactcaggattgtgacatctgttcccactacctcaaaaatggaaaatattgcagttttttgattttctttgctaggaacattctttccgttagttgctccttggcttggatatcctgtttctataatggtgatgtctgatcgggaacatgctttttggacgacctcaatctggcttttgacaaaagaaccggaatcagaagcagcaaacaaggtgttgaagtaggaatgagcattaactccaacgatagacatcacatccgtggaacatagatctccgtaatcttcataaacatttggtggctcagcagtagtaattggaccagtgtatcctgcacttgataatatggacgagacttctttgatctttgaaattagactagaagctgaaacgtaacctgcgctgatagcttcattgcccacagtaatgagctcaaagagatcccaattaaacccattgtttccattcacagcttgaataaattcctggacagcatcatctatagagtcaacaccagatggaccaatccagaaaccttggttaacctttagacccaaagaagcacacttgggaagcacaaccgtgagatagttgcaatcattaccgtaaattcttacagcagaaattcctttagaggcaataaattccaaatcagtttcaatagtcgtggcatctttgcattgacttgagtcggaatatggactgtaaacaatgcttcgtggatggttaccaccaggggtactagatgcggtaggagtggttgatgttgaacttgtagtacgagcggccgtagtcgaagtagtaggggcggttgttgttggatttgcagtttgtccagtgttttcaataggggacccatcaggaccaactaccactacagacgtcactacactacgagtagtactgtaggtagtgaatacgccgttattgctggacgtagtaggggacggagtaggagcggcaggagtgtcagcgttgttttgagttgtatccacctgcgttggtcgtgtttgttgggtgttcggggtaacagaagttggcacaacaacctctttattcacgatggatgtcgttgtgatcggttgaaaatttccgttctcttctgcggtgctaacggtagtgagtgtgtgagtgtaagttgccccatcggagattaggacttgaacgattggaattgttttagttacaacgcggacgttggtctccgtaacaacggcaataccttcggtaacatatttggtaactacaggtattggagcctgtagggatgcctgtatgaagagcaacaggataaagatatttaagatagttgatagcatatttgctgtattggataatgattgaatagggtgaggtttccaacaagttgtctgtattaacgaatgagattagcttcttagcttagcaactttgtgagcagctgggggattgtgtgtggtgataatttcggcacccagaataatgaaagatcatcgttgatttataccaatccgtagatcaaaagatggcaggtattaaagttggatcaggtaccagccgcaacggcaagtatcaaaaacaaagcaagattcaatgcatcgagagtgaggacattgtcctgtaccagccatttcaaacgaccttatacggtacgaactcttataatatggttattttctggtagtaatagagatcttcagagatgagattcgaaatacgcgagtgaacgttcacgtgactatctaaactagccatttccaagaatggctgggatgagatcttacataggcacgatcattggatgcaggaccatgaagtaaactttgtacgggggaactggttccgattctgggagaaagtgtagtgatcttacccttcggttcatagcagtttctaattttagtaatggctggagttttgaatttgccatgatttcatttacttcgtgaatggctgacatggtattgagatcatagaagcttagaaactcaatggttgaaatcaaagagctataggtgattcgatcttgctagatcattaagcatgggttgtttctgattttgtttaaattgtactatgtcgctgaagtcacttactggtaactgaaaatctattatgtaatcgcattcgaaatcgagtttgtgttctattatggctattgaacctaccattctatatacgagtaaacatgaccgaggaaagcctggaaagcactagaatgtctactctaggtaaagataaacaccacaaaactactccgtctattgtctattgccttggcttggctctagctggaatagtgtttgggttcgacataggaagtattggaatgataaacttccaaacatatagggaccaattcggcgatattgtatatccatcaggagagaaaagaattaatgaagttgtgcttggtttaattgtatcaggtttcagcttaggagcggccctggggggtcttttactgccaagatttgcagacaactacggaaaaaaaccacttattctcttttctatgttcctctatttcttgggttcactgacagtcttctgggcgtgggtatggtggcaggtatttcttggaagaattctcaacggtgcaggagtaggatgctgcggtgtcgtttcagtgatgttgatcagtgaactgtctccccctgatctgaaggggcctttggtctccagttttcaagtcttcactactgttgggattctttttggagcacttgtgatctatctctgtaaaaatgaaagaagcagatggcagtaccgaattggcttagtaattcagatgaacctggccaacattgtagccattgttacggcatttgtgcctgagtcgccagtctacctgatcaaaagtaggcaatataataaggcactgagatcaataggtagaatcaaaggtctctccccaacagatcatcgggtggagaccgagctgaacgacttaagggagaggactcaactggagtctttgaatatagccctgagcgatccaaactccacaagcatactgaagggtgaacctaggatactgtttagaacagtgataggaaccatcctaatgatattccaacagttaaccggtataaactactttttcttctttggagtggcaatctttgaaaatgccggggtggaagacccgtttctgacgcctgtgatacttggagctgtcaatctagtattctcgttcctttctttatggctggtgtctcagtatccaagacgttggctattaatcagcggaagtttcgtgatgatgatcttgattttcatgttttccacatgcggagtatttttcttagactcatcaaatggagcagtggtgggcagcattatgatccttctgacatgttttttcataggagcatttgcgtgcacttgggggccgttgtcatttgtagttctcagtgaattgttccccattagagttagatcaaagtccatgtcaatagcgagtgccatgaactggactacgacatttgccctgtcgttattgtctcccttgatcatcagatacataggtttttggtacggatacgtttttgccgctttcttgtttctgtcagcattcttcgttttctactacataccagagacaaaatatgacaccattgagcaaatagatcactattacgaaacaatgaccacttttaacgaattcagcatcggattccccacaaaaacgtttaaaaaaagaaacaagtctattacagttaaacaaccagaaattcagctacatgatgtatgaggaccgttttcccctgtctttgataatgtcgtgtggatcgggattttttagtcggcgagtttctcgccgcaggagtcgattgaaagacaaagagaaggccatctgaaattttgaggttaggagaccatatcatcatagagatttcttggagataactaccatcagctatggtaagacggccttgcaaaggcactgaaaacccctaccaaggcaaagtagaccaatcgaatgaagtcaggcttttgtaacattttggttttccccggataattgctttcatccgttggcacttacgcttacatgaaatattagcctgataagatgataagcgcgttcacacatgacgcaacggaaaaaaaaaagggcctaaattctgcgaattcttactgatactgccaagcgcaaaagataactatcataattagatctaatggaaaatcatggtataaatatttcgcaaattccttcaaggtgactggttgtcactgacacttattcaactgataatggctggaggaattgaaacaccactaccacaaggtgcgggatatgccgtggttctaggattgggattcttcttctcattcctgatgattggaatcacatatggtctgcaaagatacaagaaagagatcatgacatcggaagagttcaacactggtggtcgttctatcggtacaggtttgatcgccagtgcagtggtgtcgtcgtggacctgggctgctacacttttgaccagttccactatggcctacaactttggtgtctcggggtcctttttctacgctgccggtgcctgtgttcaaattgttctgttcagttatttagctatcaaagccaaacaaagagcccctgaatgccatacttatcttgaaattgtcaaagctagatacggcactctaacccactgtgtgttcatgttctttgctattgcaaccaatgtcttagtcacagcaatgttgctaacaggaacttctgctgttattagtgatctgactggtatgcacactgttgctgtctgtttcctgatgccaatcagtgtggttgcctacactattgtaggtggtttgaaaagtaccattctgtcggattactctcacaatggagccctattgattattattctcgtgtttgcctttacaacatatgctggcagtgataagattggttcgcctacaaggctttgggagatggtcaacgcaagaagtgctttgaaccctgtcgaaggaaatgccggaggtaactattttaccatgagctctcgtggaggtggtatctttttcgtgatcaacattgctggtaactttggtacagtcttcttggataatggttactggaacaaagctattgcagcttctccagctgctgccatgcccggttatgtgctggctggatttcactggttttcaattccgttcttatgtgctactacaatgggtttggcctgtttagctcttgaagacctcaatgatccactgactccccaacaggtctcagccggtttggttttgccaactgctgccactcaactacttggaaaaggtggagctgtcgcttccttgttgcttgtattcatggctgctacctctgccctgtcatcggaattaatttcggtttcctctattttcacgtatgatattttcaagggttacttacgtcctagagcctccggtaaaacattgctggtgacatctcatctgtcagttatggcatttgctatgattatgtctgcattctctaccggattgtggtatgccgaaatttctatgggatatttgtacgaactgatgggtattttgatttcagcagctgtggttccagcatcttgtaccctcctttggaaagatcaaaataaggttgcggctactctttcgcctcctcttggctgtgctttggccattactggttggttggtttacagtaaggtgaactttggagaagtcactgttgatactacttttgaagacatgtccatgttgactggtaactgtgttgcccttctgtctccgcttcttttcgtcccactgttctcgttcatttttgggttccaaaatttcgactggagagtactaaagtcgattaacagagtggatgaagatgaagagatcatcgaaaaaaccgagccaaacgttcatattgatgcggaaactggaatgtaccctataaagtcgcaaataactaatgcagccgaagaaattgctctcaagactggtgacgaaagattaactgccgaagaagcccagttgaaacgatcctccagaatagcaggatttgcatgtcttgtgtcagcatcctccttccttatactttggcccatgccaatgtatggctcacgttacatattctccagtcagtttttcactggttgggtcacagtcggaataatctgggtcttcagcactattggtttagtgttgctgcttccaatctgggaaggccgtcacactctttacactacttttaggggtatctactgggatctcagcggaaactctcacaaactcaaagaatggcaagaatctcatcctgaggagctgcatgttgtgcaaagtcaaatctctgcccaagtacaaaggcacaacagaattcaagttattgatgatctcgttgagaccgacagtgacagaaagtaggcttttactccgtatgttcgttcgtaagaccttttactggggtctttatttagtgttctattagaagtttttaattgttaattcgttttgttatgtaatcagaatcacacgtctgcaaaatcgcttagttctctgttggaacatttatggtcaacaagtctttcgaaaatggtacagttcataccgattcttgtcctgattttcctcctcttttgtttcatactaatagtattgtttggtgaccttccttcttatagaggtactctaattccaaggatacggcaaacactgatactcattctttcttgttcgggaaatggcctcgtagctgctgatcgaagatttcttggaggagtcgtcacaaaattggtttccagtccaataatcaggaagacacttggctggctgataccttcgatgtacttcgtgatcatgtggaattgtttgaaattattttttaacaaggtgtaccccaccctttactctcaactcgaatttatcttagttattgtaccttcattgattgtcaacttttcatcgtttttgctggcaactttcatcagtccaggagttcctactcacactgatcttgataaattgctggctcaattcccatataatggactgatttttcattcgttttatgattataagttttccaacccagaatactacaacaagaaggttacctgctcaacatgccacttgactaaaattcccagatcaaaacactgttcacattgcggccaatgttttctgctcttggatcatcattgcatatggctgaataactgtgttggctacaataattataaatggtttctaatattcctcgtcgacatggattgggtatttctctacggtggatatttgaactacaagttccttaaaaatcaaatagcagatgaagtcccatggtccagctacttacgagagatttgggtgttaaggaaggtctcgttcgataatgaggtagctcaaattttgctgcttctttgtacagttctattccctgtggtatttggcttcacaatagagcattttcgcaatatttatcttggtgtaactaccaatgagactgcaaaatggaagttcatccaggctttgattgaagaagggatactctaccagtactcggacaagaatacccagtgcacatacttgattaaatcaaggctacattttcttcggttagacaatgaagagagcttcaaagatatcgatttcatgataggaagactatcaaagatcgagagcattcacgatatcgataatatctacgacaaaggtttcttacaaaacttcaaagagagaatgcgtattcaatgactttatgatgcaaaaatatgcataatttaatgtacacaactaatagtaaaagttataataatataataatcatttggaggtcaaactaactagagtttccgcggcagttaattcaggaagatccatgctggtccttattccctggatagcactggggctggtatctggattctcatccaactctccattcctaatcatctgtaatcttgtattgttcaaagaggctcgtctttcggggtttaatgagcctctgcgcctagattcaaaactctgtctagagttcttcattcttaaggcagcgcctttatcctgatcatcacttgtgaactccatctcaatttcttcagtttgtaatgaggatgcagattgtccataagcgttgtatcgtgcaatgttggcatcattcttattcttgttcttgtgaaatatggatttcatgaaactacctcttttaccagcaaccccgtttatggaatcccggtattcgtgattgactgccattgttggcttgtataattcctccttatatgttggctgttgttcagcaagcatatctctagagtattgtgaaattttctttcggttaggatcagtaggatcataatcgtcagggtattggctgaaatctcctcgatcgacgcattctctaataacatcaatatctttggggaaatagagcttttggaaaaagtcataagtgaatctcggtatgagacaaatcacaagaccaacaaaagaacaaacccaaaaagaaagtgtaccgtacatgctggcagctgctttatagtattcacccgagcttaaagaagatgaccagataccagtccatgcatataagaccacaatggaaaataaaatactcagcatggttagccaatcccatcggttgatatgaaacaggatatagatgttacaagccagaatggagatggttgcaacgactgtaccaatcaagtacctgtgatctaattgaaggccattcatggtcacaaatccgttcttatagtacatcagataagggaaaaagaaacatataacggattgatagaatccgtctcccatataccaccagaattttgattgtgtccactctgatctaagaattcctgtgctgtataattgcggcaccaatagagaaacaacatcacttacatcttggtcaaaaatacccatgaaaataactggcaacgaagtgaacgccagattgtagaacatcaaatatgtgaactcaaacaggtaggaaccatcaaagttgttgtagataccgtaccagaacaatgcaagtgtgaaaatcacgttcttgtaaaagaaacttggtatcatctctgctagtcttttgtatgaccatcgtccatgaaccaaaacaagccgtgcaaggtaacggaattgtccaaacgcataatccgatgacatagcagccgctcttccttcttctccggcaatacctactccgacgtgcgctgcttgaatcattgcgacatcattggaaccgtctccaattgctaatgtcataacgttcaaagagtccttgactaatttgacaacggcagctttttgagctggagaaacacgacaacataagacagctttacactgtttgcataacaataaaaactgtcttttacaatcatcttgcagagctatctttaatgcgtctccgtcaatgataagtccgaaccttggggacggtggattgtgttcttttcttgcttgcataagttcttccatagaaccttgcatatcaaaattttcttccaaatacttagaaataagcctttgaacaacctgtttttcatcagtgtcagaataatcctttcctaaaacttcatgaacatcttccccatgagtcttgataattagcaagtccatatatgaaccaagtaaattacaagagaacccaatgttgatggcggtttccactttatcaccagtaaggacccaaagtttgataccagcctgaccaagaagctcaatggcatccgggacaccgtcctgaagtcgatcttcaattgctgtaccaccaagaagaactagctctcgctcaattgaatcagcgcactcttctaaacgctcttctctgtcagtgatggatgcagccgcctcgtcatgtctaatagcccattcttcgtattcctcccattctagctccctttgagcaatacaaagggttcttaatccttctgtagcaaattgctctaaatggatggcagttctatctaccatcttggtgttatttcgggtcttggataagcgttcatatattacagaatcagcacccttgcaaatcaagagtgctttaggttttgcgtctggagaagttggtggaatctttataatcgcactcattctttttcttgtagaattgaattccaaagtactcaatatctgatattgtctttcttctccttggacgttcaaaatcatgcctttctttgttttatcaacaaacgtgaaacccatatcgctagcagtgctaacaagggcagcttcgtcgggagactgtgccttgaattctactttgcctgttttgggattctcttctgtaaccactgtgtgacaaagcccaagggctaacatgaagttttcattgcaatgcttttggacggaatcttctttcttcaaatcatccacaaacaattttgagacgaaggtaagatcttcaagagaaagagtgggattcttgcttatcttttgcagggattcaaacatttccaatctgtcagcttcaatctctttcttctccctggatgattcctcttccacatcaacaccttgtcgtttgcggatacctgcataggcttctgtatatgctctaccataagatactccgttgattgtacatttcttgaactccatcacattttgagttaatgtccccgttttatcactgaaaatgtactctatttggcccaagtcatcagaaatattccacgacttgggggtacatgggtagtctaactgtggatagtacattttgacgtccgaatagatgaagaatgcttgtgccgttttgattatctcgatggaaacgtacaacgaaattggaactaacgactggtacaaaataactgcgacgaaaaaggagatgataccgttaacagctggagttccaccaattgtaccaaactcaaaataagttctggaggtattgtcatttgtataataaataccattcactaaaccggaaaccaaacataggatgaacaataagaggaagttcagtaagacagaatagttcaggtctctggagatcttagatttcttggtgggtgtaattcctgcgtttatcatgattttagtatctacaccagtgaaaatgacgataccaattgcccacttcgtgtttcgtaaagagcatcctcttaaaagtaagttgttaatggttattggctcgctggatgaggagtatccatcatgaagaacaaaatttccctgataggaatatagattatggtgcggaccttcgctatcaatatgaaactggagcttgtccaagtcatgtgggcgtctgacaacagaggaggtacatttcaaagaattcttaaccttcagatttgtttcaccatccagatctttagtttccacataacaggcaccatcttcatcagaagtggccaagatacacacatctgcaggaattgagtcgttgttcttgattctaatgatatctccgaccttgacgtccttccaatagtcccttgaaaacttcaaaggtttgagttcactgttgaagggatcttcacctattgatgatctcatggtctccaaagatactctgttatttgcagcttcaggaagtttgatctccgatttcttgaataattttttaactgatcttagcactatgaacaaaagctttgtgtttgcctttttaaactttctccataaagaaacgttgcttgaaaggacatttgggttgggaattccatgcaagaggtgtgtgatttgattattgatctccatatccaaccctgtccttcttgagtcttctatggcatcttttattgccgttattatgacgatgacaatcaatggaacagcacttaaagctggattgggaactccaaagatatcaaatgctccaagaataatcatggttaaaaagtatacgttagcgatattccggaactgaaatgcaatatttttgggaatgaatgacaaaggggtgtatttggtagttcggatcttgtttctagggtaagtgttgcgaggatcgccattctcagcaagcatatcaggatccaaaggcaagttgtgaaatatcttacgttgttcgcctctgtgatcgttggcgacattggtaggattagactcctgtggttcttccttttcccttcttcgggtggtatttcgtcgccaaattgacttggacctcttaggtcggccggacgcgtgtctggttgttccccatcgcatcctcttcattttgccttcctcttcctccttatctttttcaatggaatcattttcttggtcgaattgaacgcgttcattgattcggggtaagtgaaagctggataaatgcattggattcggcgatttgagaatactgtcagcccttccaagttcggactcaccatttgacatgttctcgtcgaacctagcggatttttggggagaagtaaccccttttgagctctttccaaccattaaattgaaaaatgcagagtgtctttttcttgagcccttttaccgttccgttcaaaaccgtttcgagcggtggaattttgtgcggaagaaaaaataaagccgaagccgattagggactaggctgatagaggatggatgatccaagaggctttttaagtgaccgtgaagagctagacagtttacgaacagagttccaaatttagcaacgacggagtttcatatttttgtactcaaaccaggatactaagtgagggtttcttatcattactaattatatgtctgcgcacctaattcacgctcactggaactcagaaattaaatggcaccatttatataattagaaattgtattaaatttatgatttatcatataaacatgttactgaagagtgtttgaaaatgattcgttcagagagatcataagtaaccagtaaccactatactgattacttcgcaagatcgtaaagtaaaatgcaactaattcaccctctttaaccactacgtacatctgccctattgttcggttgcatatagcttagtgtactctttagctgtagcaattgcatcctgttcgtcccttttccaatgttcagccacctcgttcgacagcggatcgtctggattgggggcgctgagcaaagcctggattgaaagcaagatagttctaatttgtaaggcaggggaccagtttttctttaacacgtccaggcatattcttcccaatctgtctatatttggatgatatattttggttagaaacctgacttttggagcaaccatcggatagtcatcaggtaagtacaactcaagtttaaacaagccgtcttgatacggagattccttggggccttgaatagtgacttggaagtagcgtaaattatcctcgtggggaacagcggtgattcccggaaccggatcagaaatcaatctctgggattctttaatgattcgtttgggaagttgagacatgattggggaggcgaagaggtaagataaaggatagatggcccttttgaatcaatgacgtgcttcgcgagtcgtttctaggaggagatttgaacggatgttctttgaacggcgagagagacggagaacagtaccagattgaggaaaggtaattggaaagcaattagtgagggaagattactaaagtgctgatatgggttcatagcgtgggataccaaaggacatagtcgctagttatggttaccacttctgcaaatcctgtgattgttaaagaacatcattttcctcgttcgaagtttgcgcgagccttctaggaaatgtcaagcatacctcccctttatcgccaagggcattcgaagattttgcctatcaattagaaacgatggttaaaccaaaaggaccctcaactacccaaagaactgtggtgcttctacttggtaccggatttggcttgtactggggaatgaaatacttgaacgaaaactacaaactagtatcttataaaccacctaaagacgacaagccggttaaattttccctgaaatacagagatgtgcaaccactagaaaaaaggaaacctatagaagcggaaatagtggaggctacttccgaaaagaactgaacctgttaaccctgatcagtcactacaatctgacatttccccaagagaatcctttcctccaacttgtaaatatgggttctgtcaaacttctgagggattttcagaaacgatcctgagttgcggtttcgatcatcccttcacattgattgcaaattgaacctgacttggtcgccccttaccggtttcccatctccatccaatcaaacgtcataggtagtggttacgtaaaatggtgtaatcaatagtcaacttcgcgccttttaaagttctcaagattaccaagaatttttagcttaatcaaagaaaactgcctgatcaccgcttgactcactaacgttttgctctattcttgattattaaagacatgtcagttattgaaatcacatcgaaagagcatttcacccaggtgaccgatgttccaaaggacaagctgctggcgttatatttccacacccaatgggctcctccctgtatccagatgaacactgtatatcagaccctatcacaacaacaccctgaagtttcgttcatttctatcaatgctgataaccacagtgaactcagcgagatgtttgatgttagtgcagttccttttttcgctttgatcagagataacactatattgaaggagatgagtggcgccgaccccaaggaatttgtcacatccttgaatgagctaaccaacggcaagagcaccggagaagactctcaaagaaacgagcaacacaattcaactgcacccggagacgagacagaagaacagctgaatttgcgtctgtctaagttgacaagtgccgcaccagtaatgcttttcatgaagggaacgcctgcttcccctcaatgcgggttctccagacaagtagttgccatattaagagagcatcaggtcagatttgggttctttgacattctgaaagatgattcagttagacaaggtctaaagaagtttagtgactggcctactttcccccaattgtatattaatggtgagtttcaaggtggtttagatattataaaagagaacttacaagaagaccccaaattctttgagaacaccatatagctatcaatatcattgtacaattctcattattttgtcactgcaattccaatgttggtttttttctagtctttttcctttttgatgttcataattccatgttatctagttcgtcatcagtagtcatttcactatcttcgatggattctatttcactctcgtcagtggtacctttacttagtgaggccgaattgtaattcttccttcgttttgccagtaaatcctcataatacttgtattgatcaaatttaacggtgatttctttcttgggcagtttactgaaatagttaattttgtgttttgctcccgaatcaacattgccaagtttttccaacttgtccatttcatatctcagtttgaagactggcagatagacgtctttcaaaagatccgagtgcgataagcagtcgacaatactctctagagcctcccactttttgttatccatacgtgaatgaaaccattttacattggtgtaattctctagcaaacataaattgaatcgactccaaatgtacttatattgatccgctataagctccctcattctactgtttcgactaccatatagaacttttccaatggcatcaaacagacctatgtcatcatcctttacatcgctgaatccatgcttcacgttttgttccatgccgttaatagcactagatatgtcgcccatagagctgaatgattgcaaatctttgcattgggctccctcgttcctcaatatgttctttaatactttttctaaaattttctgtgttactttgttgaaatttattcttactaccttgctgtgattcaaaacttgcttatcaaacatcttttcaacatactgatttgcctcttctccttggctgttctctgaaacacatattatcagaggaggagttaaacctctgtagtcgagccaacgaagtagggcagaacttgtcttctctctggtgacgtcattactcaaattaggtaaatcatctactataatgcttttggcagtcttcgtatgtgttaatattaaacactcttgaagaaacttggcaaaatgctctgagcctttgccactttcatagtccaaaaccctatccagtccttcattctttccaaacacttcattgagaagtagcctactaactgctctagccactgtgcttttgccagttccagttggccccaccaagaatattattttaatgagtccctgtaaacattggctaagtgcggactggacctgtttgattttttgaggattcactgcaatactctctatttttctgggagcatacttttctatccaagggctactatcactcttcggccttttagagagtctgggtcttttagaaactctggttaagtctatttgcattgatagacaaccgacctaacacatgagttagctgtgagagatggaaaatgttgatcttagttgcgcgaggttctttcaaataactgaaccccttcgcgactcctccccttcacaaaccatttcttttgacacagcgacttatcacaccagccatgactagggctatcaaacctgaccattacgagcaagggattccggttttcaagccttctaccgaccaatttgaggacttttatgcttttaacaaggctgttcatccctatggaatgcagtcgggaatcatcaaagttatcccacccagcgattggattgacagtttacatgattccccagattatctgactcaggaggatctactgaacgtgaaactaaaaaatccaatcgaacagcaagtttctcttatgagtaacaaatcttgctttagtattgataacgtcgagaaacacagaacttatacattacctcaatggaagaaattgcacgatcagttgaagtatagtcttccacgtccacgaggagcgaagagtgatactttcaactctaaagatggtccgataccaaaagaaaaggaaggagaatttaccgcaaaaattgatacttcaatatacgaaccggattacattgagtttttggaatcacaatattggaagagtctcaaatttagtgctccattgtatgcagcagactcactgggctcattatttccaaagaacttaaaaacgtggaatgtatcatctttaccaaacttgttagactacttaccagagaaaattccaggagtgaacgattcttatctgtacgctggtttatggaaggcgaccttctcctggcacctagaggatcaagatctgcattctatcaactatattcattttggtgctccgaaaaagtggtattcaattcctcaggaccagcatagagaattttatcagctaatgtcaaacacctatccagatgacgccaaacattgccccgagtttttgcgtcataagacgtttttggtcgatccaaaatacatccgctccaacggaatcacagttaatgaaatagtgcatcgggaaaaggagttcattatcacttatccctacggataccattcgggatttaatttaggatacaatttagctgaaagtgttaattttgcaatagaggagtggctacctattgggttacgggcaaagaaatgtgaatgtatcgatgacagtgttggaattgatgttagaaaattaatggagtccgtttcaaaatgtatactatgcccaactttgatgcagaagaatatttttcaagagtctttcgataaactactcatattgggaacgaattctaaagcgcatagaatatgtggtaaactaatacctggtcttgaagtagatggcgatctcattacaaaatacttttcaatgattgacaatactaagctctccatctgtaattattgcggagagggaggatattgtgtttcctgcagttttcaagattgcaccaattgttatcatgtactctgctcattgaattccaatgtgtcgatagatcgatgtaaaatttattgtgaactacataaaggggaagctgttacgacctttgactcgctggaaattggggatattattagttttgacagcaagtatggtgagatcgtttctcttgataaagagaaagaaacaacgactatggcgaccttcccagaagcacaacataaattgatacaccgatatcagtttgactctatcaaagcacccagtaggaaaagggaaagggacaacaatgattctgaattagtcttctaacttatccatcaaggcgatgaataggaagtccttttctataatcaatatcaaactaacaacaatccagaatgtgtgcttgaactttttcatactcaaatatgagtttgtctctatcgtgcaggttgctagcaaaatagatgagagcataccaagttggtaaatgtgaaataatccttcaaataaagagttaaagagaggatgtgaactgatgatgggcgaaatatctctgtattgaaaatatagtatttcaatgtttgacgataagttaccagtggctagctgaacaaatgatattaaggagttcagcgatagcaacctttcattgaaggtaatagctaccgctagacagtatttctgcaaagaaatcatggagttttcctgctcttgataaccatattcctccaattttgactctacagcctcatctgactgaacagcagaggtccttatgttgtagatgaacactaaaaagatcacgactggtacaaagttgttatcggattgccctttgaaaaggatttgggagggcgcaaacagaacctgcaatatcctccacacttgaatggccacaacagttatctggatgtactttgcgggtatatgtttggtgtaattattcaatgaagctgagatgtccagattaaataaacggcttttgacaaatatcatgagagggaaggctagattcaagatttccaaaacgtaaagtgtcaaagatggatagctgtttatgattagagagaataatctctctgctttatcgttggactctcctatgaaatcgcaaaggatcaagccgtgaataatcaagaacggaatcaacgtggatagggagatcaccaccggcgttacctcataaagcaaaaagtcaaacgtgagatttgataaatctgacatgatcaggctttggtgttaattggggatcaaaaagacgtatttaagtcattcttgcttttgaaagtttgcgtatatttttgtgctaactaaactttacccgaccataccgatcgcgcgacattttatttaagctcatcgagaaagatcagctgtaccgatcccgtgcttgggaaatcttctccttttcgcctgcgcacgacaatttcactgtagttttttgtggaaggttagcatggcagcggggagccattacccggtcaaagtatgcacgtagatgctgagggaggtgagagttaacaagagaagtttccttttcgggctatttttgcatctcaattatgcgggcgaaatcaagatttcacataggcgagatgtgatggtgtgagcacgggaatgtactgtatatatataataatcttcacacaccattcttactctgaaatcggtcatttgagtttgaaaagtttttttcaacctccatgggttctttgtcaccggaaagtgacgtggagtttccaagcttattttctgtggacacttcatcgagcactcactgttcaataacagagtatgcagcagaaaagaggcccactttcacgattccgatctgtgttagttttccatactacgaacagaaaaacatgctctcagtcaaggtcaatagacgtcgagatactattgagatttcttggaggttgaagaagtggagacaaagatacatcgacggctcctataacagtccatctgatctggcaaatgaacagcctgaaataagcaaccacacaaccgagcaatgttgatcgcagggtcttccatcatgagctcaatattttgcatcatcatccatcaatggttgattatcgttaataaacacaccatcagtggttcaattcatcaatattcgctcccagcagtcacccaataagggcaacagacaacaacgaacctcttcaactgtccatatccttcatgaaacttccttcaagatcatctattgttagtccccacttcagagttgccaacttttcttttccagctccatatgttttaaggccagaaggctgaaaatggttgaaaaatatgaaaagaaactgccctatacaaataagatcaaataaatcgattaaataagctggttccacctgtgtgaacaaaaaaaaaagaaagttcttatgatgataaaaatagatctctacgtcatccctttttcctcttcccttccagaagcatggagggagacccgctgggcgggggagacggagttaggagggtcttgaaggatcgcgtcttctttagcaatcttcctgcgcccctctcacgttccccaactgatcccttcagctcaattttttttccttagggcctcgacccttgattgggaaattcaaaacacaaataaatagactcgtaatttttgctgttttcgcaacctggcacggacctttcattcttccctgcttccagaccacattttggtagtttcttgctgagttaagggaaccttcactccattcgcttcaaagactcgttctcttcaagattatcgcagaaggtgccttgaaataatcactcactatgaaaaattctttctcatccgataattaccaagagttcgatgtggaatctggtgatctcaacagaaagaggtccctggtaagacatgatagagccaggaatgatccacataatccgcattatcattatgccaatgtggtcgctcaggaatccgatcacataaaggtgcaatcttttgacaccggattggacccaacccgttgggattctctatctagaagtgcatccgcaagaggtcgttccattccgcttgacgacttgaatagtaaaggccaaataatgcatgacttcgaagatgactctactcaagtggatcctcgaggaacagaaatacaagggttaaacgacgaacaatccctacacaggaataacactatacgctcaaataaactcgcctctaaagttatcaagtctaaaagcagctccaagtacgagttttggcccatttattgtaccatcatcactttctgggccccatctcctttactaaggttgtttggcttcaaaacgaaagaaagacaatttgcctggagagaaaaaatggggttgatctcgatcatcttatacatcggtacatttgttgcctatcttacttttgggttctccagaactgtctgctccaatactagaacaagaatcgagaacaatagcgtctccaccggttatcttattatcaacggaagagcctacgatctcaccgcctcttctcatcccgctgctgctggtattgatgcaggaaccaatattctatacccccctatcaatgctggtggcaaggatgcttcttttctttttcagaacgtgaatggaaactgtaagggtcttattactccaaaagaggatagtgaaattccttttgacggagacgaagttgcttggtacatgccctgcaaattgtttgcccaagatggatcgtcgtctcccaatttcaccgcctctgaatactataatggctggggatgtcacacatccacaacagctagagatgctttctactctttagatgttacaggtgatgtctacttcacatggaatgacataagaaattcgtccagaaatttggttgttttttcgggtgatgttttagatttagatcttatctcttggattgattctgataacttgaactatccagagttatttgatcgtcttcgcacagacgagcaaatgaggggtcatgatatatctatcttactatcttcttcttctgaaaggaaggctgcacgatgtttagtagaaactatcaaggttggtgtaatagactctgagacaattggctgcattgcttcggatattgttctttatgtctctttgattttcattttatctgtggttatttcgaagtttttatgtgcctgctactttaaatgggttatctctaggagacagggtgccactacatcttctaccaaagaaatgaatgaacgtgagagagatatcgaagattgggccgacgatattaacaagcaggcccccgttgcttctgttcagccatttcaacgttttgattatcgcaaccagtcgaaaggaaatagagtctcgaagctttttaacagggcttcaagatactctatggcgacgcagttggacggctttgattacgttaactcagttggaactttggcaagttctgcaaaataccccatgacaactatgactcttcaaaccacaaaaatgcttcgggcctcaaaggacaggcgatcacatgtgagaaacaggtcatctgttatgttgaataccaatgcttccaggcaatcactattgttgggaagcgattaccataacccttttgatgctaatgatgggttctatatacagtcgttatccgctgatctgattcatcctgatgttgcaccccagcctccagttgagtaccagccatatgggtatcccttggcccatgttattactctaattacctgctactctgaggatgaagatgggctcagaactacaattgaatcgattgccactaccgactaccctaactctcataaacttattttagttatctgtgatggtatgatcaaaggtgctggtaacgacaagactactcctgagattgctcttgacctaatgacagattttgtgacaccaccagatgatgtgcaaccattttcctatgtttctgtcgcccaaggctctaaaagacacaacatggccaaagtctatgctgggttttacaattataaagactccaatctacctcctgaaaaacagcaacgtgttcctgtcgtaactattgttaaatgtggtactcctgctgaaactggagctgccaaaccaggtaacagaggtaaacgtgactcccaaattatattgatgtctttcctccagaaggtcatgtttgacgaaagaatgacccaactggaaaacgagatgttaaaatcaattttttcaatcacagggttaatgactgaaatgtatgagattgtgttaatggttgatgctgacaccaaggtgtatccagactccttaacacatatggttgcagaaatggtgaaggatccaacagtgatgggtctatgtggagaaacgaagattgccaacaagagacaatcctgggtgactgcaattcaagtttttgagtactacatttcgcatcaccaagcaaaggcgtttgaaagctgttttggtagcgttacctgcttacctggttgtttttgcatgtatcgcatcaaaacgcccaaaggccgtgacggctactgggttcccattcttgctaaccccgacattgtagaaagatacagtgacaatgttctggacactctgcacaagaaaaatttactgttgctgggagaggatagatatctttcttcgttgatgcttcaaactttccctaagagaaagcagatatttgttccaaaagctgcttgtaaaactattgttccggagaggtttaaagtgctcctatcccaaagacgtcgttggatcaattcaacggtacacaacttgtttgagttgttcttagtcaatgatttatgtggaacgttctgcttttcgatgcagtttgttataggtattgagcttgtgggtactttagtattgccagctgctatttgtttcactgtttacgtgatcatttttgccattgtttctcatccaacacccattctgtcactagtattacttggtatcatttttggtcttccaggtttattaatcgttgtcacagtgtcttcatggtcgtatattttatggctactcgtttatttggtcgctctcccaatttggaatttcgttctcccatcatatgcctactggaagtttgatgacttcagttggggtgaaaccagagtaacatcacatgaaatcaaagatgcacatggagaaatcgagggattatttgatggttcacatattatccagaaacgttggagagaatttgaaagagatcgtaggcgttcaaacagtccaaacctaaatcacagaggaagtgaactgccagttccatctgctgcttgggatccagccaatataaatcacgattttgagaaggattccgatgtgtatgtgaatgcccaggaggaagctgagagttccagttcacaaaattacttaaaatagaagaacaaatgaaatatataaggatcatcaatgcattgaaaatatttattcactcaaactcaacactttctgtaaatctctttcgtctgtgaatggtacgtatcgtagaaataatggcttcaactcgtggatctgatcttgaatgtttctatcaccatttttctgaactaacgaagagatgccatttatgattgtttcaatttctaagtgctgtaatctgggaagaggtcttctgtctaataaagacttgcaaacaataactctgtgtaaagcgatagctgttctggagataaaaaatggtgtcacaactttttgaaattgtggatcactgcaaagatcgatcaaatcattcaaacatctcaaactaagattctttcttggatgtgtctgtatagggcttgtggtattggcaattgtatcaaacgggaaactgagtaacctggagcataaactctgttgagctggaatatctttcagttcatcaaggccaattaatgccgtttcagtatcatcgaactcataaagaaacgaatttttccagatggagtgagcaaattcaacttgcacacttttgggcatctcagtgagtggtggtattaagcatgcatacaacttgtcatattgaacgatgtcaaagcgttcatagagcgagttttttccatagtaagacagaatggtatcagttaatctaataaacagcatcgaaagatattcaagggaactgtcgtatgactgcagcagtttttgagatagatcaaccaagattctggaggcaatcatccacaattcctgttccgtttcttctaatcctactgatcgttcctgtacaatagttaacagttgttcaaacagcctttcggtgaagcttccaagatctagcaccttagcgggacttaagtcggccagcttattttcaagcacgattattgccttatgactgaaatgaatgtaagtaggaacttgaaagccagaatcttgaactttcttgatgaacttctgttcaatagccgacttaggtgctaatggaagcatggaaatatttgctaactgctgaataagcatagacttgtaatggtaatcatcaaactccatatagccaagaatattgagaactgtctcttgaagtttagtgctcttaatagaatcggatgatctagtagatggtaatatggggtaacggatagcagtgttcaaaatggcaagtattctttccattttttggacatcttggatcgggctcaccatcttatagatactatcaaacgactcaaaatacactacaagcgtatcttgagctaaagggttcacttgatacagaatctggtaagtagaccaaaacgagtaaaataactctttaagttccgttgggatctcgtgctccaaaccttgctttgatagctcttgaaattgcttgaagatttgatactccagatctagccagttaagctttaaaagtttttcgaaatacccaaagagtccctcccaaaataatagtaaactcttagtgttcttcgaatcggaagagtcaaagcttaagaattgactgctgtacaaggagcataaacctcgcaatattagggttatactttccaagtgatcggaatctaaactatcggagtagtcaatggtataaaattccttctcaatcactagcctatagatcaacttccagcatccaagtaaggaaccatgagaatcaataattgagaaacatgtagatattgcaccattgcgaacctgagcccttggatctgaagcagccttgtttagggatattataaggcaaatccatatcaagtgatctataagtgctgggtcggtcgaaggtgaattgatgagcgtagttaggtcctctttgtcattcagtaccaaatccaaattttcaccaacataactggaatcttttgtggcattgaatgagtttttcaaagagtcactaatcagccaaaagtaacttaaggagtttagtgatatatttaaatcaagtgtctggtaaaaaaatttgcataaaatatcaattaatggtttcaactgtttcttcggcagtgatgtgaggaattcgtctagaagcaatttgacagtttcaaaattagattctaggagttggccaacattgattctcaattgaggatcttttaataagattggatcttctaatactgttttttcgattaattggaacggggcatcaaggagtgtgtatactaaactccaagattcagcgaagttgcttccgtatctgttcagcacggtgctcaaagttttcaatactcgtagtctaatatctgtttcacaattaactatcaaaagttctttagaagttggaaggtttgataagctagtgtctattttattgagtgaattcagcacaacgtgttcggtattcctgatctcatcatttgtgaacccgtcagcagctattttcttcacgacagaatcaaaagaatcagtgatcaaaaagcgagtctgatcatccaatgttctttgttgaataatactcttgtaaaattccaaagtgtaatcccaaacgccattggcagttgcaagtagttgtatggtattgttttgaaggatatttgtaagctttccaacaaaaaatagcttattatagcttgatgtcctcaaagttaaatcatcgttttcttcaaatggtactttggagccaccctcttccagaagtaactctgtagtcaaagtcacaaatgattctattattaaactcaatgtagtagaattgtatccggaaacggagtcttccaatttaacaatcgaatcttgaatagataagatctcttgggaagaaatcaaatcagcagaaggtttatcttgcggcaaaagcttatcagaggatgccccattcagaaagtaatccaaccattgaatagttttaaaaatcaaaatccactctgagccatcaagtagattgccaagactaatcaccaagtttatgagcattcgaaacaacacagccatacgtgagttgaatgaacgactataaggctggatactggttgatacattggatactggttgctgcgacaaagtttgaatcgttgttgagatagtcccaactatactctcgcctaatgattttgatctaaaacctgagcttccggtcagatttgtgattgatttgcaaataagaaacaagagtttttttctagcatccttgaggtccaaaaagctcacagtcagcgtcaatttttgcagcgattttgtcaatccattaaaaagagtttcacacaaggaagaatacagaaacacggttgccatatctttccaaagcacccagttatttgacaccaaatctttaatttcgatgtatgaactagagtttttatctagtccaatgacagccttggaaaggctatcacacatcgaagtcaacgtttgaagtatgaggtacagcatatatgtggacgaagtttgtggaggttccaacttatctaggtagtcaatgaatagaacttttgaagaagacttggccaccgtcagacctgcaaaatcagccggtttttgatattctctagatataaatttgggcagaatggtatcaccggtatttaataacgacttattgagaacaacgatctcaaaacaaacatcgaaaaagctcttgaaaacggttttctcattactatctagctgagaatcgtatgtcttgtgaatttgttgcacaagagtaaaatctttaacaatagaaagatatatctccaaactcaaaacctttttccagaacggtgagtttgaatcttttgtgagttgaaaagtaagggtggataatattggcttcgattcattcttcagtgttgtgaaatgctgcaaaagcattagttgaatgatgcgagctactcttaccattattggaaactcatcagatgaggttaggtaatccaatatgagtggagaaatctttattcgcagaagatactccagctctaaatgctcattgaacagctcactattgtcttttaatatggtttctaaaagttcaaggccaaactcttcactgatcgagtttgttttcaaaaatataggcttttgatgttgtatcaaattgatcaaatcaagaagtattctttgggaatcataggcacattggcgaacttcgatagttttattgtcatccaaggaaactgtgtaaactggatcatctggggatattttgctgtcctctattttaattttatcgaatacgccagtcaacagttgtagatatgtggcactggcagtattgatgatagctggacttttgctttgtgtatacaaattggagcagacaaacaagaactttgatagcaattcattcttcaaacggattgggtagctctgtaataataatgacagcaattgaaggatttttaaatgaacatcgtcacttttgaactgggaacaaaccagtagtgaatttaccagtgactcaagttttgtatcagcaattgcgctctctattattagcttttgtaaacaagcaagtccagtatttaccaatttgagggaccttgtttgtatagataatagaaaagggtcaacgaaggactcaaacttcacaagctcttggatggggaccctttgtttgaaagatcttatcatatctatagatgcatctgctgcttctttcagctcgggatatttccttttcgaatcatgactgagagttcctagctcttgaaccaaataggccagggtcataattgactggactaaactttatcaaggggatggggaatactgacatcgctattatctttgggaaccagataatgatgtggtgtagggatttacatctatttcatgtgaaagaggatgatttggggagtttgaaatatatttatcttgttatagtgggactgatagatatctcaagtgtgtctggtctgttgtagagctaggatcgtttaatataaaccttggagtgtcaattgtcagttcacccatccaaaacttttcatcttatataatcatctcggatctcgatatctggtgcgtatggttaacctactaaatttttactgaggacaatactaccccaatgaacggaatatttgctgtggaaaaaccttatggggtcagctctaacaagtttctgcaacagataaataatatttttacaaactcttcgatatttggcgctgacttggctgagctgagaaaaaggaagctagctggctacggaaagaacagtgccagaggactaaagaaagccagcaaagccaaagttaagatgggccatggtggaactttagaccctctggcttctggcgttcttgtaattggagtgggacaaggaacgaaacggctacaagaatatttaggtggctctaccaaactgtatgaaactgaagcattgctaggagctgctacaaccacaggggattcagagggagacgttatttgcaaaacggaagtcaaccacattactaaggatatgtgcttgcaaactgctaaaaagtttgttggggagcttatacaaactccacctctgttttctgctttgaaaatgaatggaaaacctctatacgagtatgctagagagggcaagccattaccgatggaaataaaaccccgaacggtacaagtttattccttagaagttgaagaaagtgatttgttgtctactgaccatgattacaaattaaaagaatcaataatcgatgaagacggtacccctctagagtctaagttgtctgaaaatcctcttcttcaaaacgacaagttacattttagcaaagaatttatagagtcggcttcccaagaaggtcttcgcacagatgttgaccctccacatttaatcaaagatatttcggtccaaatatcaaaagcaccattgttacattttgtggcccaggtcagctccggaacctacataagatcacttgtttcagactttggaaaggccttgagctcatctgcatatatggtcaaacttattagaagaaaacagggtgaatgggatttgagcagcaattgttttactctggcagattttcaagaaaatgaacaggtctggggtcctgtcctcaagaaagtttttgaacacggtgacgagattaatgttttggaggagatgcaaaggagtaaagagaagtttgtgcaaaacgaacatcaagaacagtccgaggagacgtctgaggaagtaccgaaagaaaatttagaagcaaggtctgaggagactacgaacaagacagatgaaacgttcaccgcttaggttgaaaatttcgtttcagaatgggattatagcaacttagggccgcatttatgtacataattcatcataatagcttgtaaataatgataatccacaacgctatcactacctcaagattccgtttgactgacaatctagcaccactgctttgcactataaatcccagggcattgcagctaacataatcttcaccttcatcccaataatagctttcacgtattgtttcgttcgtggtagggcatacaaatccaaaactgccaggacaatccctgactattgcattgcagctgtccacacacggtaaaatctcataatatggattgggaggctggatttcttcgttgatgaagctatttcttccgtcagaggtagttctgtacttgtaaccacttgtattgtttctagttgtacacctcggtatcaaaacggaacacagccagttttggtaggaattggcacaatcttgacaagttcggagaggcgaataccttgaagaagcatctgtatcgcattgcacaatttgcaaactttttgtgaaattttcgtaatgctccttagcataatcatcatacaaggctcctaactcggtcgcagatatcaagccatcgaaaaactgcatggacattgggacagcatagtctacgttattacaaaattccaagtcatagatcaacgtgcacgtatcttcaagcattgtttcgaattcaaactgatgaaaaactgttccgccgctgtcagagttttgagttcctgaattctgagttaagtatgcaatgtattgggatgacgaattcagattttgaacataaaattgttctctaatagattcattcttttgaacaaatgacgtgttgatggatatgctagatagttccggaccacttttgatagcacaccaacttctattcaagttttgaaatgtcgacttataggtgtaatcaaagagatgaagagaataagaatcagttaagccaggatcaatatcggaaatgttggaataaagatcagtatctaatgcaccggtcattagtaaagcagattcaccatcagcatcaagcaaatgggcccaagcacgatcatcccattgaaagaccagaccattttgagagatacccaactcataagtccattggcctgagacagtatttgttccaacatcattaggttgcattgcaacatacagagtggaaaacggagctgatgttggattagaagcaagagcttgaacatatcccagcctgaagtctaatttggtcatttggtctatagtctctattgagaagacagactgattgaaagtgtaatacagagatagtccattttcgtcaagatcggtatctggcaatgaacatatattacctgtaataaaaattaaggcatcaaaactgctagaaacaccgggattggtattgtttatgggaaactcgtagtagtgagtctcattttgggagatatacttgcgtactggcttccaatcatttagctggctatcgtcaccaatacttagatctacagaagtaaacctgaaactcctatgaaccaaggcgtcttgatcaatttgtgaggtgtactctatatccctttccaaaaaatctagtggttcaatgtccaattcctcaagctccagacactgttttctatcctgactatcattcaactcgtcacactcaagattcaagcattcttgaagcgtgacttctggatggtagtaagtgtgcctcaaaaatttaccgtcaacagttgtgagtaaatcatagcaatgcggccacatgttggaggacagcgcttgaactactaaggaccacaagagaatgccataaatgaaacaaaacatgttgaacttccaagggcaagtgtgatgttgaaaaaaatgagaccctggaaaaagccgagttccgagcgtagaacaaatgaagcaacgcagctgggggtcagggaaaggtaaagagaatgagacgagactgacagttgaaggtggataaaacgaaaggttcggacttaatcgaggcctgacagctcagttatcaaagggattccttccagtttttccagccagcctgccgcataaacttcccagtagttctgtctcattcctaaccttcgcgcgcccttcaactgaaaaatctagtccagaaagcgcgtctggtttatttcactacgataacttactggaatcatgtcaattagagctggtcaggacaataccaatcttccatgggtggagaaatatagacccagcagcctggattatgtgtatgggcagcatgatactgttgatacggtgaggaagtttgtgcaggatggaagacttccacaccttctcttctatggtcctcctggaaccggaaagacatctaccataatggcgttggcgaaggaaatatacggcaaaaattatcgaaatatggttctagaactaaatgcaagtgatgatagaggtatatctgttgtccgagaccagattgtgaactttgcaagtacaagacaaatattcagcaatgggttcaagttgatcatattagatgaagcagatgccatgaccaacgttgcccagaatgcattgaggcgagtaatagaaaaatttaccaaaaatactaggttctgtgtcctagctaattacgcccacaaattgaaccctgctctgctttccagatgtacaaggttcagatttcaaccaattagccaagaggctatacaattgagaataaatgatgtcattaaacaggagggaataaatattgatgatgatgccctgcaatctcttttgaagttatcaaagggtgacatgaggaaggctttgaacgtgttgcaggcttgttttacaggtctggactctccctctcaggcaataacctcgcctatgatatacgaatgcgttggtgctcctgatccccaggatatagagcatgttctggacacaattatacaagagaattgggaagctgcattcacaataatgaatcgactgaaacttgaaaagggttacgctctaatcgatttggtcaatgggtttgtagatattcttggagggtatcagttggaaaagatgtgtcgactaacaatattgaaggggcttgcagacattgaatatgcgatatcacgcggaggtaatgacgctattcagaacacagcggtcattggagtcataaagaaggggtttgaaactcagacttaggctacttgtcaagcatctaagctggttcattccactacgataagatatatgggtgcccttcgcgcattcacttttgtcatgtctaacttacttgaacatggttaaatacatcaatggtgacgtctttgcaattctaaatcaaaagtccaatcttcctgttatacttgctcatagttgtaattgttttggttcatggggtggcggaattgcatttgctctgaagcaaaagtttccatcaagctacacactttacagtgattactgttccagatttcaggacaatccccaggagttattgggcaagtgtctcctattaccaataagtaaaaccgatcctggatataccagtgtcgtcggggacaaattcctcattgcttgtttgttcacaggcgcaagcggtggtaaagcggagattttgaagtacactgatgtgtctctgtcccatctgggcaagatcatccagagcaaaaaatctgaaataagtattccaagagtggacgaaattttgcaatccatcaatacagatgacgtccctatctacctgcccaagataaactccggaattttcggagttccctggccaaatacagaaaaaatattggagaaccataatgatctaaagtttgtagtgtacagtatataaataattgacttgactctaaaggttaacatcccagatatctgttcatgtagctattgctggcaacgtaggagaacccttggaatgcgtcttttgtctttgtagttggtattaaatttaagtctgtggatacatcatcgcttagcttcaagtcggtgaaatctcttgagaaattctcagctagctcaagattcgtgattattggcacgattggagggctaatcttagtcagatctcttttcagtagtgcgtcccaatcaatatttctaaaaaaagagtgcttctggaacttgttgaatgtagtgtcaacgtctctcttggctggtgatttattgagcagcttttgaaggagctccttagcggttggagttaaataatagggaaatttgagtgtcttattcacgatcttgtccatgattatcttactgtttgctcctgtaaatggtggtttcccaatcatcatgtcaaagattactgcaccaagtgaccaccagtcgcaagaaaatgagtaaggatcacccttcaatacctctggagccatgtattctggggtaccaatgatgcttttgaaagagccatcgtgttcaatagatgaagcaccagtatccagtgattgtttgctaagaccgaaatcagttagcaccagaaaaccctgggaatccagtaaacagttttcaggcttcaagtctctgtacacaattcccatggtgtggagatagttgatggccaaagccatttgagcggcataaaaactagcaatgtcctcgcccaaaaacttttcctcattcaaatgctgaaacaactctccaccaggaacgtactccatcattaaatacaacttgtcgtggtcatgaaaagcgtagaaaagcttgactatattaggatgttctgatatcttgctcagaatattacgctcttccatcgtgcgttcgacgtgcttttcgttgatcaccaggcttgctttcttcaactccttctgggcgtatagtttggacgtgtgtttattcttgaccagcttcacggttccgtaggcaccctgtcctaagacggtgataggctcaaaatccgaaatagaagcatttgtttcttgctcgccctttgtgtactctgtgatcgatatctggccattgcctgtgtcttcgttgtgcactgatatcttgctatagacggaactttttcttcttcgggttggagggtgagctgagctcagatttgctcccaagtgttctacaaggtcagcgtggccgtcatcgttgtcgctgtcactttctacgacagtctcatctaagtagaaaaccatatctaaagatagttagactggagccaaggccaattgtgggttctagattgataaaaaaaaacgagacgataagatgaggaaggtaccacacatgggcattcttagtgcgcgagagatgattagcatcgagggaaagcttaaacatctttggtctacgtaagcagagaccaggcactagcaagcctaattagggttagggaattgaatgtcagcaaaagctgaggcggcttccgagggccaatagaataagaaagaacaacttagggcgcaaacctgattgcgattttggggctttccttggaaaagacttgatccctacgctgtggaaggcgcactactatcgaagctccctctaacctcccaaaggagaaggaagggaaaaaaaatagtgacaaaaagaaaacaaagagcccaagacctctatcgccccatcgcccagatctcctatcagcaaaattatgtaagctgcatcttttggtgagctaaaggggactttcgcgctaacaaaaagagcaaacttgtttgttgggtgattgttgggtgttcaaggcacgactttctaatctaccttgcattgacagattcttccaactgcgcccgatataacgtagcattgccaggtaatgatggtatactttacatggtcacactacgacgctcaacatcagtccctcttagtggaaccacaacttgctcgttgaattttggagcgtaatgtgtcatgttgggtcctgcaaaaagaaaagttggatcccataaatttagactttgtaggatgacaatctacagagatttctcgaacttcgggccttcctataaaacaagataaactccttcctctttctctttccttctctttagtcttctcacttcatctacgccacacaatggagcaaccacaagcaatggaaaaggttgagtctgtcgacgttacagaggcaaacgcagttgctgctggaaccaacaaactcaccaagagaattgtagctgctggtctgggaggtaagttgatgggtaccaagtcaatggtcgacgtcacagccgatcaactggctaaggactctatcaacgagcttttggccagagacaaggctttgaaggagaagtacgagaagcagaaacatatcagtgaacaaccatggactaaggacaattggcaccaacacataaattggttgaacatgatcttggtttgcggtttgcccctgtttggagctattgcaacgtattacaaaccacctaccaaggagaccgttatactgggagttgttttgtacattctcggtggtctgtcaattacagctggttaccacagactgtggtctcatagagcctattcggctagaactccgttaaaggttttatttgccctctttggagccggagctgtggagggttccatcaaatggtggtctcactctcacagagttcatcacagatacacagacactcatagggacccatatgatgccagaaagggattctggtactcccacatgggttggatgttaaccaagccaaacccaagatacaaggcaagagccgatatctcagacctcgctgatgactggattgtcagatttcaacacagacactacctgttaattatgactttcatggcccttattttgcccactattattgccaagtatttctgggacgacgcatggggtggatttatctacggtggtatcttcaaagttttcgtcattcaacaagccactttctgtgttaactctcttgctcactggattggtgttcaaccgttcgatgacaggaggacaccaagagatcactttttgactgctatcgtcaccttcggtgagggataccacaacttccaccacgagttcccatcagattacagaaacgctctgaagtggtaccaatacgatccaacaaagattgtcatttacttatcatctaaggttggattgtcttacaatttgaagactttttctgacaatgccatcaaacagggtttggtgcaacaacagcagaagaagctggactccatgagggctcatcttaactggggtactccattacaagacttgccagtctgggataagtctgagttcttcgagaagtctaaagataagaaaggtttggtcattatttctggtattgttcataacgttgagaatttcattggtgaacatccaggtggagagaaacttgtcaagggtgccctgggcaaggatgctactactgctttcaatggaggtgtttatgcgcactccaatgcggcccacaacttattagccactatgagagtggctgtcataagggatggtaacgccaatgcaaacactttctccttgcagaacgagtttttggacaagaaagccgccgctgcagctgcttcaaattaagcaagtatatatataaatcgttagggaaattttattaggtgttattgtgattattgtccgttattactgtttctgtagtaaaagtgtcgtcgtattcttcgtcgctatcaagttcactgggctctgtaacttcaactcgctggacttgatgaacgaaaacttcattggattgtgggttatttgaagatgcaacagtagaagatccctttttcttccgcaacccagttgaacgaatatgatctcttgttgtactaaatttgtttctaatgttatgtttaaaggaggacagcttgacaaatcttgctttttttggcttctcaatatgagaaccaacaacagaactagataaggatggggagttgtcaattgaaatgtcaagcttcttagagaattccacatggtcgcctgtaccggatatactccttctatttgtactttcaaggacatcatcctcgtagtaaggtcttcctaagacacttgccctctgaaccatcttttcaagatacgaaatacggtttatccattcccaagtggtcacgttacaaataacataagatgtaacattgaaaacttcactcaactcagagacccaaatctctgaaacgtcagcaatgaaaaaagccactgtaatattaatggctatagctgtgaacgcagttagcaaaaacatctctcgatcaaagagatactgacttttggaaaaagcatacacacaaaccagggaagagaacacaacagcaagtgatatccgtaataaatacatgaaagcaggaatcatggctagtttagactcatcttcggaatcatagtaataattgctggaaagaaaggcagataacgcccagattatttgaatgagaactgtgcaaatagttcccacaatgaagatgtaccttttttcttttcttctgggaaaaagacgagtaatgatctgcacttgtgccagcaaaagagcaaagaacgcaaagaagagaacaacgttgatatatatccgggagttgagatatgaaatcaagagatcagcgttggagaccccttcgtatcgatgttgtctattgagttccacaatagaagcaacaaaatacatcattatggccacagcacctaacagtatggagaggcgtagcaacttggttggtcgttgggaatgcagataatttttggtaaagacaatgatggtaaggtagcctattatgacagcactagcgctcaatgtataaataagtggataaatggaggactccaggggacttgttgttggagtactttgagatgcaaaaagttgccagtcctcgtctataatgggaagggtactgattccaaactcgtcttgaagtctgttattcatggcactataaacaggatggccgtcataacatcttgcatgatacttgatcgaggaggagtaggccatgatagctggatcggtgcacattattatcccttcacctagttggacaccctcacaggttgggtaagtgtgttctgagggtactctatatcgccaaatgatattcctttttgagatcgtcatcctggtgaagtctagagactctctcctttgaaagttcagataataacggtgtagtgagaagatctttcactgtctgcacaggtatcactcagggtcctttttctggaacttttatcgaatggaagtagtacttaggcctggtcaggaattcttaccgtaatcagttttaagtaggaaaattacctcgcgaaggagatcaggggaagcctggggacggaagtgacaattcttaggtcttaaggtaccaaaatccgggctactcttgcgcaacatgtagacataaaagtagaatacacaccgttaataagagtagttattgcgcctttagggaccacctttctagtttaaccatcagcacgtggctggttgaacctttttttagtttcgactccacaatcccaaatccttctaaacagattatcgagaagaacctagaaacaaaaaccaacacagttttctttgaacgagcttgtttatctaccccttaccatttaatgagtgatcggccggtttccgccagcaatgcagagtctctgtttcaattataccgagacaagagtcccgaaaagcctggtatagagtccaaaaggaaaacggtagatctcaatgggagagaccgatatgggtttaagataagtgccagctttgtggaccaggaaaagtataacacgtggtgggatcagtacagtcgatatctcattagacgtaaactaaagtgggtcaagctgatgaataaaaatggctttgaagctgatgaggactcaatgccgaccaaatttccaacaagaagcgaagagctcaaacggtatgtcaggaagggaatccccgcggaatggagaggcaatgcatggttttatttctgcaaaggaccagagagattgagcaaaaataaaggattgtacgataacctgtgtgcaaaaatggatactttggatgaggttaacttggaagctatagagaaagatctgcatcgaacatttccagataatatacattttaatgattatagtggcgaagaatctctcatgattggatcattgagacgcgttttgagatgctacgctctctacaacccggaaataggatattgtcagtcgttgaactttatcgctggtcagctgttgattttcatggacgaagagaagacattctggatgttggtcataattcatgaaaaattactcgtagacgtgcacacgatgaatctcgagggtgtctctgttcaccaaggggttcttctactctgctttagacaatatctcccgttaacttggtccgtcatgcgggaacatgacaccatcaatgacgattttttagtcaacattccttctttaggtatatgcaccaccagctggttcatgtctttattcattgggattctcccggtagagaccgtgctacgaatttgggattgcttattttatgaagattccaagtccattttcagaatcagtttaggaattttcaagttgatggaacctcagtttgtgaaaaccccagaggatgaattgtaccatctgattcaaagctttcccagaacgattttgaatccaaacgatttgttagacgtatgctacagaaagcttaattccatcagtcatctgaaacagcaggagatacaactttgcaaacagtatgtgataaactacagagcaaaatacaagaatttgaagcatgaagacaacaacttactgagcaatcaagaacgactgaaattactacaagagggcattcaagagttcgggaaacctagggtattgaaagggttaaggtggaacagcaggttgaataagcagattcgaaaactacgggttgaaagtgagcacgatatctaacgttcatttttcgactcactacctattgcaaataacattggatctaagacctcaaaatctaagctaaggtagccgttccaagaaggtggcactattcttgcatctatattcttctcttcccactctctattcttttgaataacatagtcatcaacagaggtctgggtgtaaaatgacaagataccaaaggcaagaatactcaatttttccatccaccagtttcgtttagctttgagtagtctgttgatttcagtaaccactttctgaaactcttcatcggtaaaaatattagataatggagaatgagaagtgagtccatacccatgttcttcgtaaattccatcgatagtgaatggttgtgtttctagcgtatgctccttgtctgtctgctcatcagcacgtatagctgcaggctcttcaccaggcagcactgtgctgaatctgatgtaagaatcgcccggaacatcatgaactcttggaacccttactattctcgtgcctttaccagcagaaagaagggaaatgtaagggttatcgaagtgggtaatgattaagggtttatcatgtgatcttaccgttgattctcctatctttttgtagtcgtatatggagaattcatggtaattgtagaagaacagagtcatgccataccatttgcaaataattgttctgtttggagttgaaaatattgtaaggaaactgtgtcgagcaccttctgttgagggagcttgcaagcaagatcttcgcacactctgttttcttcccaataagcaattcttcaaacatgtccgtcaatgaaattgtgtttgcccaaaagtacttggatcttataaatatcacgtcgccaaaggttctttccgacaactactctgttccaatttcatctgtcaaatcacctggagatctttcgtttcgcaaactgaaagtcaaggctgttcctccaccaaggggcgaagtccaagtccaagtcaatttgagatctatcaagccaccaaagttcagtgttgactattcactgagcggtaaagcgacgatatattcgctcaaacagaagttagttgaggatggccaagttgccgacaaatcaactatcaagctgatgaacaagagcaaaattgctggggatgaagcttccttggaagacttagcaaaagacaacaaagtttctttggttgtcatggtatctaaagagacagcattgaacgtccaggaggatgcagaaccccagtcagaattgccttccagagtaatcacttcccaatcctggaccaagatccatcagctcctgcgcgatgatctgggtgagccagaggcctcgaaggtgctcgacaggtggaagacttcgtcatcctagagacaatagagggaagaggaggaaacgagttcctagtacatagtatggattttgcgttgatccatttgggggcaggaaaacacaatgagaagaacaaagatcactatagaaatctttgtttcagagccttaaaaaggaagaagacaaaaactaaggcaggtagccccaatccctataattacgttaaggagcgccaaagttttgaggagttgctatcagtactggacagtatagcaaatgtattggaatcttctccacttacaaatacaggcagaggagcctctgtcaattgtgaaggaaatatcttatgtgatgctagcataattctgcaagaatcaaaaatactacactcgtcatgctgtgaaatcacttcgccatttcctatctctgtcataatagataactttaaagagcaattgaatccacgccatgatcacatcctctcaccattagcaactgtgtatcacaagtcctcctgtcgaccttcattaattacaccctcgaaccaagatatctctgacacaatagggatttccctattgaacaatagtatctctttaactgcatcatcatcaggaggcaacctattcaagcccgttggtcgtatcggtcccgccggaatcattggctccgctatctattctgatttcaacgattgctatcgagtatccataatgtgcaccggctcaggggaggatatcatatctatggatctagcaaggtcggtttgtaattatctccttgctaacatgacagaagatgcatttgcatccgaattaatgtcgaatcatatcgaaaagtgtgccagcaagtattaccttagatctgaatatggactctatgttggtgtcgtgggttggatactggacgcgcattcccgtgatttacgagtaatatatgcacactctactgagtcactagtgtttgcatattttgattcgcatttaaagttctattattctacgaataacaaggttggaaagctgttacatggggagttcaaatgcagcagtccgtgatcatatttcaacctgatgtcagcaccagaatctggtctcttgcccactgaccctgtcactcactcttggtttcagtgcggacactgtactcacgtcatcaagaaccttcgtcattcatgttgcagcactttcgtaccccttacataggtcaattattccgtatgagtgtaaccctgccaacccagtcatatctcctgtcaatctactattattttggcgtctttggctgcttatgtaaatacaactgtggcgcggctaggctcactttctgcgcttactgcatgcgcgaaaatacccaatgtggtatcctccttccaaactattctaggcgcgagcaatagtagcttttgcgtcccgcttacctaaatggttttccatcctcttcctgaaaaaaaaagacaataatacactttactgacctacaaaaaggcttggctactacatcagacggcacatttttagctcaaaaagttcctttgctctctttcgcccgaatttggctactgtctctgtcaccgtcactcattcactaaatacagaggactattcctgcgctagtcaccagtcttgagttaggattagacatgtcaaaatgagcactgaaaccgcccgtatcaccgacttttccgacgagtctgcaaggataattcggatcctggccatatcctccagcagcacaagcattgccttcggtttggtgtccttctacttatttggtgctatagattacagcaagagagtatttcgacatcaactcatcatcttcctgattttatttgacttccttaaggccatcttcctactcatatttccggcccggaccttggataatccagaatctgccgacaataggacattctgtaatgctattggatttttcacagcagtatccatcgaaggtgccgacatcgctatcctggcatttgctgtgcacaccgcgttgctaatttttcggcccaataagaaagtacgaaatgggaacaacctagaaggaggtcttttcaggtatcgctatcccgtatacctggtgtcctttttgaccccaatacttctggcttccttggcattcattaatggctcaggttatgtacccatctcttcctggagctatcttcctgtccatcccatttggtaccgattggttctcagttgggtacctagatacattattctgatcagcatcattaccatatattgctccatttatttttacatcctatctcagtataattctgttggtggaactgccaagatcatgtggaaggagtctttatggtacaagttaagcaatatagtactaatgctttttttcccagatatttccctttcttcaaggtcacacggccaaaacgcagaagcagctccagactcaaaaaacattgataacgtgagcgtggatgacaacactgagtttggaaactggaatagattattttccatcaaggaagaggacaattctatgtcatctaacatacagagaccatttgagaaagtcaaaatcccttcatcttcttccatgtctccaaggaacacggctgcatacgaagagaaagagaaggaccaaattattcacgatttaagggaaagaattcaattggagacccaggaaactatcaataaggaaaccgttgagttgtttcaaatacgtcggctacagatattgaaacagatgaaggttatttttatatatccgattgcctacatttttctatggctttttccatttatcctgcaatgtgttgaattcaactattcccgtgagggaggccccgtactttggctgaattacgtcgctgctttcatgcaaccttttaattgcacagttgacagtctggtcttcttcttcagggagaccccttggaacttgacctcatctagtgtggatcacctatatgaacacaagtactccgacttccgtcgctcagtctcatttttgcccatgtatggtctacccgatcagtatctacgtggcactccacctgtggcgccaagcaatgctgaccaaaacaattctattagtccatttacaaattacctcatgaataaacccagaagtttgagacctagtgtttcgtccaacattgacccctcccaaacagaagagattgctggtgccgacgatgatatgtctttcacggaagcgctgcaatttctaaggggtgaacccccagctgaaaagccagttcctaacagtgcagatttgtcagcgtctccaaaagcacgcaagctttcaaaagttagctggcgttcatccagaagaggttctgcaacggacagtcactatagtgctaagagaaatagaagtgatccttcgagtgacgaacagccatcgtccaacttgaattcttccaataagagccccgatgacccatctgactctcctcctttttctctacctcatactggggcattggagccacaactcactcatattcctgaaacatcagcatcatcacctaagcactccccaaaacagagcagacaatcttctgcgtcaaaccgtaaagatgtaccgttccttggattcttcaaatccagcaagtcagaaccacaatcatctgaagcatctcaagttgataatcactcccaccaatctcactctcaatcccataatggctcagaagaagatcttacctttttagagtttctatctcagggaccaaaaaattgattgcaggcgatcaatcactggtataaattgtaacaagtagactattttcagatgtttaattaatattcaaagtaaacactaccaaaagtatcaagcaagaaaaaaagaagcttataccatttagactattaatagcattattatttcttacatactactatctggcatcaactctaggaattcattgggggatatttctacccctggcaccctgggcggcagctgctgctcctgccgaggccctctcctcgttcttaattgtctcatccacagatagaatcaacatagcagcctcggtggctgattgaatggcgttgatcttcatcatggatggttcccaaacaaagctcttcaagttatcattgattccaccgtttcggaaatctactccataccatacctcacctttagcgtgagcagcacgtagcttgtttaataggtctgtaccgtcgaatccaccgttgtcacacaattgacgagggatgacctccagtgcttttgcgaatgctccaatgattaattgctgttttcctggaattgttctggagtactctcttaatattttcgataactccatctcaatagcaccaccaccagcaacaattgcagtgttctttacagctcttctaacaatcatgatagcatcatgtaacgatctttcgacttcagctattacttgctcggctccacctctcagtaacaaagtgcacgtcttagcttcaggacatcctttgaatatgttgtaacgttctccaccaatttggacttcctcaaatgacgcacaagttccgagatgctctggtaatatatcactggtagtagtttgaatggaacctccaacagcctgaatgactctatctaaatctccagaggccactctccctgcacagaaaatatttctatcagcaaaatattgcgttgccaaatcaccaattggtagtttagataaaacaatgttggcacccgaagcttcaatggcctccaacttctgggttataattttccattcagcgtcaacgatattttggtaatctttaacttgttcaattctaacttcggcattgtctttttcagctttcaattccaactcaacatttaggttcagaatttttgggttagtgaactgctttggttgttgttcaaaaccggcgtacgagaacgttttcttgaacgcaacaccgttgacaaacaaagaatcttccatagaaccaccaggaattctcttgataccaatcagtttctcgtccagatactcctggtctaaagtcaacacagcgtcgaccaccatcttggtaaaaaattcgtcattattgtgaattaacttggaagacatagccgtcttggcacagttctctaaaagctctctgtttgcaccccctttggagcttacctcgacttgaagttctttgatattcttgacggccaattgagaagcttttctaaggcccttacaaatcactgtggtagatattccttcttctatgaaacccttgcactctttaagtatttcaccagcaagtaaagtgacagaggtggtaccatcaccaacctcagcatcttgagatcttgatatatcaaccaaaatctttgctgcggggtggataacgtctaagagtttcaagatggttgccccatcgttagatatagtggtcttgccatccgctccaacaatcaggacatcagatccaagaggacccagtgtaggcttcaaagactcctgaattgcgatacaggcattaatattggtgattatctggcctcgaccttgagaagtatcggttccttccttaagaacaactattgtgggtacttggccgttcattatggtgctgagtgttacttggaaagaaaaccagaaaaaaacaccaagttaattttgggtgacagacgacgcgaaacactatgaaaaggaacgaacctgtgtgaaaaaagcgatgctctccaagaaaggctacttcaagttttgctgagtttatagttctattcgatatatacataaacgtagccgcttagatggcccaaacgccgaaggctccatcggttctaccttcaaccatatagccctcttggtaacgggcgaaaataatattaacttctgaagatggatcgctgactcgaggaccacagtcccagtgcttctcttcaattcgatcgtagactttaaccactgagtcaccatttgtagatatgatccgtcttgagtcaaattgaagagacgtgattccggtatcgtaaacaaatgcatcaacgatgtttcctgtccttagatcccaaattcggatagatctgtcactcgatccagtgattaaatgcttgtcatcaaattgcaaacaggtcacaggtccagtatgacctgagagttgccgaataacttccccagacctcaagtcccataatctaactaaaccatcagcagttcccgttgcaagggctgcatcgtaacattgcaaagagcctataaatgaagactgttctgctgcaactacgggacttgaagtggtataacttccactagaggcattcatcatagatgaagcccagagaacgtcaatagtttgtaaacagtgccccgtggtcatatcccattgtcggatggtcttgtcgttggacccagaaatcaaagtgttgttgttgaaatgtagagcagtgatttcatcgacgtgactatcaaatgagtgtattagagggtcttgctcttcattatgtagcctgtttagatcccacatcttaatggaagcatcaagcgagcctgtgacaacagttgaatcctcaatttgaaggcatttcactgcagcattatgtccctcaagaagaccaatgcatttagatctactgagatcccaaacgcgtactgtattgtctagggacgcagataccatggttccaaatggaaggtcaaatccgaatgtagtgattgtatcttcatggccatggaactcggctatattagatcccggctcataatattgttgcaaagtaggctttatctttctcgattttttgtgatgttcatcagtcagcctaccatagacagactgattcatcatgaggttttcggatttggggtcgggttcaacgtcttcggcatcttcatcctcctcactactttcgtcagtctcatttaaatccggatcaatatccttgatcaaggaaagcctggattcaatttcatccaagtagttttctaatgcaatctcgtctctttcataaagagctatcttattgaatacagatgctctcattttgtgtaacttttccagtttgatatcaatttcctggatctcatttgcggtcaacccttttcttatctctaataggtctagtttgtaatcaatctcagctttgaattgttttaaatggtgaggattctgagagtgttttatttttgattccgttattccagctggtaaaggatctctattgggatcatctagctctcttgactctttgtctacaaaaccaccctctaagagtttcgatgatccctttttaattctctctatttcttcattcacttctggaagggtggcattgaatccttggaacaaagaaaacacagatgtaggtccaccgtgatcagtttccaatctttcatccggtatgtctctcaccaactcgtcgctcagttcggcgtatagcttgggttttctatttctttgtttcttatccaatgagtgccttcttctcgacaacaatggaattgcactactgtacttaagaatcatagaggtattcttgttggacaatgtctcatttatggtttttcggtaagaattgttcttcaaaaaaacatccttattgagggaaccagaagagtaaagcgctgaagctgttgctaccgccttgctgatattatctgattccattaaaagatttagtaaccaagagggcgcttatactctggcttgcggttaagttggagtttggcggatggaaattctgttcgagtgtagatagatgttggttgggcactcaggtacgaacgcttattagaggtgcaaaggagtgggcattcgagcctccgcctagcagcgtctgggagcaactatatgttggagaccccaagaaaacttggagacgtccctgttacgaagtatggacaattacgaatgggatgatgattgttagactcttgcctatggtgcaaaattaaactaagcctaatcattttgctccaagatcagtttcagctctcgtatcctggtttcttcctttgcaatctcttccaattgatcttcatttatgtcgtgaccttgcagatcctctgcctgctgctgctctaaaagctcatactcggcgatgctctgttggagttgttcgtatttaagagtgctggcttcaagtttggcagccatgtcttccagagggtatcttgtcacgagatcgctggctctctccaacaactcggagatttctgtttcatcgttcaactgtattagggtactcggcgtgtcttgtgtggaataatctgggatcttaataatcgttttttcgtctgatggagtttctgcatagttattgattccatctattctgtgtggttcgccgtcctctatagtgtataatgatctctccaaagggtcagagtctcgtatcagcctggtaatttccggtttattgattattgcatttgtaaaaataccaggaggtttgaaatagagggttcttagagactttgcattcttctggatgtttcgaagatgtaagtccaaagacattgagttgacttggtaatatgttgtttacgcgatgcagttgtttacaagtagaattatataagcatataattttttcaaaggagccgtccaagctagactgtttcaatgttcaagaatagccaaaatagtggactatctaaatgacttgaactcaagcaatctatcacacacgactgtgaaacaatgttttgagtgtcttcctcttagcgtattcttgattggagattttccagtgcttactcaatcatacaaacgcgtacatcgcggtttaactaagatttaaacgcgtacctaacttacagatctatcttcccttctttgacacaacaacatgggccgtttaatagggctaaatctctataatttcaagtcatatagaggactgaatcgaattggctttggctcggcaaacttcaccagtatcatgggaacaaatggttctggaaagtccaaccttatggatgccatttcctttgtcctgggtcttcaatcaaacagtcttcgttcgaccaatgctaaagatctgatctatcggggaagggtggctggaacggacaacgatgatgatgatgatgacatggataactcagacaaagaaaactactcgggggatgggtctagaaatgcctacgtatctgcaatttacgaaacctcggagggtgaacaagttcagttcaaacgtgtcatcaacagtaatggttcgactgaatatcgaattaatgaaaagctagtgaccatgtcggaatattcagatctactcaaagacgaaaatattcttatcaaggccaagaactttttggtatttcagggtgaggtggagaaaattgcagctcagtcagcaaaagagcttacaaacataattgaaattataagtggatctaatgaatacaaggaagagtacgactacctgaaagaacagctagatgaagcgcataatgtcactgtagctacgtttgggagaaggcgtgctttgaagaacgatttcaaacagtacaaggagcaaactattgaggtccaaaggtatgaagataaaactagagaacgagaccaattggagattactgctaaaatgtgctcaatgtttcataatgacaataatatcagtaaacttcaagaacaacttcaagcagtcaatcagcagattggggatctatcagcgcgtttagagaaagaagagtcaacttttgaggcgttaaagactgcatattcagagaaggcattgaatgcttcaaacgacaaacacaaattatctaaaaggattgaagctctgaaagatcaaaagctgaccattattcctctggatactgagaaacaaggtatcagacgtcagttggctaacttggaggtacgcctaaatgagatgaacgccgactcagacaaacaaaaatctgtcattaaaacgataacaaagtcattaaactttgcacagaaggaattaaaggagttagatgaaaaatacgtttctgaatcgatcactcttccagaagagtctttaaaagaatacaataagttaaggcagacatttctagtcaaaggaaatcttttggaagccgaactaaatgaaaagtcccagaaaattgacatgctgactcaagaatttcaagaccttcaagacaagctggatgctgagacttcaaagttagacaacctggagtccttgaaaacatccaaagagaaaagtctccacagcaagacttcacttcttaatgatcaattggaattcctgcagacgaagcaagcttccttgtcttcattcaaatccataagacagacacacttaaaacaggttcaagaagtgaacctgaaattacgtgacgttctctctcaattggatgaactcaatgcttcacaaagagaatcacaaagagaacgagctttgagtgatattaatgtttctttgaagagagtgtacggtgccatggttaaaggttcggtacattctctattaaagccgacgcataagagatatcaggctgccatttccgctgcgctgggtaaggactgggattctattatagtggaaaatgcgtccgcagctcaacagtgtattcattatttgaaagaaaaccgctctggtactgcgacctttattcctattaactcagtcaaagttagccctgtgtcaccacatctaaggaatattcatccagaagctagaccattgattgacgttatagagtacaactcgtcgttacacaatgcgatggcctatgtctgttctaataccttagtatgtgataccttggacctggctaaacacttgaagtttgatcaaagagttaattgcaaagtggtagccttgaatggtgcagtgatcaataaatcagggcttatgactggtggtgtaaatcccaacgatgttccaagatgggacaaggcaaaagctctaggattgactaaacgcaaggatgaacttttgtttgaactagaggaactagacaagaagaaacctaacgaatttgatgagcgagcactgatagatgagatcagtgcaattgagttggagctgcctttactaagaagaaacagaacagaagctgaacgagctattagagatgtggaacttgagattgaatatcaaaaacaaaaagtggcagaggtgcaaacactgctggaacactcagaacttggccaacttagacaatcttatggagaagtccaatctaaggtgactcacttacagttagaaatatatgctgatttttgcaagcgaaacggcctagagtcaattcaacagtatgaaaatagtgaacgtcacagggagttcacaagacagaagactaaactcctccaacaaatttcttctttggaaaacaaactggaatatgaaaaggaaaaataccagaatactcaaaatactcgacaagacattgagcgggaagaagataaactgaaagaatctttggaagatgttagtcggagacatgctcaatcggtggaaaggctggaccgtgaagatgcagaattggaagttgagaaagaagctctcgagatggaatttgaaaaactgggtaaggagctagagacaaccaagcaaaagggtgacgaggttgcagatcttcgtggccaatatgaagaccttcaaactcataaacttcactacgatgaagagttggagaaggagaacatgaagaagatccaggttttgaaagattgcaaaatgaaaagtattgatatcccgttgttatatggggacatggagactttagaattagaggacgataacgaggcaagcaatagctctaatattttagcagatcaatttgttatagattacgatggcaatcttgacgagaaatacaagtcgggagatcttgacactcacttgcaagatctttcagtacagatggagttactttcggaagaaataaataatttgacgccaaataccaagtcactagaaagattagcggaagctgagaaagctttaaagagctgtgagaggcaatttaatggagcaagagaggatgaaaaggaaatattatctcagtttgatactgttaaggaaaaacgattcaggttgtttgacgaagcttttcaacatatttccaaatctattgacaatatctacaaagagctgacaaagtccaaagtatctccgctgggaggctcagcttacttgactcttagtcaggaggatgagccatatttgggtggcataaactttcatagtatgcccccaactaagcgattcagggagatgaatcttttgtctggaggagagaaatctatagcagcattagctttattgtttgccattcactcgtacaaaccctcaccatttttcgtattggatgaagtggacgcagctcttgataacgcaaacgtgaacagattggcaaattacattgtcaagaatgctagtccaactttccaattcattgtcatcagtttgaaaaacagcctttttgaaaaggctgatgcattagtgggtatctacagggaacagaggttgaacagcagtaaagctgttaccttggacctaaggaacttctccgataaggaatagtctggtataaactcttaattttattcagcttctattagcgattgagtattttgtgaatgtagatgaatttttagctgttcaagatccagctttggcttgaaatttagctctgaatccgcagtgttcgttagacacacaaaaagtatttgaagatttcccaacaaatggtaggcctctatggattttattttttcatggtccatcaattgtttgacgtttttggtcagaagcatgatggcgtactgaaatctataaacggtcccatcttttatccataacggaaacactctggagcccttcagacggcttataggatcagagatgtacgaatttgatccgaaagcttggattggataccgtaatggacatcgtaaataggttgccaatagatggaccagttgaacaacatatccaagcaacgcattgattccaagctcctgtgatcgaagaaactgaaaattagaagatgagatttttgcatgagggaatattaagccaaacatgcaatgttcatgatgtttcccgttggtttgtgtgatgctaaatattgatgaaaggtctttgatgagtcttgatttttgtatagagacgtactcttgtacctcttctaccctaaccaaaagacttccatgggattctcttaatgagtggagcactttggcaagtatttcagtgtcagtgtttttattttttattagtgaacggagtcggtcacaattagttctgagttttgatattacattctgaagggaggtgttctctcgagacaacatctctaccctaggagcatattggtacgccagtcggtgtttaatagcctctatttgctgtgccgagtcagttctaaaagttgatgatattaggtggtcaatttggatgcttaatctatgcttgaacccgatggtgtctataatggagaatttgacgttagaaagttttattatttgatcaaacgagcaacttttcaactcccttgatttcaagaagcttggtttggattttactgttttcagcttgtcgctttgtatcccgtctgtggccattgcaatgaggttgctctcaagtggataatagtaccaaccatcgacaagattaagtagcaatatatttctaacatccttgacagctttttctgccttttccaaagtgggacctagatagttcagaaagctaagtttcaggttgattctcttgaacaggacccaatcgttcttagacttggactctcgaacccaaaccatcattgaaaacgttatttttcgacttaagctagtgcccgcaaaatgaacatcttgaaatacgggattgatagtgccatgagatatttctgtgatatagaagggcttgtcgtactggaaacactcgtggaaactgatgaatgtatcgtacaaaacattacgtaatgttccagcgttcttggaagtggaagacaattctcggagattggtggacgatttggtggaaactggcctgggatggccacccttgggtaatatattcctgacgctgacacacaccacatgtcttagtctcctttgcggtggaggcaagtacgacatcttgtgatggatgctttgtatgatagggacaacgataagttgagaactctgaaccaggtatcgcgccaagcagagatattgtaatttgggttagacaataaacttccaatttgcctgttatttaactgacagtttttgccccagcaccgtagagaaggagcaaattgtaccttgataagcagattttgaagtaaattaaatttctgtgagacatcctatcccattacgaacaacatcaagatagcatcccacttgtcctcaacacccaacacacatacatatggggtcatttatctttagtttggcccatttctgcgaaactcatgggccaacagtcgttttgaatacccagcatattgcgactgagcagcatgaaaagctgatatcaagcaattacgatcagcaagcttgtgaatcgtgtaaactacaattacccggtggatcaagtacattaacaagtatagataacgaagtgacatatgtctctactcaataccccacgtcccaggcaaagtactccattcttcggcaggttgccatcaagtgtttatctgttgaatctacttcagagttgtcacctgtgatgtttggggatcccatattaggatttactttagcatgcatattcaagatctctgataacactgctcgtggaggagaaagaagatacagcgtgatgatcgtagcagaagacgaaagtgagttgattcattattggaatataatagctacaaatttcaaagagtggatacactgtatcaaacaaaagagggaacaggtcttatccagacaagctgagcaaggcaataatgaacaatttttcagaagaacacagctatcaaacaaaaacatggtccaattactggaagatcctcaattcttcgtcaaaatgcatgtttgggccagtggagttctaaaacagctggtcaattaatcaagcctccacttaacccaaacttcgtctgtgcggaatttctgggtacaaacagtatcttttatatccgtgacatcacccattcgatactgcaacaatccagcatgagcaatcatgataccattgtcaatacaaaaacgttcatcagtagcataaatcgatccatttcgatccttgaccattatctccatcatttgctgtaacctctcattgcatccaactccaccaacgattaatacctggttcgagttgacatgcgccatggctcgttcagtgatctctaccagcatggcaaaaagacactcctgcaatgaaaaacagagatcttcaacagtaatcttactcccatcgctagtcaccaggagcttgttctttttattagcaaatagatccttggccagattatcaataaattccaatatacctgacattgacaagtccataccttttactgtgtacggcaactcaacgaggttcttacccttttttgccaattgttcgatgttgtatcctggggatggattattagagatcttcagagttctggcaaatctatctaaacagttccctatggcaatatccagcgtttctccaaatatacggtatttttgtctggagtaagcaatgatttgtgtgttgccaccactgacatacagcaccacaggattatgggcatttgtaatctccctgcccatctcaatatggccaatgcaatggtttactcctaccagaggtagatgccatagttgtgaaatcatccgtgcagctactgcaacactctgcaatggagcccccatccctggcccctgtgtaaaacagatagcatctaaatctgaaggagccacttgcgcatcttttaaagcattcttaatgactctaacaacccagttgcgatgatgtctagctgtatctcttggtaaaaagccttctcctggaggagttatataggtatctcgaacgttcgaaagaataactgccttattggaatcagatagttcccctttggggtggcgtatgattcccactccaagcttattggcagatccctccaagccaatagctagataatgatctttccctggcttcagcctcgtgtccaggtaggtagtcatacttggaagacagagtagcacccagaaaaaaaatgtgttagaagggaggcgcggcgggcttctcctgcaagcccccgtagggcaaaatacacttggaccccaaaagtctgtacaacgatcaaaaagctcagagtggcagaagatttctccactctttctacattatacaataggtttcggacgtaatttacagtttattactaaacagcttaacgggaagtagcttgaaccttctggaaagaacctttagcagattgcttggaaatgatgaaaccaccgttagcaatggccttagccttctcagcttgtctcttagccttgtgagcttctctcttagccttagcctcttcctccttcttagcagcagcctccttgatggccttcttctgctctggctttaaagaacgtctctccttgatcaagtccaaagaagcaccaacgatagctctttgagtcttgacggccttcttggtacgcttcttggaggtctcttcggtaatacccttcttgtggtgtcttctgaacagaacagtccaagcaattcttcttgggttctttctttggtggaaaagagaggcagacttggagttctggaatctgaaaatcttggagtcaccacggatgaacagggttcctctgcctgggtaaatcttggatccggaaaatgaatcgacttcgatcttcatgattgtctttacttagtgaattgaacgaacagatgaaaattgttccaggtatagcgacaactttggcaggactctggtgctcggattcatcacagaaatcgcgcatcctaaaagtttgaaatcacgcttagaatggaaatatcactgtgactgctctgcacatctttacctcatttgatggcggtgaaaaaaaaaaaatcattgggacgagaggtctttccttctttatacactactatcaacttaagaccggagtgaattcgcagagatggtcagtatatttagatatcaagcatgtgaatagcgtagctggtatactaacaatcatttaggccccaaaagttaagaactcagacactatcaaccagaagctggccctgaccatcaagtcaggaaagtacaccttgggattcaagtccaccgtcaaggctatcagacagggtaaggccaagttgattattatctcttccaacaccccagtcttgagaaagtccgagttggagtactacgccatgttgtccaagaccaacatctactacttccaaggtggtaacaacgagttaggaactgcttgtggtaagctcttcagagttggtaccctggctattcttgatgctggtgactctgacctgctttccgttgttggaaactaaactaattagtcgaagaattttttttcaaccaacttatttcctgtaatagttaatagagatttttcattggacattgcgaccttaatatttgcggggagcatctacttcctcattggtaaccctgctatttcttgaaaaacgatttttcgtttgtagactccaccatatgaacgcagatctgtcgcccatggtcttgcttgaaatgattgcgcgaaagatttgtacctgtcaacactagcccatatctcatcacctcgtaggactagaaataggtaaatgggtcgaccttgggcatggccctagcatctgcaaaaggtgcatccttcaacactcttctgcccaagaaaagttagctcaatttaaagcttcctgcttacaattgctgccattttccgttttccaatgagcctggattgttgatgagcatcttagaaatgccgcattgggaagtctcagtcgactagcgactcgagctcatcagccatttgaatctcccatgcagcctaagaattagtcgtttcttttctttttcatttttccccttcattttttttggtcactgaccaatactatataaacttgtgttcacccacttatagttggcgattatttccaggcacaagtaatgactctcagctcacaggcttctaatgccatcatttatgtgacttatgggctgactttaatattctgtgtggggctagcttggtatcataatgacaagtcaaaattcttatcgtcaaaccagacaaaaacagggataccactggcccttaacttcatagcctcggcgatggggtgtggtattcttacaacatacacacaagtggctaacttggcaggtatacatggattaatgacttatactattgttggagctttgcccatattctttttctccttctggggacctcttatcagaagaaaatgtccagaaggatttgttctgactgaatggactttccaaagatttggaagtgtcacaggatattatctgtctcttgccacaattttgacaatgttcttgttcatggtggcagaacttagtgctattaagttcgctgtcgaagctttgacaggtttggacggccttcctgtggtcatcgttgagtgtattgtcacgaccatttatacttctattggaggcttccaggttagtttttctacagataattatcaggcctgtgttgttctagtcttggcagttattggtgtcattggctttgctctgaacgtcaacattgacccagaacttaaaagagaaactgaaagctacctattgggtgccaacaagttaggatggcaattactttacatcttgtttattgctattgctacttgcgattgtttcatatcaggattttggttaagaacatttgcagcaaaaacaaacaaggaccttatgattggaaccggtattgcgtctattgttgccatgaccatctgcactttggtaggtttgccaggcatttttggtgtgtggacaggagatgtggttatcggaagtcccgaaggttacctgtcttttttcatcatggtatcaaccatgggcaactggatgataggattaatcctgatcttttccattgttctaagtacttgtacctttgactcgcttcaaagtggattgacctccactattgtcaacgattttggaagaggacgtatgcctctttgggcagctagagtaatcactattttggttatggtcccttccattgtcgttgctgtcaaagttgcagatgatgttttaaagatatacttcattgccgatttgatttcttcctcggtcattccttctctgttcatcggtctctccactcgcttctacttctggtctggttgggaagtagtcggtggtggatttgctggtctttttttcgtgtgggtcttcggaaccgtttactacggtgatgccgctgaaggaggcaagttgttactgatttggaatggtatctacgattctgaagattggggtccatttggtgcgtttgttgttgccccaggtgtgtctttggtaggtggtttgatcatctgtggtgtacgattagcagttctcaaggtatacagcaacattaagggtactccatttactgctcttgatagacctgaaaaacttggctttggtggtgtcgcaattggtgactcttccgatattgaagaggtctacgaagagactttaaacgaatctcaatcaaaaaaatctactgattacgtcaaggaagaagataatttccgtgcttgatcaaccttaatcccacaaatctttaatcaatcgataaatcaataaatataaaacatctatactctacgtaacgtcgtttgcaaatagaaaagtttgtcactgaaactaacttaattttggatttggaagacatcgtccaagaaagcctcttcttgagcaacgtgcatcgacttagtaccaacggcaacagcagctgctgggtttctaccagcatagcgcaggttgtaatccttgtacttctcggtctgttccaatacggttactatccttggtgcagaaaatgcgtaagaacccatgttcaatggttcttcctgacaccaaacaatctcatccaaagatgggtagctatcaatggcgttcttcaattgttcgaatgggaatgggtgcagttgttcaatcttcaatacagcggtctctttgtcgccaatatcagcacgcttcttgtgcaaagaagaatgaacttgaccagaacaaagaactaatcgcttaataccctccttgtcattgatggttttgcccagctcagaatcctcaattatccattggaaactagattctccaatgaaatcttcaatgttagatctggccaatgggtgacgcaacaacttcttcgaaaagagcaaaattaaaggctttctgaattgacggtgcatttgacgtctcaacagatggaacagattggctggagtggttggataagcaacttgcatgttacaatcttgatgttgtctctccagcttctcaggagatggataaactcttgggtcttcattacaaagctgcaagtaacgttctaaacgggcagaagagtgctcggaaccttgaccatcgtaaccatggggcaaagaaaggacaacaccggatctctgcttccatttagattcaccagcggcaaggaattgatcaataataacttgagcagtgttagcgaagtcaccaaattgagcttcccacataaccaaagcatcaggtgaggtcagtgagtaaccatactcaaaacccatacatccgtattctgaaagggaagagttagaaataccgaagtcggattgaactttacttagatgtttgagaggaatgtagactttttcggagttttggtcgtgaagaacggcgtgacgttgggagaaggttcctctttcaacatcttggccggaaattctgacatgataaccttcaataaccaaacttccaaaggcaagagcttcaccagtagaccagtcaataccctcacctttttgaatggaatcttttctattctttaagatacgcttcaaatttctgtgaacctcaaatccttcaggccaagaagagatggtgtcaccgattctctcaactacgcccctttccacagaggttggcaagtgaggcaatacttcagaagccaattcttttggagacttgaatccctcccaaggtgttgttaaccattctctggaggtgggtttgtactcaacagacttggtaaatgcttcttctaatgtgttccaaacccattgcttgtgttcattgatgtcatctagagtgaatgatccctccttgattaacttgtcaacgtaaatatcgagcacttgcttcttctcagcaatcttctggtacatcaaaggctgggtgaaagaaggctggtcagtttcgttgtgaccgtatttacggtagccaacaacatccaaaataacatcggagtggaaagtctgtctccattcagctgccaattggaagttgaaaataactgactcaacgtcgtcagcattaacatgcaaaattggagcattgattgatttggcaatatcagatgggtaaggagtggatctagcaaaacgtggatccgttgtgaaaccaatttggttgttaataatgatatggatggtaccaccagtagaataagctggtaaggcagcgaaacccatagtttcgtaaacgataccctgaccggcaaaagcagcatcaccgtggaccaaaatacccatagccttgttgaattcaccaacatctcccttgtagtgctggatagctctagttctacccaaaacaacgggatcttctgcctccaaatgagaaggattggcaaccaaggaaaggtggactttcttaccggatgtagttggacgaacgtaattcatacccaaatggtatttcacgtcaccagatccttcatcgaaatctttagaaccagtgaactcggagaagatagactcattgggttttctgacaacgtttgacaacatgttcagacgaccacggtgggccataccaatgactacatcctcaacaccgttttcaacggcagtgtcgatcagagccttcatacctggaatgacagactcggcaccttcaacaccaaatctcttgtcgttggggaatttggaactcagaaagttttcaaaagaacaagaccagataagtctgtcaagaatttgtctcttctcatcgacggagtacttgtaaggggttggaatttcaattctctctctgagccagtcacacttctctcttgaagggatatgaacatactcaacaccgtaggatgaacagtagattttctcacatgccttaataatatcacgtagtttcattgtggggtgtccagcctcggcgaacttaggaagaatacctggtccgagagtaatctcagtgtccaagtctgcctcggtaaaaccataaaattcctgagtcagttcctttggcactggtttggacttgtcgtcaccaaaggagattcccaaggggtcaattttagccttttggtgacctctgacctgataagcacgaaccaacagctgagctttcaaatgcgtcaaaacattggagttgccacttgcgttacctacaggcaccaagttgggaataccaccagctggctgtggaatcaaggttggtggtgcttggaaggcacgagatggggggacgccctggtctaagttcttgaaataagcgttccacgacgagtgaacagatgacgggtccttggaccattgttcgtacatttcatcaatgtagttggcgttatttgactgcaaaaatgaatcggtggccaataatctggtctggatcaatcgtctgggagcattcctcaagatgctgctcctggaggagatgcctttgaatgattttaacattatgctggttgtgctttttgggaagaagagagaaaagaggaagccaaacaggccttcttttttatggttgagggtcggaagtgagggaataatatcggttaagaagccccgggagcgatgaggttcaatattcggaggtgatcggaatttgatctggagtttagttgcagaagaaagaagaatacgacttgaaagagaagaagctgccgatcacaatggtgctacttgcggtgcctaagcattgattttattgggctttatgcggtgttcttaacttcaagtggatgatggaacagtagcgactccgagatggagttgcgggaacatgggtgatttacaaagacaggaaaaatatgggggagtcggaaatgagccggaagtttagaaaatgatgggtggtcggggtgatatcaagggtacctacgaggcagattcgggagataaggggaggaacatgcctatcctgtctaattggtgtatggttgctcagcaagaaagtcaaaacgttggaaacggcttatgattgctaattcgaaagaatatttgttccagttgctccaaggaagctagtttagtgttggcattatttctgttgcgcttttcttttctcgcgattgggcgtagatttgcgagctccgggagtttcactattaattatagcaaactttgaagataaagttgtcaagactatcagcctgttgctagcatgtagatgatgtgtgtatggtaacacaagagtcaattatataataaaattggacaataccatgtcgtgtgatagttgctaatttcagtaggcaagattgtgagtagtgaaatcttggctgagatttcgcaatttatcactagttgtatgagaatcataattgataaactataagcacacactgaagaagacttgcttggtcagagagaaccattattaattgttcttgaagcatacatatttccacttatctcctttatagtctcctttgagctcttttctcttttctcccaccgttgctatcaaggtgcggacagtgttctaacatctcaccctcaatgctcataaaaaatctcatctcaaattgaaaaataaaatttcatgctcaaaagattattgcaaagcttgaagaacatcctcaaaccaataaaaagtcaggtaatgaccgatctagacgcttataacaaaatcaaagaaggcaaggcagaaatactgtttccaaaagaagacaaagttttttataaccctatccaacaattcaatagggatctcagcatctgcggaatacgagcctggagtgaattgtaccaatccgctggtaagaagagaaacaacgagggagaagtcaaacctttcattaatattttggaagctctaagtgcttctggattgagagctttaagatatggtcacgagattcccctggtgaaaaaggttgtggccaatgacttttccccagctgctgtggaaagcatcaagttgaacattgaacataaccaattgaatgggatagtaaaggcaaacgaaggtgatgccatattatttatgagccaatttagggataaaccagagttccatgttatagatctagacccttatggaacggctactccctttattgacagcgccgttcaagctgtgaaaaatgatggactactattggtgacatgcaccgatttaggtgtccttgctggatcttcttatcccgaaaaatgttttgctctatatggtggtactaacattccaggtgacgcaacccatgagtcggctttgagattagtgctaagcatgatagcatcaactgccgccaaatacaaaaagactatcgagcctatgctttctctcagcattgacttctatgtgagattattcatccgcgtgaagactagcccaataaaagtgaaggaacatgcatcaacgactatgatcaattaccactgctcgggctgtggcacaacttacgaccagcctttaggaaagaagactcaagatgagaaaacgggaagatataagtttaccatggctagaggacccccagttggtgagaagtgcacattctgccacaagacgatgcatctggcaggtcctatgtgggctggtcaacttcacaacaaaacgttcattgacaaaagtcttcaaatctctaaatcccttgataaagatgtttacggaactactgatagaatcgaaggcatgctgacattagctaagcaggagctagaaacgccgttttacttcaagccggggtctctctcctcagtgatcaaatgtccagcaccacctattaatgaattggtctcggcattggggaatctaggatatatggcatccctcacacatgcgatgccctcggccattaaaacgaatgcgccctgggaagctatttggtacattatgaaaacctggctaaaccatagaaaggaggaatctggaaagaatttaagtgaaacgtctcctggctatgccatcatacacaatgatcagattggaaaggatatcgaactcaaggagtacgaggagttatacaagaaaaatgacctttaccatgaaattaagagtctcagaaacttcaagattgtccggtttcaacagaacccaaccaagttttggggacccaaagcaaagcctactaattagttatatgtatatactgtaatatgatcccgctcagtttcgcgagacatccaacatcttggatccgtttacaccttccttttctctctacttactacctccttgccccttcatccctagttcaagaccatccattagtcctgctaaccatgtcggattttgactctggtgaagaatctgaatacagctatgattctgatttggtccatgaagtttacagggacgcacaaaaagagtgggaagaatcaatgattcaactcactacattgttgaactttgtgctgatccctataataggcagagtgataggaagaagatttgctaactccttatgggcgagaattgccaataaaatatggaattgatcattccagcaactggtttattttgagcacattctccgataccaaggtctcactcaaatgagtcaaaatcttgagaactttgttagtgattgagccattacacaaaattttcagattcatcaactgactattgatgtcatcgtactgggtcagtttcactgacagtacatatgtcttcagaaacttgaacactttggcgatttgctcaataagtttcttgacaatcaggcttttgttgtacctgcaaaccttcaaggttgccttcatttcgtgaatatccgctgaacgagatttggtgatgttagtactggtgctaattatctgatagtaagtttgtcctggtgtgtagtttatgaatatgtcactggtaagtagcttcagcaaactgttaacgagaccgacgactagatctaatttgtagtctgaatcaaaaccgttgggcgaataggacctcaagtcgttattcggcagcctttccaattgatcaaagaattcctctactgggccctccatcaaacgagcaatcttgcagcctaattggatcaacttgaagccgtctatattttcaaattcatcatcatactcggccttgttaaatattctatcaagatgcgctttggacagttcgttcgggacgttttttccatacgagcagttggtcagagttgaggttatgtcattcaggtaactgagctgatcgtttatcagggacagcgtagactccttactcatgttcccctggatcctgaaagatcagatctatctgatggagaaaagcgagataaagtagattacgtaataccaaatgcaccaggtttagctccagaacgtctgagcaggcaggccaagcagattagagtttgtgaacgttgagctgagacgagagtgcaatgctgttgatttctgtttacagatagagaatgtaattaaacttgcataattgtggcttctgccgggagcatctcaggtgggaacgaaggcagacgatgaggctgcctattcgcaatagaacttcacgctacgaaaggtacaccttaattagaaaattatgtggggttgcagtaacagtgaatcaaacctccttctaatgtgcaatggactaaagttgccccttctgataaacacaactaccatcgcactttaaatgaaactacccaccgtaaggtccctttggttctgcatgatcaattgtttgcacctgtaggactgtcgtttcattcagatttgcccaaattgaatacattgcagcgataaaatgcagcaacaggctgatttagtggataacttgaattggttgaagagacgcgtttcaggggaatactacatgaaaataaaactcgcgtgctacaggcacgcttgacataaacaaaaagatgctagccatgaacactgccataacctgatggttctgacaaatttacacgggcaccatatacctgacataggcagccctgttgcgagtagtctagagccgtaagaattggaacaatcctttccatcctattttttgacctgaaattctacttcatagatactccttccggcttatgtaaccaagctgtcaattcaaaacgcgtctgaaaatttgtgcctttcaaagggatgatacacaggtaaaaggggaaacatactgggagaggtaccaaatatcattctgtgggtcgtttctcaaaacgtttgtatatatagccaaaggtcagtgcttctcctgatatcatcctctcttccaaacacaaatgtctgacgctcaatgtttaaagatcttcttacaatctcccgtcactgaggagatgatccatcacctggtggttcagactttgcaggtacttccatgtgatgaatctaccaacaccaagttgccctctttgatgagtttcatcactaagttggtcagatacacaaatgtctatacaggcacgctaatgagtaccttggtttacttgcaaagactaaggagcaagctcccccaagatgctaagggtcttccttgcacaagacatcgaattttccttgcgtgcttgatcctgtctgcaaaataccacaacgactcttcaccaaagaacaaacattggactaggtatacggatgggctattcagcagccaagatgtcaatttgatggaacggcaactactgacgctgttgaactgggatctgaaaatagactcaaaggagctttgctactctgttagaaggtttttggagcctatcagactggacattcaaaggtcttccaagctccgcttcagaaaggagagaagagaaacctctctcagctccctcagttctatggcatcaagtgcatccaatgcttctatcaactcaatacattcagttggttcgttgtacccttcgagtttaggcaggtccaactcgtcatcatcgattgaaaccaatagttctttggacactacagaactgacagccaattactgtcaaaaaccaattatgatacccgtccacacggctaaaatggagtcgtctttacaccaaacagctttaaaggagcaacaggaactggatacgctgatgaggcaatactgtcggggaactgctttttaaagtttgttttatagagaatatgtatattagaatttgtatgttaatttggataagggctgtttttgtttctactaatactcaatttgaccattgatttgtacctaacttttaccgccatttcgaatggggtttgcagttgaaaaaatgcctcaatggccttccatctagtagttaggtactcagtcttctgttatgttggctttcctaaactttcacacgtggttccagttgatatgccagtgtgtttcggaagatagttctactgtatcagatcctatgctacgcggatcagtctcacaaccctccacatgtgtgtaggcgcgcctagtggtgccaactgttttcacgtcatcaccttccttttctcaacgttacttatcacaacattacaacaatcatgtccactaaagctatagtgttggtaggaggcgacacccgtggaacacgtttcagaccgttatctctcgatacacccaagatcctttttccaattgctggtaaaccgcttttgggccacattttggatagtctgattttgttgcccagtttaacagagatcattctgattggcttctacgataaggccgtctttgaaggattcatcagcgattataacgcaaagtttcaattagaagagaggaacattgaaattaaatatctcaaagaatttaaagctttaggaactgctggaggcttgtatcactacaggaaggagattttgaagggtggtccagatgaattctttgttgttcacggagatgtgattactggatttccttttactgaaatcttcaagttttaccagagcctgaaatcggccaagaagaatgtggaagctattttgttcggagtgaagattaacaattacgagtatttcaaagtgctcaataattccactgatcgccattcttttggaacaatcgtctcagctgataccaaagttgttcattatgtagaaaagcctgagcaaaaaattagtaacatcatcaacggaggaatctacctttttgataacaaattgttcaaacgattgtccaacgctaagatcaccaagatcaacattgcaaacgatatctcacacccagagctagttgatgaggatgtcatttctttggaacaagatgtcctgcagaagctcccggatgatggcaccacatatgtctatgaatataaggggttctggaaacagattaagactccagctgacgcattgattggcaatgagctgttcttggagaatctgttccagaagagattggtgccagataaggcaatcaaactgactgcggaatctggagctgagaatggaatcactattgtgcctcccgtttatatctctccgtctgcaaagatagccgagaataccagaattggtccttatgtcgcaattggaaacaatgtgtctgtcgaaactggatctcgtatctccaattccataatcctccgagattcaaccattggtgcacattcggtgattctcaactctatcttgtcaaacaattgcactattggttcgtgggcccgtatcgaaggtactggccttgacagtaagaagatagctgagtccattgaatcccaagctaacattattggtatcaaaggcactggtaatattacaatcctgggctccaacacagaagttgccgaggacagctacattttaaacagctatattctacctaataagtctatcaagtttgatgtcagatatgagatcatcatgtgatggtgctgaggtcgaatttactatccagtagggcgtgtgtaccgcatataaaaatactatcacagtagcgcgtttttttcctctgttttccttacacgcggtctgagtataaggctgtttctttcaccctttctcctctatatctctgaaaaaagtgacaaagatggccaagaagaaagtcgttgctccggacaatcagccttccgtgttttctttcttcaagaagaagccaagtgtgaattcagctgaacctaagaaggagcagaaactacctaccccttcatcttctcctcaaaaggccgacctgtcttcaggaacatcagacaaggagaatcaccccacaacaccgaccaaaaatgagcataaaacgcaattaccatccgcttcttccagcgtagtgagagcaaacaaactggaggatgatgaggaagaaggtgttgtttctggtagaaaaagacgcagagttgctatagattccgaagatgaagaagatgcctttgatgaagaagagagcgtcgataatgacgacgatgaagattataatgaagatgatttgcataacatttctgatgaagattttgtaatttcaactcaggagatgatgcaattagaaaaagaacttgaaggagaagaggagcctaacaatagtgaaggagaagaggaagaagaggtccaccaggtcaaaccattgaagaaatccaaacaatctacgtctcaaaagttaaaccaatttgggtggacgccttcctcttcgtctcagaatgatgccaagggcaagaccgctaatagccaggtcaagagatccaacttgatcaatccgttgaaaccaaaagcgtctaagaaactagacgaagagcgatatcactggttagaggatgtgcgtgatgctgaaggtagggctcaaggcgaccctgagtatgacccaagaactttattcatcccaagctctgcttggagctcttttactccttttgaaaagcagtactgggagataaagtccaagatgtatgactgtgtcgtcttctttaagaaaggtaaattctacgagctttatgaaaacgatgccgatattgctcataatgaatttgatcttaaacttgcaggcggtggaagagccaacatgagattggctggagttcccgaaatgagttttgactactgggccaatgctttcattaatgctggatataaggtggcaaaagtggaccaaaaagaatctatgcttgcaaaggaaatcagagagaaaggcaagaccatcaccaaagaagagaaagttatcaaacgagaattgcaatgtgtgctgactggtggaacgttaacggatgagtctatgttaacagacgaaatggcaacatattgtctaagtcttaaagaagtagacaatggtctcgacggacgaacttttggtgtgtgctttgttgacactgctactggcaagatgaggctgacagaatttgaagatagtgttgaatgtacaagattggaaacgcttttagctcaagttaggcctaaagaagtgttggtggcaaagaatcagatatcccccttaactgcaagaattttacggtttaattctccttcctcttgcatctggaataagcttaaaccagacacagagtttttgaaccacgaagtcacttttgaggagcttacaaggggcaaatattttgaagcgtcagatttggacgatttgtcgaactatcccccactcttagtggagtatcacgagaaacatcacgttgcattcagtgctttcggtgctctactatggtatctgaagtctttgaagctagacgagtccatcatttcaatgggtaacatctcaccttatgacccttaccagcatgcaacatcaatgactatggatggtgtcactttacagaaccttgagatctttgcaaacacgtttgatggttctaacaaaggtactttattcaaagtgctaaaccgagcaacaaccccatttggtaagagactgtttaaggattgggtcgttcatccgttgctgttaaaaaagtctatcgatgaaagacttgattcagtggagcttcttctcaacgatggagaacttaaacatatattcattaacactctttccagacttccagatttggaaagactactatctaggatccattctggaagtttgaagattcaagattttaccaaggttattgaaggatttgaacgtatctccaaattggtacgtactttaaggtcttcttttggtgaaaactttgagtccattggaggatctcttggaaagattctttcgcagctacctcaagagttagagattcaagtttccaaatgggcaacttcttttgatagggttgcagctacatctcagggtttattgattcccgaaccaggagtggaggaagaatttgatcagagtaaattgaaaattgagaacctaaaggataagttgaatcaatttttgagacagtatagaagagagctcaaatgccaggaaatggagtttagagacagcggaaaagagatctacttgattgaagtcccgaagaaagtcatatccaaggttcccaaagattggcaacagatgggatccacttctaaagttaccagatattggtctccagaagtcaagcttgtagtacgagagcttatggaggctacagaattgcacaaaattttgatggacacattacaactgaaagtttatcgcaaatttgacgaaaactactcattgtggtcagaaaccatacgttgcattggatccattgattgtttgatctcattagccaacgcttccgaatcacttggatccccgagttgtcgcccggaaattgtagacaaagatgaggcctttatcgattttgaagaactaagacatccatgttttatccctggtggagcttctggctccagggatttcatccctaatgatgtcaagctaggaaacgggtttgcaaacattgctttactaactggagctaatgctgcaggtaagtccacagttctcagaatgacttgcattgcaaccattatggctcaaattggatgttttgtccccgcttccaaagctactttagtaccggttgataaaattatgacaagacttggtgcaaatgacaacattatgcagggaaaatccactttttacgttgaactatcggaaacaaagagaatcttgcagaatgctactccacgttcattactggtgctggatgaacttggaaggggaggctcttcttcagatggatttgccattgctgaggcatgtctacatcatattgcaacgcacatacaatctatcggtttctttgcgactcattacggaaccctgggagcttcgtttatcggtcatcctcaagtcatgccactaaggatggcgatcttggtcgatgagtctagcaaaactattaccttcctttacaagctagaaaaaggtgcctccaatggatcatttggtatgcatgttgcgacgatgtgtggaataccaaaagagattgttgataacgtcgagattgcagccaagaacctcaagcataactccatgataacacaggtatccaaggctggcgtctcactaggattacaaagtgatatttcctggctcaccgcaggcaaggacattggagctgggatcacaaaatacgatgaaaaaatcaggaagaagggactagagtatatcctacaaatgatcgaaggaatcaaatgaatttttcttacttatgatatgagcatagtgcatatgatagttcactcgtatatatatcaatgctctgcctccgtaacaaaattatataggggataatcatcgtctacgtaatcataaaagtgttcctgcttgtggaagaactgcaaatcgctttccagaacagcatcagtctgttgaacaagatttgtgatcgtattggaagagtctgtggaggcacattgggcctgcaaatgttgagcactttgatattcagaaacttttggagtgatatcattactggattgactataatgtggaaaatcaagaaacgaatccaatttcaactcgttttctatgaagctgacaggagtaatggattcctcattctttggagaggcacctaaaggcggcccaagagcaaattttgaggacgccattgacgagacaattccattactagtcatggacgaggaatcgtacacgtcggaatgcgttagaggatgggatctttcgctgtcaaagaaaaggttatcgtctgattggaaatatggtgattctatctgagcgtcattacctgtgatagagatgctatgctggtgtctttttctattgaacttgaggggagagttgtacttgatcttactcgataatgacagcgaggaacaagatctgtgatgtcgatttctgggatttaaaacgggagatgctgatgaaggcggtatatcctccacagaggccaagggatacaccaaactgtggctggaaatagttgaattcgatctgattggagtcttagatcttttcgccttattttccagcggtcgtgaaaagtagtcttccgaggctgaaggaggtcccgcgctcactgaagtgacacctggtgtaattgcaggagacgaaggttctgtcgcagcaaggatagcccgtcccgatttgtccactctcatacagagtggagcgaggtcgttggccataatctcctgtagaaaagggtctttcactggagaggtggaagatgacacggaattttccgaaagagattcatccttctttttgtatttaaacaaacgactcattctagtggctctctttggagtattggaagatgaagatgctgattgaccagaaagtttttgaggggaagtttctacgaacagaaactctgtcgaccgcccagttttcggcttgggtcttctgggagctttagtctcagtagattgggccattgactggatcatattggactgctcttcactgtcgtcatttctatacttcttgattctccaactcctcttcgagtaggaaaccaagcctgtagaagtggacgagtcagtactgtctggtagagtaggtctaagaggttagttcttgctgtttgagcctgactattcaagtttgcatgcagggcacttacctagccttcattctggccaatattgtgtcctgtaagtacactttagttaagcaaatatgcttaagaaatgttgttgtagtacaaagtaccagggagccaacctaaaatattcagcagattgatcggatctttgaaattctcgattcgaaagagatagggctccgttcaaaggtccgcagatggggggtggaaggagtgataaatggtgagcgcacgatcgttttactacattgagaggggatagtggttaacacctaggaaaccataagggacatgccaataaggttggcaaagtaaggggaccacggagcaaacaacgatgaaattgatgtcgtcgtttgaagaacgattggcaaagttttgtttcgagagccttctaacagaccacaaaaactttagggcaacctcggtccgagctatttcagtccgtttcatggagtcacaataccccatctgaaacgatttgtcccttctacatctaaacagttaccatggctggcattacaaaagctagagaaaatccggcaggcatacgactcaattaaaattagtggcggattacgtcaatttaattccgcggtccgctgaggctgtcctttccagctaatctaatcggccgattcactagttaaactaattacgcccgagctccatcctcttcatgcatgtggttgtggtggagtgccgtcaatttagatggtgtcaagatcctgccctcatcacggaatgtcctgatttaaaaggatcccaagagtggccgtagactgtaggctgtggatgtggagactgcttaaagtggtggtgatttttcaattctagatctaatttttttcatcccgctcactttagtaatagcacgcgcatgaatcccccgtgctacatgcagctccatcaatagccttaccgactgccaaaaaagaaatcgtctatccgggatcaattaatagcatcatccacttaccatacgtacagaattagggatggagattaatactttcttcaattacttatgtgctgctccccttcaattttgtgtacatattcctgattttcttgctggggaccttggcgggccaatattgcgtagcatacacccacagatgcttgagctttattgagttcccttgagcttctttgtcaatctcatctccgatagtgatgagttctttcttcagcagggcagcccactctttacgtggtaagccattctctccctgcttaagtcgtgataacgatgattggactttggacaattggcttctgcagatggattcttcatgcggcggaaggtggtcgtcatccgaactagtcttgtcggcatgagacctttcttttacattctccttcttaacctccttctttacctccttcttaatctccttcttgatctccttcttcatctccttcttgatttcctttttactgtccttcttgccatctttgttttccttcttgctgtccttcttgatctcctttttggactccttcttcaagaccctacgtggctcttttttcttcttgatttcgagagatttggacttcggccttgattcgggggtggaggatttggaaactcttttggtgtgctttttctcttctttagattcttcgccttcttcttttaagaatcccagaaggtaatccacccttctcgtcaaatgcacagctcctggtgttcttttattgaacttttccttctcctccttggaaagagtcgaaggtgcagtctccaggaaaattttgctctgcaatcccagcaaagggtcgtctcgtatctgaatccaagagccatagccaaacttgaatattcctaccaatagcatagcgtcatcacgctcagtccattcacaactccaaccgttgatcactttgggaggtctctgaaatttgaattgaagtgggtcacttggcatctttaaagacaaaagtttcagatctccaggcctggaaactaccatctccgcgttgacattcttgactccatggtactcaaaaagaacggcctttctttccttctttctaggaccatcgttgtttgccgaatctggcaccgagttttctttagatcgacggtcgtcttcagccttcagtaaatcttgggcctgatgtaccaagccattatacacatcttgcattagctcaaccttcttgttgggaagaataccttccccaatcagttcagtccatcgatcattcagatctccatacctcaataatgctcgataaatggtcctgtaatccttctctatcagtccttgagtctcagtggcacgtcgcctacggcttccaccgtcggtactttcaacgtctgtcccctcagcgctgttctccattgctttcaaagcggcctttcgtttggagaacatttcgatctgttcctttaggtactcttcatcctgacgtttcttttcctcttcctttaatttctttagttcatcttcaggaatgatatcatcccaatcgacatctgctttataatcagtaacttcaaactgtttaagaaactcttcgcctcccaaattactctctccaaggtccggtgtagtgacgtggtcttcagcatgattcaatacgtcatctagatttaaatcttctagctttttttggttatccgaggctttgaacatatttcctgcaccaaacttgaggatctcggataactcaccactggaaggctcattggatttcttcttggtttgaccagggtcacttataccaagagaaatgattgcatattctaaaatcatcttcttacgggctctttctaagacctcttcttccacggtatctttgctgacaaaacgatacaccatgacatgattcttttgacctatacggtgagctcttgccatcgcttgcaaatctgcctgtgggttccaatctgagtcgaatatgataactgtatccgcagtcattaaattaattccaagaccacctgctcttgtcgataacagaaaaacaaaatcttgcgatccatctgcgttgaaatgatcaatggcgacccttctgcgggcagatggaacagtaccatcaagcctttggaaactatatcctttgaatgtcaagtaatcacccaatatatccagcattcgaaccatttgagaaaatataaggaccctatgtccgtctttctttaatctagtcagtagtttatccaaaagaaccatcttaccagacgacatgattaaacctctaaatatgttttctcttgaagatgatcctaagtttgcgagcacttgctcctctgctccgtcaaacaagtagggatggtttgaagtttttttcaattcagccataacatttaacaatgaaatctgggcttctttaggccccgcatttagtgcagcataattcttggtcaagatattcttgtagtaatgtgtttgcaagtcagataattctacacgtaaaattctttctgttttggaatgcagtgacttttccacatcctttttcagtcgccgaagaataaaaggatgaatcttgctttgtaagtctttgatatacgtctcttgttcctcactagctgtttcaaaatcgatttcctgttctatcgtaaactttccaggcatcaaaaagttgacgagtgctgctaactcctttatgttattctgaagaggagttcctgtgataagaagcctattggcaattttaaaatcaaacaaagattcgtataatgaactttcagcgtttttcagtctatgggcttcgtcgactgccaaaaattgccatttgaattgtcctaattcagctctatctttgagaatatactcgtaggtagtaagcagaacattgaacttgggcttcttgctcttacctggaagaaagaattcgtagtctcgtatcatcttacgggaattggtatttcccatgtaatatatggtgtttacagagggagcccatttctcaaaggtctcctgccaagccggaactgttgataacggaacaactaccaagtgaggaccgtattgtcttctagcaaatatcaaccaacttaagaaagaaaccgtttgaacagttttaccaagacccatctcatcagctagaataccgttctcgtttctagaccataaaaaggccatccagtttaaaccagtaagctgaaaatctctcagttctccgttcttaatataaaccggttgaacctcaagtttttcaaatttgggacggttattgccgtaagaagcagaaagactgggtagagtcttggagttagctcgctgttgaaaatgtgtgactttatcgggactcaatttgacaatggtgttggcatcctcccaggtgcattcgtcataattgagacgcttccatttacacaaatactgcaatttagagtcaccatcctcaattattctgtcactgtcaacgattctctccacatgtgtgtactcggcaagctcctctcttcttctctcgcggtcaagatccaaggcttcaatatcttctctggtagtaaacgtgtcgtttctgacttcttgatcgtaaatgataaactgtttgatatagttatcaacttttttaattcctttgaatccattaaggtcagaataagactcccaggtgttgtgtagatgtgatattccagtccatttgatcttgaactcaaaatctacataaggatctcctgaactattcagcctggccctctcctctttttcagtctccagttttacagcttgttcatctgcgtcagaagtgagttcatccaaacctttgagcctgtgatctaaaacctgatctatactcgctgtgttattctcctcaacttcttggtcgtagtaaccatcatacgcgtaggagtcctcatcttggccattatctgactccaaaaactcatcctcgtcatcttctaaagcataattcactgttttgttgtttcttgtgctgaatctgacctcagcggcttccacaagatttccattcgtctttgcagatctcttctcctttgaaaccgccttcggagtaacttttctctttttggcaactccaaactctatgtcactttcttcactagccgattcgtcaaatgattcgtcaaactctagcttatcattagattgatcatcatcctcgccagaagtagttatgggtgctgtatgaggccttcgactgcggcgaagtccgtaaagctcaggattttcaaaaacctcgtccggtaaatctcttgacatggtgatggaatgatttccggtggtgttaacccttgtagtcctgttgaatgagtgtttaccgacaaaagaggtgaaaaaaaagagaggaaagaatctggttggaaggggcgaactaaatcgagaggaggctcataaattataaaggttgagaagggaccacctaatgatgggacgcctgaaccttgctttctacacataaagtattcaataactaagttaactggctgtggtgattcaaagacctgaaacaactactgttctttaaggtcgttaaattcagccaataggaaacgattcaatgaagcgtttaagtaataaacagtagctgcaacgatattcaactcactaccctcaagatatcacagaaaacccattagagtcaaaccagcatacaaccaagtactgttttccacattccgtagtcaatagtaacatggaccgtagcctggttgaagtcattctattaagatcaacctgtagcagtaaataacatttaatgcaagaagaacaggggttctgccggtgtagattgcaacaatcaaaagcactcacatgtggattgtgtaattgaaggatatgttcaagccatcgataggcatatctagagaaggacaaatgtgcaaatgtactacatcgcctcatatgaaatcaactatcgactgttaagccagcctcgatctggagtggaaattacatgtgaaatcaacaaaggaaacatgcaagatgtagatcaccaactcaaaagtgaacaactagcaacagaattgacgtcgaccgatatcatagaaagcgtattaagagaatcagatccaaattattgtttccaaaccactcgtgaaaatgacatacctaaaatgtaaacaaatgcaagaaaaaatgtcaacccttacaccttctcaaccctagaaacctatgcatagagggaaaaaaatgttcgtaacagaagaactttcaaaacagcagctcccttcaatttataccaaaagaagtcgtgcaccacaacgaaacgctgacattaacacccatctgcgcatttttgacaccaaaaccaaaattaagcagctcacggtcaatgccaaaattaccagtggttttcggaaacaaaggataacttcactttaggcaagaaatatcagcaacgtcgtggcgttcaaccaattacaatttttgctgcttgatcgaccaattcaaccaatcattcttgacttgtttgtcaccatcgcgtattattgcaatccgatttgattacataagccgatggttttctcagattttttgaaaaatccaaaaaaattttcgtagctaacttccaaccttacaagcaatacaaacgacacaaaggcgtcacaaaccatgagtgagaaaaacacacgtattgccattgtttcagacgatagatgcaaacctaagaaatgtcgtcaggaatgcagaaaatcctgtcctgttgttaagacaggaaagctttgtattgaagttgaagcatactccaaaattgccttcatcagtgagactctgtgtataggttgtggtatttgtgtgaaaaagtgtccatttggagcaattaacattatcaatctgcccactaacttggagaaggaggtcacccacagatacagtgccaactcattcaaattgcacagattgccaacacctaggccaggtcaagtcctaggtcttgttggaaccaatggtattgggaaatccaccgcattgaaaattcttgcaggtaagcagaaaccaaatttaggtagatacgacgcgccacctgactgggaagaaattttgaaatacttcagaggaagtgaattgcaaaattattttaccaaagttttggaggacaatattaaagcaattattaagcctcaatatgttgacaaccttccaagggcaatcaaaggtcctgttaataaggttggtgagcttttgaaagccaaactggaaagaaaggaagagggaaagcatatcatccaagttttggaattgaaacacgtattgaacagagaagtcgctaagctttctggtggtgagcttcaaagatttgcaattggtatgacttgtgtccaagatgctaatgtgtacatgtttgatgaaccttcatcctatttggatgttaagcaacgtttgaatgctgctcagattattagatctttgttgcatgccacctgttatgttattgttgttgagcacgatctgtctgttttggattatctttctgattttgtttgtattttgtatggtgtaccatcggtttacggtgttgtcactttgccagcctctgtcagagaaggtatcaatattttccttgatggtcatatccctaccgagaatttgaggttcagaactgagtctttaaaattcaaacttacagatgcttcggactctgtattaattgaacaaagtagagcttttgaataccccaaaatggttaagactcaaggtgatttcaagttaaccgtcaacgctggtgacttctcagactcggaaattattgtgatgatgggtgaaaatggtaccggtaagaccactttatgtaagctgttagctggtgccattgaaggtgatgaaggcaccaaggtacccaaattgaatgtttctatgaagccccaaaagattgctccaaaattcacaggaacagttagacaactgttcttgaaaaagattagatcatctttcttacatccacaattcaacaccgatgtgatgaaacctttaaaagttgacgatgtcattgatcaagaagtccagcatttgtctggtggtgaattgcaaagagttgccatcgtcttagctttaggaaaagaggcagacatctacttgattgacgagccatctgcttacttggactctgaacagcgtattatctgttcgaaggttattagaagattcatcctgcattccaagaaaactgctttcattgtggaacacgatttcatcatggccacatacttagccgataaagtgatggtatttgaaggtcagccttccaagaatgctgttgctaaccgcccagaaacccttttgactggttgtaacaggttcttgaaaaacctgaacgtcactttcagaagagatccaaactcttttagacccagaatcaacaaactggactcccagatggatagagagcaaaaactgagtggtaattacttcttccttgagaacactgagttataaaggttgcattcactgttttagcatacttatttattatagatgggtgcaccagtgcatcatatctcccatcacaggtgaagtgatacatttgtacaataggccaggcaaggtccatacttagggtcttagcctgagatggtgtttcaaaggtcagaatgagagttaggattggtttggttttgagttgaaaacagttttgtttgtttagtctttgcaaaattcctgactcttcttgctgattgccgcactttatatatctactactgcaatctaatacataattgcatgattcttcaatctaccctttcatcttctgcctcactgaaggataatgaaacccgtacttttatcacagtatggcgctataaaatgtgacttaaatcacgaactgtcagtatctctgattctccacaatttcagtaatcagtaagtggaagctagagacatcgtcatcgagcagatcttcccgttacttccaccgtacagtgcttatataatcagtacaatttatttccactccgggtaacaactattttcctgtttgtgtaaaaaaaaaaaattttcagcgaacactactaagtcgtctactacaactacttgttccctcttccaaggttataccaataattaatcgtttagtgtctatttgttcatagaaacaactcggttatacccttccacgttaaaaccctaaaaaaaaactataaaaaccaaacaaaaaaaatgtctgtcgataccaaggaagttcaagaatcccttgatcaacttaacatttcagaatcaccagctactgctgtgactgaagagactccagctacctctaccgaggccgctgaagagtccaacgagtcatcgactcaagcttccgagaccttggcttcattgtatgttggtgagctggaccctaccgttactgagagtgacttgtatgagttcttctctccaatcggtagtgttaattccatccgtgtgtgtcgtgatgcagtcaccaagcgttcgttgggttatggatacgttaactttcacagccaagctgccggcgagcgtgccttggaggagctgaactacgctgagatcaaaggtgtccgttgtagattgatgtggtctcaacgtgacccttccttgcgtcgtagtggttccggtaacatcttcatcaagaacttagaccctgctattgagaacaagactttgcacgatactttctcctcttttggaaaagttttgtcctgtaaggttgccactgatgagaatggaaactcaaagggattcggattcgttcattacgaaagcgatgaagcagctcaagctgccattgagaacatcaacggtatgctgttgaatggtcgtgaaatctacgttggacctcacttggccaagaaggaccgtgaatctagattccaggagatgatcaagaactacaccaatgtcttcgtcaagaactttgacactgagtccactgaggatgaactgagagagctgtttgagtcatacggtccaatcacttcgatccacttgcaagttgattctgagggtcacaacaagggttttggtttcgtcaactttgctgaacacgacgatgctgttaaggccgttgaagccttgaacgacaaggagtacaagggcaagccattgtacgttggacgtgctcagaagaaaaacgagagagtccacgaacttaccaagaagtacgaggctgatcgtcttgaaaaattgcaaaagtatcaatcagttaacttgttcatcaagaacttggatgagtccattgatgatgcccgtcttgaggaagagttcaaaccatttggaaccatcacctctgccaaggtcatgttggacgaaaatggaaaatctagaggtttcggtttcgtttgtctctctactccagaggaagccactaaggctatcagtgagatgaaccaacgtatggttgccaacaagccattatacgttgctttggctcaaccaaaagccatcagacgctctcaattggctcagcagatccaagctagaaaccaaatgagaatgcaacaacaagctggtccaggtataccaaaccagttcgttcaacctatcttttacgggcaacagccaggtatgttgccaccaggtgctagagtcccaccaatgggtaaccagattcctcaatttgctggtatgccaagaccaggcccatttccccaaggccaattccctagaatggctcctaacggtcagccaatgcctgtgtatggccaacctgtattcaacggtaacggtcctcagcagcgtggctactacccaaacaacagacagaacaagaacaggaatcaaaaggaggaaggaaactctttggctgcaatcttgcctcagttgccattagagcaacaaaagagagtactgggtgaggagctttatccaaaggttgttgctactaacaagacccaagatccagaagctgcaggtaaaatcactggtatgatcttggatttggacaaccaagaaattttgcaactgttggaagatgaagaacttttcaacactcatttcaacgaagctctccaagcttacgaggagtacaagagtaagactgttgaacagcaacagcaagcggatgcacaagcaaactagatttttagggagttaacttaacatctactgtttgacgcataaatatgatgatacaaattgctagatgttacgatgtgttgtgtggtgatgctacttgggacgtgcagtagcatttaattgttcacttttctataattgtatattgtgtttagttcaatcaagaatgaaaaagtcaaggtacgagttgtaccaaaggttgaaggttccctcgaaagcatagagttcctctaacgttgctaaatgggaactgccgtttagttagggttgatttgcatattcaacctcaaagccaaatgttccctatagcccaattgtttttggacgtaccaattcttacggtgaccattcccgtacaaccttgaactaattgagaggatcaatggaaactgataaaccaatggctcagctttcagtgcaggaattctgtacttgaaacttttgaccttcgtttgaggtttggaagatgcaagtgaaatgtagaaagggcagttagacaatacactgtcaattgtggttacgataagcgagttaacatgagcagctagtaattgcagaattaacacttgctcaaacaatgatccgtcttgaaataacatgcagatcacccttctacatatggaattaaccaattggaacacgcttaaagttgtagaaacaacgagtcctgtttacattactggttttcacctgcttccgattgacgtaagcttgaaaataaatcacaaattacgaaatctggtttcgctggtccacctttcctatatatccaataaatgccgcccaaagaggatgtaatgaagcaatgtaagtacctgttggaaccttgatccccattcagctcatcctaacgcattccaagtgatatatgttaccttgacgtccaactctaccacattgtacacatatgataatgctccacttattaataaactccaggtgaactgcactgaactgatctctcaggagctgggactcattaattccatgagtgacttcaaagacgagagcggatcgataatcataaacaatcggaaaccagtcttggtgaacggtgaatacgtgaatctggtcatgtattatgtcaagggatcattatctaacagcgacctaattacagttgtcgccgttgtatctgatcatgtgcttaaagaatttgtactgcaaacattgtggaagattctggtggagttcagaaagttcagggaagtttctgttggtgaggaacaaacacagaaaggacctgagaatgggaaagtagcaaaggtgggaaacgttgcgtattctccctctcaatcgtctccttcatctccgatctctttgcatacctcattaaacttttcagctagcggtcaggatagctcttcggtattgtcttttaagaaaatcatgacatccataattaagaaggaagagagcaaatacctccactacggcgccacttacgatgctacattcgatgaaattgaacaggtaagaaatattatgaacaaaaatattgaaaggacaataaataggggcgagagaatcaacttgctcgtatcaaagaccagtaaattgacaaacagtagtaactcgtttagacgaagaactgttgctttaaagagaaagatgtggtggagtaatgttaaatttatcatcctggtagggatattggttgtagtgatgttatattttttgattggtattgagtgtggaatgccatggtatcaaaattgcttgcaccctagtaagcccgaacaaccgcatcaaagcagtatataataactattgttcatcttcttcgtgaaggcttccctccgcattggtctctgaatgttcttccacgccatttaggggatctctatcaattgtatctattacgtcgggcgcttcgggcacttcttcatctgagctttcaaccaggttgtaaacctcttcactggcctcttcggtagcatcttcagtggcttcatcgtcatctgcaacttcttctgcggtaggttcttgagacgcatggacagaagatgcatccactgcgccttctacaattttcaattttttgtttgcttcgtacttttcatcgtcgccttcttcctccacctcttgatccttatccttttcattctttaatttctttgcttctttcctctgattaaacgatatcaactcttcttgaacagtaggaatgagagcactgaactcagtattttcaagagccttgagtatatcttgcacgttgactgttttacggtttggtccttactgacttctctggcatgatggtaaaggtaagatacaaacacaactgctgatctttgcactgcagtgagtccatctttggaaagaatcatattgctctcattctcatccccctgaaggacagattttgcgagcttgccgattgtagctttgggaaataataagttctaattcttagttagtaaaagccagatttggtgagaagggactcaacttacctcaatcgatatattttcagactccttatcttgttttgctgccggccctttaggagtaaaggagccatcagaggttttcttccatcccttggctggcattttctttttagtttcagatgtgaggccagttacgaggaataaaatgataacctaacgcgcctggcagtggaaaacagagtatagatgggtggattccatcacagttgcgcgaccagtcttgaaagatcccatttacctcttgtgagattttacccttcatgtccaagatctccaagtttctagaccttatcaaaaggcaggccttaaatgaggtggtactggtttgcggaaaccaatcggcagacttggattccatcgcttccagcatctcatacgcatacttccattaccagaaatacaggttcaccaagggtctggtgattcctttacttaacattccagagaaagatctggcattgaggaaagacgcagagtttgttttgacccagaatggcatcaagagaagtcaactctggttcaccgatgatctctcaaagtttgatcaattcaaactcatcatggttgatcataacgttccccaaggagaggtagctaagagcaggctcactcatgtggttggcataattgatcatcaccaagacgagcaaaagtatctagatagcgctcctcgcgtaatagaagagtgtggaagctgttctagcttggttcttaactactggtacgatttaattggagaggatgtgggggaatgcgcaacgctattggcttcagctataatgattgataccactaatttcactcagagggtaaagtcgcacgatgagaaggcgttagagacaataaaaatgttgggaatatacaatgtttctgcattcaccactaattttgaaaagattcaggagagtaaatcggatctagaaggtttgagcatgaatgatatacttcgaaaagactacaaacaatttgtctttgatggaaatacagtaggtgttagctcaattgtgaaacccttttcttggttggataagcattttgatatagacaaggagaccaagtcttttggggaggaacataagttggatctattggtgttaatgactgcgtatactacaaacgatcagtttaaaagggaaatttcatttcatgatgtattgaaagatttaagtgaaagatgcatcaagggaatgaaagacaaactagatctcaaccgcatttcagggaataggtttactcagaataatataaaggccagcagaaaacaggtggttccatacttggagcagactttaactaatactgattagatattaatattactaagagcttctaataagtaccgtgtgttctgaacgcaagagaagtgcgtatcctttaatttctttcttgcaagtatacttttccagtattctaagtgtcgtttaattttgggttcaattgatcgtggtatcatacaagttaaatcctcagctctgctggtgtgtcctccattgaatatcatgattcgttttcttctctacaaaattggatccatgatgcttcttccttctgtggtgactttctttgcccattgccttgcaagaatgctcaccttcatgaacttctttgatgcatattttttgaaaaattcttcatgaatgatgggagataccaaataatcaattagcatctcacaagtttctttcaaatgggcttcagtatagcctccggaataatgtattaggttaccgttccactcatatctccctaacattttgcgagcaacgtacatcgaagctgctgcgcacagggatggtagtacacctaaaaacttgtgatcaataatggttatttccaacagatactttcctattgtccttgactgaacgtcgtagtcatctgccttggagattcttctcagaaaattcattgctccggggtagtttatattgaaatccaatatctccaaaatgaatttctcagcgtccaagatctcttcctcggaaaacccactatcttgggcgtaatattttatagacggagaatagacctcctcgtactttgctgatatgaaaatgcaaccagttgccagcaattgaagtttatttatttgaacgggttctttggacaaaaagcgatccatgatattaattgagagatacagagtctccggcaacagacgaaactttaactgaacttcgaccagccaatctaccagaatggatctcattttgggtttgaatgatttttgccattgcaggtagttggggtctggtaacgtctccttctctaatcgatgcaaatactcgaagatttcaccaacatactcgctgaccatcaaaggatcatccgaatcatcagcatccaggtcgtcccaagaatagtctaccttggcttttttgttcgttacctggggcacgtccgtaatggtagcagatctcttgagcgaagactttgtgtttctattgcgatcagctggtcccgagaggatattctctttttgaatattttctggaaaaacatttgctactgaactagcagtttccactattgtgatgtccattttatcctccgtgtcctcttttctagcatgttgtgttcctacttggtcttttttatggagcccgtgatggggcaccttggagttgttactcacgtccgtcaggacgtttcttttcagttcctgtgtcttagaccgcgtatgacgtatagagtagacattttcgttaggctgaacattagacatagctcttctagcacttgttcttagtagaggatcttgccagctacaagtaaaaggggatagttaagggaagaaaacgcggatttgtatatagggctagctttgtttcaactgaattgatcggattgggaaaaacaacaacaaaaaagggatggtgtttggatgctacttgaaatctgcttttaacgtgttgcaacatctctggtgttgtgatgttggatcgagttagaggaaaggaaaaaagaaacaaaaaaaaaagcgaaaagggaaaagagaacaggcaaaagccgtgctatggatgtcaaggacgatggtcttccatcggttcacaagcccatggatctttgttcccaaatgggaaaagtaaggcttctgagtgtttttccatcccggatccctattgttacttttgcttaacattccaatattcttcaacggttaattgattaacactgtaacctctgcccatgtgcttcatccaaatctggtaatctgctttctatttctgccaaaatagttaatctatgagacatgtgccctccaattgcgcagtagatcgagtggaagtcttctttgcgtaacactcaaagtatacccctgttagtctttattcacctgttgctgcttggtgcagttaccattattgtttccacttgaaaagcttgtttttttttgatagcacagaaacgtgggctccgataagctaaacttcaacgagaatataaaagctgaaaagattcttgtcaagaacttgtacaacgaccaataagtctttcaaggcatcagacatgttttctcctattctaagtctggaaattattctcgctttggctactctccaatcagtctttgcggttgagttgcagcacgttcttggagtcaacgacagaccctatcctcagaggacagatgatcagtacaacattctgagacatctgggaggcttgggcccctacatcggttacaatggatggggaattgctgctgagtctgaaattgaatcctgtacgattgatcaggctcatctgttgatgagacatggagaaagatacccaagtaccaatgtggggaaacaactagaagctttgtaccagaaactactagatgctgatgtggaagtccctacaggaccattgtctttctttcaagactatgattacttcgtctctgacgccgcttggtacgagcaagaaacaactaagggtttctactcggggttaaacaccgctttcgattttggtaccactttgagagaacgatatgaccatttgataaacactagcgaagaaggaaagaaactttctgtttgggctggctctcaagaaagagttgttgacaccgcaaagtactttgctcaaggatttatgaaatctaactacaccgatatggttgaagtcgttgctctagaagaggagaaatcccagggactcaactctctaacggctcgaatttcatgtccaaactataacagccatatctacaaagatggcgacttccccaatgacattgctgaaagagaagctgacagattgaacactctttctccaggatttaacattactgcagatgatattccaacaattgccctatactgtggctttgaactaaatgtaagaggtgagtcatccttctgtgacgtcttgtcaagagaggctctactgtacactgcttatcttagagatttgggatggtattacaatgttggaaacgggaacccacttggaaagacaatcggctacgtctatgccaacgccacaagacagctgttggaaaacacagaagctgatcctagagattatcctttgtacttttcctttagtcatgataccgatctgcttcaagtattcacttcactcggtcttttcaacgtgacagatctgccattagaccagattcaattccagacctctttcaaatctaccgaaatagttcccatgggagcaagattgcttaccgagagattattgtgtactgttgaaggtgaagaaaaatactacgttagaactatcctcaacgatgcagtcttcccactgagtgactgttcctctggccctggattctcttgtccgttgaacgattatgtttctagacttgaggcattgaacgaggacagtgactttgcggaaaactgtggagttcctaaaaatgcttcctacccacttgaactatcattcttctgggatgacttgtcataaaaatggtaaggaatgttttgcatcagatacgagttcaaaacgattaagaagagaatgctctttttttgtttctatccaattggactattttcgtttattttaaatagcgtacaactttaactagatgatatcttcttcttcaaacgataccacttctctcatactaggtggaggttcaatggatcctacaaactccaacgatacaaatccaacaccaacgataaccagtaaaaaccctatcaggccgcggaaaatcgaacctccactgatcaacactcccaaaaagatgtagaagccacctcttcccaaaaatgacaacaaaaacgatagatacggcgtaactttaggtaccaattcgggctttatttctagagctgcaatcacacctccaaatgcaattataaacagactcaagagaaactaaaacttgggtcagtttggcgggcttgaaaaagatgtcacataatacttacagcattgagaccatttagcaattgtagtgctcccgcaaaaatctgtagaagaaccaaagttagtaattttccctgaatgacagttctgcttcttatcttgcttaccgtggcccctgcaacaaatagattggcggctttgaatagagaattgtaattttgttccgtttccatctctctataagcttcaacttttactgctaggttaggtgaccaaaaataaacaccccaaaaatggtagtgtcccggtgaaacaccaagggcctagacgttgaaactcagttatcagatgaaattcaactatataactaactgagtataagtcttctatgttaactcttagtagctaaatcactataaagttctggaattgaaaacggaagtcttctcagctcaaaacctaaacaaaaaaaataataaacattctttaggctcaaattcttgtcacctcaagccccgctccgttcacctttctcaaaaatatattcccgatacatatcttgtatagtttcacaaacactaatcaatcgatctatattcactcttcatctttgggagcagcttctgtcttatcttggctattggatgactcttcttgtccagtttcagacatgtctgaggtccacaaagtcaagttgtcacgcagcagttgcataatcaaagtggagtctttgtaagattcttcagatagggtttctaactcagcaatagcatcgtcgaaagcttgcttggctaaatgacaggcgcggtcaggagagtttagaatctcgtagtagaagactgagaaattcagagccagacccaatctaattggatgagttggaggtagctccgtaacagcaacgtcagaggcagacttgtaagcctccaatgacaaattagcagcttcctttcgcttgtcaccaacagcgaattcggccaaataacggtggtaatcacccttcatcttaaagtagaagaccttggattcgccagttctggcagaaggaataaggtgctcactcaaaacagacaaaatatcctcacaaatgttggccaattcggtctcaatcttggagcggtattctctgatcaaagacacttgtgattggttacccttggcttcctctttctgttcaattgaggagacgattctccaagaagctcttctagctccaattacgtttttgtatgcaacagaaagcaagtttctctcttcgacagacaactctaagccggaagaggcgacggtcttcatgttctcgaccatctcctcataacgctcagcttgctcagctagttttgctaaataaacagaatcttctcttgacatgctaaaggtaatgttagtaaaggaggcttcgggcaaaaaaaaaaaaactgggaaaaaaaggaaggaagaaatactggaacttaaaaaatcgaagcaatcatcggaaaatcaccacttcattgcttaacggtcatttcgcttggatcgtagcaaatttcaaatcgtgtctttgtagccaatagacgaaatctcccgtttgctatgtttgtttatactacttcgccacccggtagtacgatggatcagagtaagttcacttgtttctcaaaagtccaatcatccttctcaccttacacatgaactactcactttaaaactcaaattaatccgtagttactcaattaaaaaataattctttagaacctttgataataagtacgtgtgaaggtattcgcaaacgaatctgaggttcaacaaaggcccatattgttttgattggtacacctctatggaaatcatcagaaagaaataagaaatttcgacagccaccgttacccggagggagataaaataaaaccgctttacgaaaatatggtggtgtttaggtgcaatgtgtattctctattattacatggtcttttaactagaatggaggacactcttggatattgagtccgaacttggagtcttcggtcagtttgacaagttcgtagatcgcctgtttgtaaggaccatctaattcgtagtttgaatggacgtaactgggcctggaggtgctacctcctgtcagcctgattggtggttgttgttcaggtagaaggattgtagagcattctctggcaacgtcaattggaatagactttttcaaaagtgacttaagtttcaagctggaaattcccagccttggtaggggtgtttctaagcctggcaaagttgggttggctgcgtcgtaaccatccaatcctgtggcattagaagcttccaatacaaccttcaatgggatgaatcgagcggtttgaataggttttgtaacacataaacgtctgttggtgatctcggacattcccaatctaccgcgtttcatctcgttgaggatgtttgatagttgtgtctcaactggttctgcagtcccgtcgttggaaatgtttataggataagaagaagctgtgtgggccaatttgaaggggaaaactgatagtttcttatcaatggtatctagaagggttcttgaagcttttagcttcaaatgacgaaccattatcacatctcttaagaatattgaaggcttggaagtgatggacgatttttctttgttcttaccaacgatctgatcaacactttgaagagtgacatatccaacctcattgatcccttccagactggccattctaatatcaacaatatatgcttcaccaggaagtacctgaaactcgtctgtaggaacggtagacaggtttctcaccaaaggagacagtttgtgaacaaccgtgagatcttgggatgagttgacactttctaaaaaagccttttcctgatcagattccgaccagacgacacctttgtattctttttcagcaactaatccctcggcttgtccagccaagaatcttctaacacgacgaactcttgaacctggcaaaactctacagttgaatgattgggcaatgctatccactaccgatcttatggtggatccgataatcttgttgccaaaggcagctggaatcttttctggtgtggtggttgctgctaatagagtagtaatagtttctgtggcaatgtgggcggcacaaacagcatcggcctttccagttaacaacgggccagttgggctctgtcctggagggaaaatcacaacggtatgggaaacattggcagtatacccatccagatgacaccctagagttatagtggcgatatcgcctggttgcaagtaaacattagcggtctcatccaactctggtgagtatccactgacaacatcgttcgcttctatgcacacaggttgggcaatccctttctctctaataacactctttgtctccgtaagaccatttatagtatttatcaagtagctgtcaccaagggcacacaattcgttgatggaatagacagtacccacttgagtgtggtagccctcattgatcagtttaaccagataagtcaaacaagattgagctatctttccggctgaagtatatttttccaacacctcattgttcaagatgtttttatccttcaagagaatatcagcatctctgggggcaacttgtaactccattatttaggcaagttagtgggagtactaagaataaaaaaattccaaccagaaatattttttaaaaattttccttggtgatgaggtttacatttcgcgaccccccacttccaccaatatctagttcagtgcaacgtcctcgtaacggcgtatgtactccttctgtctagcacttgtggctacgccattccatgtgtcctcaaccggatcgtagacaggaacccctagctgttctatgacaaaactactggcaacattagcggctatattgctcaatgtccagttaccagttgaggcaaacatgaaagcaacagctcctgcgaatgagtttcctccgcctgtggtgtctaccaccttgaaatctgaaaactttggatcgtggtacgcaggaaaccatttgtggtagcttttgtctccagtaattgtaagcgatccaagttttccgcagcgtaacacaatggcgctgttgggtttctttaagtacttcacaaaagaattagcaacgaagtccatctcttctctagtctcgggttcacttcgacctaacaaacatgccgcttcagcagcgttgggggtaaatatgtcaacgtgttccagggcttttattgtttcttcaagcctggcagatacacagtaaaccccaaagggttcccagacgattagaggtttttcggcacaattcctcttatctacaataccttgtacaatttcaattaacttaggtccatctgacaataaatgaaaagacttggagtacaacaattcctcttcttcatcaagatcagctaccccaattcgtttctttggtgttaaatagctaaagctcatctgttctgtcgagctcatggtgtaattcactagtcctctggtagtcaatctcctcctgtcgaccctctgtttcatcaaagtgttccaactcgaaattactctcttgacctcatgatcgtcgtccaccatgtctcctccaaaatcagcaaatccgcctatcgtcctcggattgtcgcacacaattctggcgccgacagtagcatacaacccgcctcctcccatgacatctttccgtacgcttccattgagtaaatgaacttcatccacgataaacatcccgagagaggtgaacatcacatgacttttatcatttgcttcgtactctctgttttccattcgataaagttaggaaggagaagcgaagtgagaaacggcattttacttaagcaactgataccggtgcatatcaagataagaggtgagataatcaacaattcttagccggttgaggacttttttgtttcttcaaacagtttttaaagttactattcaacaatgagcaagaatgaacaggaattgtcccaattgggctccgtattcgataccagagcagcctactttgtgtgcaactatttcgcttcccatgataattatctagtcgacctagatggcaatgagtacttagatgtgtatgcccaaatatcatcgatagcactaggctacaaccatcctgaactgattaaagtggccaagtctgacgaaatggccgtcgccctggtcaatagacctgccctagggtgctttccttcaagtgactataggactattctggaagagggtattttggccgcagcccctccaagtttggacaaagtttggacatcattatcaggttctgatgccaatgagacagctttcaaggctgcattcatgtaccatgcccttcaaaaaagaggcaaagggacaccttttacagaagaagaaatgaaatcatgtatggaaaatctccctccaggttgtcctgattatgtcattctttcgtttgaacacggttttcatggaaggttgtttggttctttgtcaaccaccagatccaaagcaattcataaactggatattcctgccttccaatggccaaaaacaccatttccccgactgaagtatccacttgaagagtttgaaaaggaaaactcacaagaggaagagcgatgcttggaactgttcagctccgtcattgatcaatggaaaggaagaatcgtcgcatttattgtggagcctatacaaagcgaaggtggtgacaaccatgccagtccttatttctttcaacggttaagggagattagtttggagaaaaacgttttgatgattgttgatgaggtgcaaactggggttgctagcactggaaaattttgggctcatgagcattggaatttaactactcctcctgatttcgtaaccttctccaagaagttccaagctgcagggttttactttcaaaatcctgaatttgttcctaaccaaccattcagacagttcaatacttggtgtggcgacccttcgaaggctataatcgctagaactattttcaaacagattcagaaagataacttggtcagtaagattagagaagttggtgactatctatacgagaagctggaaaccgtcttcaaaagcactccagtgacaaatctaagaggaaaaggaagagggacttttattgcttgggattttgactcagcacaggaacgaaacgagtttttgttgaaaatgaagcaacatggtattaatataggaggatgtggtgacagctctgtccgattaagaaccactctaatatttgagaagaagcatgctgatatcctctgtgatgcaatacttaaagtactaaatgtttgattgattattgagtcattttctttggcttcagtaattccttcaaggctaatgtggtaccattatttctaaaattagggtcatctaagtattcgaaggttgtttcaaatttgaataaatccttgttgatttgcaaaatttttgattgcttatcccctttcggttgtgtgtttatgaaaacttttattttggaaattacttccgcaaaacttgtttcactggtggtagctgaagcttcctcttcaaaattgatcttgaactctctgctgaaaagttcgaaaacatccaatatattcctgtagtttagaagtgagatatctaactcaaaagtttttattaagtaaaacagatctgaattgtgctccaggattcggtatatcagttgtagtaaaattgaagtcgtatcctcaatgagttgatggggaccaagaaataattgctgttttccccaatcgttcaaaacaaactccacaattataagtatctcctctactattgaacccaactgtttgttagagacatccatcttgtgcttgctaactaactttgaaataaattgaaccacttgaaactgggtgtcccaaaagtcgacccagttgtatcttccttcggctccgctattcttgtacgaatagtttagtaggtcgttatcggatagtatctgtaatgatttcaagacaatgttgttcaccaacttgtagttgtccagctctagtttctgagtcaaattatatcgagagtatctctgtacgtcgtcaagaatgtagtaaatcgaacacttattggtgataaactggggatcggatactaattgctctccatccagttttgcctcatgcaaatcaaatactccaactgggttgattagtggtcttcgctgataggagggttttatttttcgttgattgattgtataaggcaccagcttggagctacaggaaataagtaacttgtggagtatttgtaatgacattctggtaacaagcttgtgagtgggtgagtagtgctgaaaagtcattacatacgagttgaacgacagaaacacctcaagaaaatcaacgtcggatcttcttgtggcaaacagctggcagtaaaaatcatcttccgctattaatgcggtaaaaaagaccatcacaggcaacaattctggtacaggcaacaaaggagagtggttgaaattttccatatttgattcacaactatctttataacgttctaactgtcgatcccaaaacttgggaatcaattgatcagttagcaactgtgaataatgagtgttggtattagaattgaaattgaatctgttgaaagtcatcaggtgaaaaagagaggtccttttctcctcttgaaacagaagatctggagagaactcttcataacacttggtggccaagatgaaccattggaaaagccatttatctatcaaattgatctctttttcattctgagagataatatgagtatttagcaaacctttgtagatattatggttgacttctttgtttgaaaacaaaattgcaagacacctgaatactttcatcacaaccacagaatcaaaggtatcatccgcatcgctgtgtccagcatcctgtaagattgacagcagccctacaaagaaagtgtccttttcaaatagtaaatctaaaaccatagtgtcatggaatcctaccaaaagggaatccaataactccaaactgctttccctagttgaatatatgacagcgtgacaagaatccttgtcattgggaacaattgatagaaagtgatctgtgaaatagatcagctctctagcgctactttccacaacatccacattaccgaagataccaaccaatatctggttattatccaactgcttcttgctggaattagagctgagtttcctggttagaacgttcttaagaataaccctcagtatattcagcacattgttgactagtggccaatcagttacttcattttcttgtgttctagtatctagttgctcctttaagatctccaaggcgtgctgtatcagatttttcagtatttccaaatgtgctggtttggcttttgctctaacgtctatattattcagtgttgaattgagtgctgtgaaaagaaacggagttgtaaggaaatctctaaaatagctttctgctgtgtcttgttgtggttcgacatccagcaattggctgtaaatatgaatcatccggtgatagttatccatcttgcctacagtatgcggtggttcaaagctagctaaatatagtggaggcgcgttctttggggggcttggatgggggacaaaaaagtacaattttcacgactttgattgatgataagtctattcctgtagtctatatatgtatacattcataaaacaatagccagcgctagtttggcatatcaactacgtcggcattctcagcctccaatatcaattgggctttttttatctccttctcttgaccaataataaaaaagaccagcaaacctccgaataaagcagttatggaaaccagcaaaatgttaaccgggattgggttcatttggaaggtgtcatgcatcagagtatccaagtacttttgaatcaaattgcaaaatcccgaaagacaaatgatagtaccgtaaactgttccaaaagtatcaaaaccaaacactttggcacagaaatcagagaccgcagtgtaatagaaaggtctataaacaactaggagcactattcccaaaagggcacaggcctcgtttgcaatcactcctaatattccaatgagcagagatattccaagtaaaagttggatcacggtcacagttttgaagttgtccaaaaagaatccaatgaatggaatagaaatgatacctcctgcaggtaatgcgacatcaaagaattggttgataacggcagctgtcttggagtcaaaaaagtactgctcttgagctcttatagtagcaacaaaaaagtttatacgtagcatctgtactgaggtgaacagggccatcaaatagaaccaaggagtgaaaatttgctgcttcacagtctttccatgcaaagctccaaatataccggtttgctttaccaatttattttcagcttcctcttcgtagattgttcttatcgagtttcttctgctaatggtttcccttggcaagagctgtgaggcctcatcgattgtgataggaataccagtttcatcgattccttccactgtaatcttagcaagtgtattggatgtcttgtaggagtccttaggcataatagtgagttgacatatcaaaatgaaagccggtaccaccaagtagaagctaaagaatctatgcaacgtaagatttttgatgatatcattttggtaaatgaggcggtagaacaaaaacaaagcagatgaagtatcaaatgctccagtcagtaatgccaaaaccaatccagagtttctgggaaatgagtttgccaattgaaagcaagatataaacacaaagggtccacccaaggctagtagagagtacccgtaacggtacccgtcaaagggtagtttgtcaccgtctctcagtagcaaacttgctagtgccaacaaaacagctcctgttattcctgtgactcttggaccataggtatctaggacatgaccaaccagcagagcagcggcatttgtcactacagcagcaagtgtgaacataaagtttagtgacaagtcttgagctggacaaagatctttctcttttgaggaaattgtgctttgcaacatctcatcgagtttaccaaacgtgagttcttcggctttacatttttcatggtagatgccttggtcaatgagcactggtttcaacgcagcaaaaccgaatatggggccagccgctagcaaacaccagaacattgcgcatcctatctggactaatcttttgacgaaagtcgctttgggcgcccggtaaatcgatattgcagattcggagtccagagtagcactataagacatttggtagatctttctaagaatgtactgtgcttcttgagcaatggcaggaaaggaaaatgcaggaagttaaaatgcagccgaagttttcagatcgggcattagataagaaaatcgcggcgggatgcagggatttttcaaccttaggtaaggcagaaaagaagtgtcaaaagaggtcacgagaagaaaaatggaattgtccggtaaatactatatgcccttctatttagcagcaggcaatattatgcaaatttcatagagaggcattttatatcttgccaattttgtcaaactcgtcattcaactcaccgagctctctagcagttttgtcctcttctgtttctttagatggagtgctagtacccgattctttttgcttagccttttgctctcttttcagttgtcttttgctcttttctccggttacactctgggctttccctttgttattcttgttggctttaatctcttctggatcaagatctaaagcattcaaaacccaggatacctctttattgataaggtctttgatgttgggaacgtagtgtccaccagggtgtttgagagtcagagtggtctctggaacacagcactcatctattaatctctgagatctttcctcgctgacaactgtatctaattccccaaaaatgtgcaacgttggaatactaatcttgggctcataatacttccaatatttctggttattaactttgaatcctgaatagaaaatgccaaacttcagtcccggatgaccaggcactatttcagagaacttgttggccaatatagctgcgagacctgcaccttgagaaaaccctaaaactccggtgaagggacctttctctttacaacattctcggacggcctcaaatgctggttctatatcaaaatcatcaactgtgtaccaccagcctttgaaatcaggagcttcggcagagtcagcactgtcagcacccaaagatgcagaatcgaagggaagatcagcacctttcaattgcaggggtgcattcaaaaatacagtttctatgtcaaactttttcaaagcttttcggattccagatgcttttgcggaaaaattgggaccgttttgggcaaaaccatgaagacacaaaactcttccgttcatattgtctagactagtgggaaggtacctatctaaggttttttttttccgtagcctccagtaagcggataggcgcggcatttgtttttcggatcagagtcctgctcccatagctagcatttgacaggattgtattgcgaagggaaatgacatgtctagcttaccaatgaagtgaaatcgtaagtaggagtgctttccctttccttttcgactggtcgcaaccggtaagactagaaattctaggtagtcctcagtagtgagctacaacgccaaatcttattcaaaaaatgtcagtttcctcatatcataaccaattacctgaaaactacgaatccagcgatattggagctcaggttttttccagtgcctccttcaacttttcagcctttctcttcctttacccctacagctggtccctccactatttttctcacttgtgtgtcacacgaccttacttaactggccggacaatcaatctggggaaacgagtatccaaggaccaactacgaaccataagcaaccaaaatggcagtgtacagcgtagttgacaatttgagggtctgcgtggtgatggtgggacttcctgctagaggaaagtccttgatcgcccaaaaactggttcgttatttaagctggttaagcatcaatacaaagtgttttagcgtgggcaattataggcgcaaagaaagcgttcatccaagtgcagatttttttgaccccgaaaatgaaatggggtttttgataaggagacaggcaacagatctagctatcaaggatatgctggaatggtttgacaacggagacggcgttgtaggtattcttgacgccagtaacatcactaacgaaaggcgtaggcaggtccttcaaatcatgagggaaaaccagattgagcctattttcttggagagctattgcgatgaccaagagcttattaggaagaatgtgaaggatatccaagagacttcccctgattacaagtctatccaagaagactatgcgataaaggatgtactagagagaatcagtatttacgaaaagagttatgaaagcatagatgtggaacgagattctgacctgacgtttgtcaagctaatcaatgtcaatacagagataatcatcaacaagattgagagctatttggagagtagaatagcttttttcgtgatgaatcttcatatcaagcccagatatatctggctatccagacatggagaaagtcagtacaatcttgaagggaagattgggggagatgcagatttgagtgaaagaggttggaagtatgcgaagaagttgccttctctggtagagaaatacatccccaatcacgagaagctgacagtatggacatctacgttgaagcgaactcagcagacaggatcgtatcttccatatccgaagaagacatggaaggcattggatgaactggatgctggcgtttgtgatggtatgacgtatgaagaaattgcagagaagtatccagatgatttcaaggctagagacgaagacaagtttgaatatcggtacaggggaggtgaatcgtaccgcgatgtgatcctgaggttggaaccgattatcatggagatggagaatctggaaaacgtcttaatcattacgcatcaagcagttttgaggtgtatttatgcatattttatgaacgttcctcaacagcagtctccatggatgagcattcccctacacactttgatcaggctggagccaagagcttatgagactttggttactaggatcaaggctgatatacctgctgtgagtacctataaggagaaaggtacttccaagttgggagagtccaccaagaatgaccattcaatggctggagccttgattagcagttcatcatccaaggatgtttgaccgtgaagtattttcattgacaccataaggaaagatagtatctttgactgtagttttattttggcagaaactgctatctatcatctatttatctagtctagttgttctttgtaaagataacagtacaggcagcatttgattgatctggcagctattaaaatgttgtgggcctttggctgtgatgtaataaggatatccatcaacacatactctgccactgaaggcatcatttgatgcaactcctcacgatccaattgggaccgtgcagtcttaccaagatcgagatctccgcgcgctgtataaaaggctgccgaccccaggtattttgtcaccatctgagggcattcgtggtagcatcattcaatgattaagaaccttagattgctacttctgggtgctcctggatcaggtaagggtacgcaaacctcaagattactggaaaaaattcaaattactcctgtcagcagtggggatctcctgcgtacagaaatctccaaaaagtcttctcttggtcttttggcttctaaaatcattcaaaaaggagggttagttcccgatcatcttatgatagctcttatctatagggagtttcaagccaggaattggctgggccaggattgcagttggcttcttgacggttttcccagaactcagaatcaggcagtggccttggacgacaagctgaccgttgctccgattaattgtgtcattgaacttgacgttccagaaaaggtgatccttgagagaattgaaaatcggtacattcatattccctctggaagaatttacaatcaacaatacaatcctccaaaagttcctggaaaagatgatattaccggagagcctttatcaaaaaggcctgatgacaatgcagaggtcttcaagagacgtctggataactaccacaaggaaattgaccctctcaaggagtattttaaaaataaaggaattctacacagtattcgtggggaaacttcagatataatattcccccagttgtacgagtatataaccagtgagttcacttccaaatagaccgtagatgactttattaggacaattatataaattatattttatcgcattcattatgcccaagaccaacatttagtgttggttgttgttggatcaacattagctgaactgagattactttgtataaatgtcgttattattttatttcgatgtgtcagtatatctgtcagtttgatatctacaacaaagtgaaatattatttagatacaattattgtaacaatgaccattcgtttcatagttgcagaacattataaaattcctcaactatgctcgttatatgctagtcaataaaaaacatggcatgagtgagcttctgtggcgcagtggtttagcgcatcgtgcttataaacgtttaacacgtctatgttcaaagcacagtcgtttagaaacgcgatggtcgtgggttcgaacccctccagaagcattgcttacttttttctttttgctactaaaacaacgaaagtctaggcctattgtctcctgtttcacttaacatgtttaaagtgcgtacatttttacaaactgacgtatcggcaacatcattccttttgtcttatcccctcattcaatgtgaaacatgtaagagatgtggaacggagcgtctgcgcatctggaatgaaaataacaccaaattattacataatcacaaaacaacctcctagtcgtgcatcacgcagccaattctcttcgtcgataaacaaatctgaggtaaagcgaagctcattaagtaatcacgccaacttgaggttaccaaaataaaagatgcaaacaatcaagtgtgtagtggtaggtgatggtgcagttggaaaaacctgcttactgatgtcatatacaacgaacaaatttccaccagattacgtgccaacggtgtttgataattatgctgttacagtgatgatcggagacgaaccttatactttgggtttgttcgacactgccggtcaggaggattacgaccgtctccgtcctttaagttatccaaactctgatgtgttcttgatctgtttctctgtctgttctcctccttcgtttgaaaacgtcaaagagaaatggttcccggaggttttaaaccactgtccaggtgtgccttgtctgatagtcggtactcagatagatcttagagacgacaaagccactctgagaaagttacagaaactgaatacaaaacctattactcctgagcagggggagaaattagctaaggagctccatgccgtgaagtatgtggaatgttctgctttgacccaacgaggtctcaaaaacgttttcgatgaagctattgtggctgctttggagcctcctgtgtataaaaagtcgaagaagtgtttgattttataaggttgtatattagcatggtgaggagcaatgcagtttgataagttagagacatttttcttcgtacaccgataaaaggaacctgagacccattttgacatctggtattcttgtcagagggggacaaaagaagcatccagactttactggagtgctgctgttccaccataaagtgtcaccatgattctggaatctcttttccttatgagatcaaacctttcaagctggagagcgcagtgagtgatcttgatattttcaattgcaaaatgttccaaaactaaaaaatcataaatttccatgtagtatctagcttcagctactgcccggtgtaacaactggtcagccaagtggcatctttttaccttcctggatcatttgtattcttgggtctgcctgtaggttatcaaaacttctcaacctttccgcctagctctcctttcgccatcaaaattcgccctcgcaaaattttattctttcacctacccataatgttcgacagtacccgttcagataccctgttccttggagctcaaaaggtcagcggagacgatgttcgtcagcaaaacgtgctagcaacccaagcggtagcaaatgtagtgaaatccagtttaggcccagttggattggacaagatgttagtcgacgacattggagacgtggttgtcacgaacgacggtgccactattttaaatttactggacgtgaagcatccagctggccagatccttgtagaccttgcccaacaacaagatagagaagttggtgatgggaccacaagtgtggtgatcatcgcaagcgaacttcttaaaagagccaacgagctggtcaaaaacaagatacacccaacgactataatcacaggatacagattggccctcaaggaaactattcggtacataaatgaagttttgagtcaatcaattgattcgttctccaaggagatattgatcaacatagccagcacttcaatgagcagtaagatcattggatctgattccgctttcttcagtgagatggtggtcgacgccatgttggccgtaaagaccactaacaacaaaggtgagactaaataccccatcaaggctgttaacattttgaaatctcatggtaagtcttccaccgagtcaatgttgatcaacggttacgctttgaattgtaccgtagcgtcgcaggcgatggtgaaatatgttaaggacgccaagattgcttgtattgatatcaacttgcaaaaagcccgtatggctatgggtgttcagataaacattgatgatcctgatcaattggaagagattagaaaaagagagtatggaattatcatggagagaattgacaagattatcgaagcaggtgctaatgtcgtgttgaccaccaagggaattgatgatttgtgcttaaagaagtttgttgaaagtggcgtcatggccgttagaagatgtaagaaagaagacctgagaagaataagcagagcaacgggtgctaccttcatttcgagtatgtctgatcttgaaggtgaggagacttttgactcttcctacctaggaaatgcaagcgaagtcgttcaagagcgtatctctgatgacgagtgcatcttagtgaagggaacaaagacccattctgctgcttctatcattcttcgtggtccaaacgaatacacattggatgagatggaaagatccattcacgactccctgtcggttgtcaagagaactttagaatccggtaatgttgttccaggaggaggagccgtggagactgcgttgaatatctatttggagaactttgccactactgtaggctcaagagagcaattggccattgcagagttcgcaaatgccttattagtgattcccaagactctggctgttaatgcagccaaagactcctcagaccttgtacccaagttaagatcgtatcacgctgcatcccagcaagcgctaccaacggagttaaagaagaaaaactacaaaaactatggtttggatttaatcaaaggaaaagttaccgatcaggttcttcacggagtactggagcccaccgtgtccaaagtgaaatctttgaaatccgctttggaggcttgtgtggctatcttaagaattgataccatgatcactgtggatcctgaacctgctaaggaggatcctcatggccacgatcactagcttaggtagtagatagacacctagaggggaatatggtatgtagtaacccccacttattacataagcatacacgaataatctttaaaaggctaaaaattcagatcttacatatatttctactctctcgtatatctctatacgaccatacatggctaacctaaagatccctggatcagagcagttaacaacaaataaggtgcttaagtcttccaagggcaagcggaaataccataacaagagcaggaaaggatgtacgacttgcaaaaaaaggcgagtcaagtgtgatgaaaataagcccatatgcaacaaatgtgagcacttgggcttggactgtatctatatgagtccaccacctaagaggctcagctccagtacgagtgatggcagtccagctataacagtaccattgtcgtctgggcctcctcttggggccacttctaactcaccctccaaccagtacacaggaaatctgaacatgctagatctaaggctaatgtatcactacataactaaagtttggcatacgataacagcagctggtatatctgatgccaagatctggtgtgaagacattcctatgctggctttcaattatccgtttttgatgcattcaattttagccttcagtgctacacatctttcacggactgaaaaggggttggaccagtgtgtaacttgccatagaggcgatgctctacgtctcctacgtgaggccgtacttgagatttcaccagcaaatactgatgccctggtggcttcagctttaatactaataatggactctctggccaatgcatcgttacctacttcaacgtctcctaaatcacttccagcttcggcctggattttccacgttaagggagctgccactatattgacagctgtctggccattgaacgaaagttcccgatttcacaaatttatatccgttgatttaagtgatctgggagacgttgacctgatgggcgataatgccaatgctaaccacccacatgatgtgaaatattcccagttgttatgctttgatgaagagctaaccgaccttttccccgttacttatacgtcaccttaccttattactctggcttacttgaacaaattgcacaatgagcgatacaaatcagattttatcctgagagtttttgcctttccagctttgttggataaaacgttcctgactttgttaatcaatggagacatttctgccatgagaattatgagatcgtactacacgcttctcagaaacttcactgacgagatgaaagataaggtttggtttttggaaggcgtgtcaaaggttcttccagtagatgttgacgagtattcgggaggaggaggaatgcatatgatgatggactttttaggaggtccttctactttgaacgataatgacacaaatgacattgctgacaatatagcccagtctggccttttggataccgacaatttgccaagttccataacagacaacttagatatcatgcacagtagtatatatgatgagtaacgagggttaatttagttcaataataataaaaaggattggagttacaagagtcagacgaagtgacagagtccttagaattttttcctagcaattccatcgctatctctatcaacacctagctctagaagctttgcaaaatcctgactgaattcatcaaaaaacaacttctcatcctccccatagatcttgacccacttagcaaatgatgggtctctgagcagtgccatatcggtattcagcatcattaaacgtttcttttcgtagcagaactgtttcattcctgtttcaggaactgtacattcgtcccactcatgagttaacaattccaaaaaaaactgatttgagaactgaagaggattctctgtccattttccatcccagccactatacttggcatgagtccttcctagtgcatggccacctccaattagacaaacagcagccctatcgtcgaatccaagcgcattgatgaacacatctctgatatgatctgcacccaagcttcccaacggcagtctaccatttgggggtaccagagattggtcggtacaatccactctaccaggtttccagtctattttcggacctcccaaatactcaattgcaatggctccagcaaaagtgtagagatcagcataggatatccatggaaatttagcctgaattaagtttagcgctgacatggcagggtgcagtccagtatttcctggatctgtcaattcaggtgggaatctgatggtacatccgttactgcctccagtaccagttctttgatcatatgtggcagatacatgccaagctaacctcactatattgggcgctagagatccgtagtcaagttctggcctatcgaaacaattaatgatctcatgtctgacgtgctcgtaatcataaaacgacccaatgaaaggtgcctttggtttcttattaactacaagcttaattcttctatttcttggagagcccgttttcgaaacggtcaattgaccagtcaaaggagtatggctagatgagaatttggtccctgtatccgcatccaaaactattggacttttatcgatggccggcgtgtctggctttgccaccacttctggaatgacttctcgttcaaagagtttaaccaatggcttttccacaggctttgggacttccgccttattgagattgaagcttctggtcgcttctggagaaaaatgatactggtcaggttcaggtaattcagaaagaacaaaaggaagttttgttcctggtcgtggagaatatatgtaccggtttctttccccagatagacgaacaataatacaaaaaggggtgtggacaacatatctgtcatagtaataatcagttctaccccaagctttgagcatcacgtctctcggattcacagatgccctgaataaaggcttcacctcctctgcgattggccttgaagtaccaaaatccagcttccactggtccaattcctgtgatttatctttgaacgttgtcgacctcctgctaccagaagtgaatctctgagcttctctacggtaatagagctccagattctttgcttgcacgtaaacaacaaagtgtactgattggagatgagccaggaaaagaacatatggatagaggagaactcttcccaaaggtgctaatctgatagccaatctctgatagaagttcctgaatggcgctattaaagagttaatcagatccattcttgacagcaaactaattcaattgaagaatgacagaaggatatgtgtattaaggacacaaaacgaaaatattattagtttgatacagacgtatcgcgtgcaacatgcccatgttgtgttcgtatagattcttgatatttgacatttagcattatttattcagttcaacgtagttgcctgggaagacaccttgcactccgttgagtcttccagtccaccagccattggcgtctgttttttgaacgacttcgataacttgtccagcagagaatgacaggtctcccgcggcttgcgcactatagtcgtacagagcagtacaagtctctacaccaggagcagtggtgggagcggttggagtagaaggaactgcagaagggatcggagaagcagcagaggcagcagtgactggtgcttgatagccttgaggctgtccataaccgactttctcgggaggatatggggaattagattgcccataagcaggagcctgcccataggccggcgcttgaccataagctggcgcttggccataggctggtgcttggccataagcgggagtagcggcagaaggttgaccataagcaggagcacctgcagcagtttgaccatactctggagtttgcccatactgaggaagctgctccgtacccgctgcagtggaaccagcagcagcaccagcaactccagctgcgccagcaggaccgccagcagcggcataacgcctttttgtagcctctaatttagcctttgcattaccaagcttgaaatgggtgattccaatagcgtctgcttgttcttggacgttaccccgcttgtatgtgaactgttcaatgatatctgcagagaggtcgaagtaaggtatcttcaactcctccatacgttggaacaaagtgtagaaaatattcaattgcatatagtagaatgaaacgaaaagaggtttgatgaattcagcttccaatttaaatagaacgggtaactcgttcttcatcatgtcattgtaatagtcatattcttgttgggcaatagccacgtcagcttctgccttgtacatcttctcctcatctttaacagttttttcttttttctcctgaatcttgtgcaagctattctgggcccgatccaagtctaactgcttgtggtttctcttcgttgccatttttctaatggacttgatgacatccaataactgttgagcaggcgctacgattctggtctctataagttccaagtctggcttcaaagttgtttgtaactcagcaactacttccctgtattgagtactagcctcgataccttcaggggacccttccaccaccaaggtgctagggtctgacacacgtcccgagattggtttgtaaatctcctcaatagctttactgaatccaatttgatggttcaacataccgttaactgcagtgaagtaacgtttgctctcgtcactcaacctcttggtctcgtcttccaactctttgaatcttcgttctgcatcaacatagaccggatcttcggtaatttgacccatgtttagcttttgacgaatagattgtggccctctgaccaatcctttcctgaaacctttgaaactcatatcggatagttcgcaattgaggaaggtggtggtgtatagtgttttcaaggtgctgttaacgattggatttcggtcacttgtctcttggacgccacgatcacgtggtacacatccctaggggacacgactataccaactggcacccacagtacatagaagttgatgaagtacatttggtacgcaaaaggctaacagggggctgtgtatcctgaaagattctgcctggtatctgatgtagttaacatggatcgacaagtttgtttatccgtaggcagaggaagttcaatcttttttggtatcgcttaccatgactacttcttttccaccgtctgtggtcatgagataaacatagtctctcaggggcttggtagtaaggcttcattctacccatatagtggacgctttctccgcaaactctcattagaatcgactcgtccacagtgtttctcaatcaatttacctgtaaactcttagtgtaactcctgaacgtccttccaatgccttcgaaatacggtcaatccctagcacgggccgattatgcatcatcgtctcaacagataggttgctgttccaaactcaactttaataaaatgtgacaaaaagtaaagcctcgttttatttttaaggttattacgatttctggctatctttagatcttcacctctcgacacccaaaattgatatggaagataatccttcagccaagaaatccttggctaactggtggaaatctttccagcggagcgcacagtcaaacaaggtgccacaggatgacgagagaccaagaataagattcagatccagatcgtctactgcaattaagaccaactcagattataaacaacacatcgatgactttttcacaaagcggaaggaacgggataattacttaaccaaaggtggcgttggcgataaccttgtctttaacgtaacattggaatcttcgttggagattacaagtgccaaagtggccctttgtacagacataaatacaagcgtgacatatggacgtatccccactctggtcgtttgttgtggcttatttctcaaacaacaggggttggataaaccaggaatcttcagaatgcctggtgccgcaagacgggtgagggaattacaggttcttttctcttctcccccgacctatggtgcaaagtttgattggaacggatatacagtacacgatgccgcttccatattgaggcggtatctgacctcactatcagagccacttattcctctggatttgtatgaggcctttagaagtcccattttgaatcgtccattgattgtgaaatatttcaagaagaaagagcaaaggagaatagaacgtgacaaaataatgaaacagaaggagggagacgagccaagggctactaggaatgcacaaaacaatcaggacaatgatgacgagactccggagaatatggacgctcctctgggaacggaagatgttgaagatcactttgtagatgcctcagaagagatagtacccgatggacaacaaaaacaaaaaagaaagaagcataaacagaaactaatcaaagagattcatggagccctagccgaatatgtggatcttttcagccaactttcattaccatcacgccagttaatctattatttggttgacctgctacagatggtctctactcactcgtctacaaacttgatgtcagtcagaaacttggcatccattttccaaccgtctttgctatttcacccgaagcacgatctagaaccagagcagtacatcctctcacaggcggtagtggagttttggattgagtacagtgaccgcatactacgtgcaagtacactgttggaaagtcagaccacaaaaaagcaaaaaccaccgccaatagccaggtcaagtttgcccccagtgacccaaccagaagcaaagcgcaattctctgtcgagtttcttgaacctgagctactctggaagaaggaaacacagtaagtccatgtcatccgctgtttctcctccagatgtcatatccaatttgaagcattcaaatctttcaggagcatccttggagcacacgacatctttttcctctgattatactcatcctggccaggctcctagtagcgtgtctgacaaccctccctccagtgtttctaacaacccacaatctgcttcactccaaaccaaacctcccaacataatgatatcatctgagtagatgaccaagacaccccctcccctcaatgtccttaggacaatgcttatgacaccactctgaaaccattgctgtacccttatgtaactaataattaaaaaaattcactctttttaccgaaaagggaaatatttttttcacagaaaaataaatgagaactgtatacacagcacaatggttaccgttcccgtaccaacctaatcttagttagccccttgcatttatacaccactgatccgcaaagcttctctacatatcgaaacagattggaaatggaaacgtccacttctcccccgaggaattcaatttccagttggtggtctaacttcaagcagcgtcactcctctaacgaatcacttagtatttacacgagcaacgagacgccatctaaacaaggaggaacgacaaatacatcaccaaagagacctcagatgagacccaaatctcggtccagtaattatataccttacaggctgtccttgcaccgcaactcaaaagaattggacctgagtgatgaggccaaactgaaacaacataggaactcatttttgaactcgagacagcaagattttttcgaagactcccaggtgtttgcggttccgttgaagcagagcttggaaatcgcaagtgctaagatcaactgtggatcaagtgattacggtttgatacccgttgtcattgctcaatgtggaatttatatcaagaaaaacggtttagatgttgaaggaatcttccgggtcgctggatcatcccgaagggtcaaagagttgcaatttgtgttttccaccgctccattgtacggtagaaaaatagactgggaatcttacggcaccacagttcacgatgctgcttctctgatgaggcggtacctgaactttcttcctgagcctttggtatccttagcgttgtatgagcaatttagagatccaattcgttctaggccgagaatcttgaactatcttaaaaataaatctgaaaagaaagataaggagaagtcgccagagcaggagggagagaaagatcaacaagacagagagcaaactggggtgcaagcgcaatcagaacaagaatcaaaacagcaagcaaaggacattgacgaacagaatgaggagtacaaagcaaaggaagctaagaaagctgcaaatgaaaagaaactgaaaaagagcattcttgctgcccttaaggaatacgctctactttttaattatcttcccaaggaatcccgacacttgatcctgtacatcttagatctattatctttgtgtacccaacatagagacaaaaatttgatgacggcgaagaacctcgctgccgtgtttcaaccgtctattttaacccatcctgatcacgacatgtcaccagaagaatatgcactttctcatgcagttttggaaatatggatagaattctcgtacattttgattgctagactcaatgactctccccaagagataataagacttactgatacgaaaggaacaaaacgcgacacgataccgtcagttacaacaagcactgattcgaccttcttggctccaccaccagggcaacatcgacgccaacatagtagatctttgtccagtgtcgttccagtcaacgatcgtatctaccagaataaacagaaaccccagcttttggatgatcaactacaagaaactactcccgagcctcagaacgataaagagagtgacgatgtataatacattattatgaataaaataatacctttaacgaggaatgaacacatgtccaagtctatatagtactcttctttcttttcgaatatgtttcttcctgctctatttccagaggtcgcttttctgcgggttcatctattagcagaatttcatcctcatcaaatatctcctccatttgatcgtcttggatagtgacttcttcttttgattcttttttcttcaaaggcttcttcttaattgtgatatccgtaagagttatatctgtttcttgaggtgcaacttccaggtatagttcaatgtcttgcagatcatcatcggaatcactaacgaagaatatactaccacttccaattgtaaggtccttcaatgaagaaatgaggttgtcctcaaaatcgtagtcataaattagcctattgtttcccaccacaatagaaacatcatctgaatagccaaacttcttcagaagttgtttgtgaatctcacccagttgtatatccaaactgggaaccgttatgatacccctctggatcccacaagctttgcaatttgaattgcctggcaatggtggacattgtgtaacaaacttgttgatgtactctgaatcataaatcagtctggagtttccaacaggatcatcagagaaaacattgagtgactgtagggaactgaaaccggcaaaaattgcattagtagttgccactgctggaataatgttaccagcaatttgtttaatctcaaattcggattttgtttcaattccaaatatgaatgatcgtaaattcgcagctgcgacgacaaaatccagggtgtctttatcatctttatcgaaatccaataccccttcagacttataacgagcttgcaatcttttcagagagtctattagtacaaacaagttttcttcagttgtccatatcttttgatcatctgaaatgatgctagtaggcaattctttgagttttttcgaatatagctcataatttaatggtattggcttctgtctggtcttccacaaagtgtcaatctttgctaatcgaacaatgtcttccacaaatattttctctactactgaatcaatgaactcttcagcagaatcttcctttatcagtttttttagttctagtagctcgttggtttctttcagcagagcctcaatctcttgtgcatcatcagtttccagatctgctgggtttatttcatcctcagattcttctccaaataactgtgtaaaaagaaagttttttgcccatgtaatacagtgaataggtttgcttggtgtggatctgatcgtacaaacggggaatgttttaggcgtttctttggcggtacattcaaaacactccgttaaatatgggaaaattggctgaacctgacctttcagcccagtagtaccactttcaatgagcggcttatttataaacaatgccatcctgttcacgtacacccttgcttcaaggttatccaaagcgttgaaaattatgtcaaattggcggaaccagctcaagggaaattgagaaacgtccataatatttccatggtgaggctctaaccgagtgtttcctttgaacaaagccacagctgctacagctgtgtttgctttgctcttctttatatctttttgtctaaacagaaactggcggttcaagttgctcagatcgattgtgtcaagatctgcaacatgaatctctccatagcccattagcagaagatctttaaggagttcacatcctattcctccggcaccaaccagtaaaaccttactgttacttattttattgtaagtttcctctccaaggattcgaataagctggatgtccctagccatcgttcgttcagtgaaagttttacttggaggagggaagttagatatccagcgcatcgcgggcgactaaaaggggtagaagagggaggatttcggagggcagctaggcggaggtggaaaattttcaaagggggcgaggtggaggcaatatctgaataatctttccccagatcgctaacacgtcccacattctcaaaactgcgaatttcagccaaagattacttcggcaagccagttagcatcaactccgatcgcggacatcaaattgtctggtcggagccgaacttaacgctatgggttctctaatatcgcgcccggttgcaacgaacaccgctccttccaagaaaaaaaaggtcgacctgcactttctatccgtcccttttacccagtcactaaaagctttcagattattccaccatgttcagacaatattctagagcaatccgttcaactccgttcaccagatcttacgctactaacgttgcacagttcctcggacagaagaacagcaatggaaaatacaccgtgtctttcatagagggtgacggtattggtgttgagatcagtgatgccgtcaagcaaatctactccgcagctgacgtcccaattgagtgggaatcatgcgatgtcactcctctgttcatcaacggaaagaccactctgccacagcaggccgtagactctatcaacaagaacttggtggctctgaaaggtcctctcgcaacccctgttggaaaaggtcaccaatctctgaatctaacacttagaagaactttcaatttgtttgccaatgtcagaccttgtaagtccatccaaggttacaagaccccttacgagaatgtcgatacagttttgatccgtgagaacactgaaggtgaatactccggtatcgagcacactattgttccaggtgttgtccaaagtatcaagctgatcaccaaggttgcatctgagagatgtatcagatatgccttcgagtacgctcgttctgttggaagaaaagaagttttggtcgtccataaggcctccattatgaagctttccgatggtcttttcgttaagactgctgaagaactggcttctgagtacccagagatcaagctgtccttcgagttgttggataacacttctctgaagttatgtactgatccatctgactacaagagtttagtgatggtcatgcctaacttgtacggtgacatcatgtctgacttgtcctccggtttaatcggtggtctaggtttgaccccttctggaaacatgggtgataaggtttccattttcgaggccgtccacggttcagctcctgacattgctggtaagaacttggccaacccaactgctctgctgttatcctcatgcatgatgttgagacacatgtctttgaacagctatgccgacaagatcgaaaactctgtcttgaagaccattgcttctggaccagagcacagaactaaggacttgaaaggaacctcctcgacttcaaacttcaccgaacaagttatcaagaacttgtaatagtgaacggttatgaaaatgaatgcttcatgacttgaggctcctttcgttagaaatatagatagatgtagcagtcttttgaaacggttgaaaaatgtattaacgatctttactagtaattatggtttgcagttcgcacgttttttttttcagcctttatcatcgatcacactaggaaaaaaaaatcaagctagtctagtaacgatgacgcctaagatattagtactcatttctggtaatggaagcaacctccaggctctcattaatgccaaggagcaaggccagctgaaagcagaaatatctttggtcatatcctcaagtagtaaggcatttggcatcgaaagagccaggaaacacaacattccagtccgagtgcatgagctgaagtcatactaccagggaattcccaaagaggagaaagccaaacgagccgaaaagagaaacgattttgatcaagacctggtcaagatcatattgagcgagaagcctgatcttgttgtttgtgccggctggatgcttatactaggtgaaaaattcttacaacctttacaagagaagaacatctccatcataaacttgcatccatccttgcctggagcctttgagggaattaatgcaatcgaaagatcttataatgccggtcagaatggcgaaattactaagggtggtatcatgatccatcgggttattctggaggttgatagaggacaacctctcatagtgagagaaatagatgttatcaaaggagagacgctagagtcgtgggaggcaagaatccattctttagaacaccaagcaatagtggatggaactaacaaggcattggacgagttgaaataagggtcacatataagccaattaatttcttcaatttcttttatccgttaacagtatgttgtatatctttatgcttcagtatctacctccattggaaccacagtttcctcaatatcgacaagattgtagatactctctttcaacaccgcagtagtgcctctagcaaacttgtatgacttaaccttggcttcacggacgttaggcttcagatagtttctgtacaattgggcatcttttccaacttccatgacacaaaggtccacgttagaaccggatcccaaatcattccagatacctgcctcaatagcttctgtgcacagcttcattgcctcttccttagtcaagccttctttccagttgctctccaagacagccatggccgccagcgaacctgatcccaaagattgatagaatccaatatcggtggatccatgcgcatggatagaaaacaagtgggctcctgtaggatcaacaccaccgacgattagataggctccaatgtgaccttggtacttgaacagatgttgtttcagcatcgtcaatgctgtgaccactcgaggtttcctttctgtagacatggcatgcaattctagatttgatccaatcagttgtgtaaccatctctgtatcagcagcggtacctgctcctgcacaccatatagtaggtgacaacctgtgtagcttttcacaattcttgtcagccacgataggacctgacgtagctctggtatcggcagcgatcacaacacctccttcaaatttaactcccacaatggtggttcctgtggaagttgccttcggagagccaaatcccttagctgaaaggaattgatttctttggtggttatcgaaactgaggcctgccatattcgtgtgatggtatggtgaacgagtttgtcaagtgggttgaatttgccttcaggatattacgattcgagaagtacattctatcgatgtcggatgtgagatacatacattaaaactcatacgtcaaaggtatgcaactacggctctcaagaaccttttatatacaggacgttagttgaccaccttgtcacatctatggcacagttcgtgatctggcctaacttcgtatttccaacatctgggacatttatgcagagagctttgaacaacatgtacatcgatggttccacaatctagtcgaatcttatcttcataatggtaagaaacagagaaatcaggaagttcttggttgataaaaacctgggaagtcaagaagtaatcggataggtagctttgatgcttttgtaaaagatcccacacaggggtcccttcttcacaattcaaatagacggctgtttctaaagtgttcctaatagatttatcaactctggatccctggtccattaaaagcttgatcgtgctgttaagctcaaatagttgagaaaactccaactctaaatctgctctgcggtatgattgtggtagttcgtgccagccttttgagaatggcgacttcgtatcgttagtaacatagcgtggagcatggttccatgcttcctgggcaatgattggagtaattggactcaagatggaaatgtaagattgtaagattgcaaccaaaacagtttgaactgaccttcgagatgcggaatccggggcatctgcataaaccctatccttgacaaggtcaaaataaacagatgacagttccacattcatatgatgattaaggttcctcacgactttggaaaagttgaactcagagtaactctccttacagatttgctgtaagctgtaaagtttgctcaatgcatactgatccagcaattgtagatcttggtagggaacagatttgtccatagagaagccctccaaattacctagaataaactttatagtaaatctaatcttcttcaggttttctgcaacatgtttcaaaattgttggtccaatagctacatctgtgaaataatcagattgagcaacccacaatcgtatcccatcaacacccagagcgggtatattcttgcttttgacgccgttgattacatcttgaggtttcagtgtattgcctaaagatttggacattttgtttcctttctcatcaagtgtgaatccgtgagtaataattttcctgtacggactgatggtcttttccttgtctttgcaaatagccattttggtcaacagagaactttgaaaccaccctctatgttgatcagatccttctaagtagacgtctgcaaggtagtttctggaattgatatcctgcccattgtgcttcaaaaaatcctctatcaaatgccaactagttccactatcaaaccaaacatccatagtatcatttcctctaacatacttttctgaatctgccttcatagattctggtaagaaattactcatgtcacagtttttgtcaaaccaagagtcgacgcctgctccctcaatatacttagttatagcaccaatcacttcatcattcaatatttcctttcccgtatccttctcataaataacaggaataggaactccccagcttctttgtcttgagatacaccattcctgtcttctttgaataaaagtctctagtctcttaaatcctttgtctggatagaatttaacatcttgcaatgttttgagggtcctctccttgatttgatcaatgttgatgaaccattggggagtagatctaataattatcggtttctttgacctccaatcatatggatacgaatggatgtaattcttttggatggaaaagatcgcaccaagattagtcagtttttcaaccacttttggggctccttccttgaggacatgaagcccgatcaaatccttacaactttctggtacatctggagtatatcttccaaaagagtcaacaggagaatagggtgcaatatcgttcttcaaacatacccaataatcatcatttccatgtccaggtgctgtatggactaaacctgttccggcaacgttagtaacatggtctccatccaaaatcggctgctttacgcccccggttaacgaattgatataggttgtttttagtaattgggcgccagataaatgtattttagtgtcctcaataccttccttcgaactcattacttgggaagctaaatctagggcgacaatgaggtactcagattgatgttttaatatagtgtaatccagcttggaattgacggagacggctttgttggcgacaattgtccaaggtgtagttgtccagattaatagattgactttattacccaaacttgacagctccttcaaatctgtagtgtcgacaggaaacttcaagtagatagcagtactgttatgactgtcgttatactccaattcaccttctgccaatgctgtagcattctcacaactccaatacactggtttttcctgtcgtctaattagtccattgtccatcatttgtttgaaaatgtacaattgattgatgacatacgatgggtccagagtcttgtaagggtttttgaaatctcccattacacctagttcttgaaaacttttcgattgagcctcagacgtggctagagcaaagcttcgtgccaacgtgcgtatatctgatggtgttaatttagaccgtttgacttgtttaatttcatgttcaatattgtctctctcctcctcattggttgttttcttcaattgcgatttcagtatcttaactctggtattttgttcttttctcaaagcttctaacgctttaagttcaatgggcagtccatgacaatcccatccaggtttatagaagaccctcttaccatcgatgaggttaaatctattgataatatccttcagaactttattcaatgcatggcctatatgtaactcgccgttggcatatggaggtccatcatgcagaataaacagttcccgatcagtgttgtttaagttgccataatacacgtcatcagtacattgtgggagtaactttgatgatattaactccgatgacgatctgttagggaaagaagtttttggcagccgtagagtagaggaatatttgtgggaaacgtctgagccggaatcagatgacacagagtagcatctggataggcagctactaaaatatcttcttccttcaacagtgaagagcgctcttcgtcttaacattcccacagtttacctgctaaatcatccaatttctaggtttcgtggtattgcatcttgatgtgattatataatcaattgttcacctcctctatacagctacataatactttcctactagggattattcatcatctggctatgactttcagaggttctgtttcaagatattgattgtcatcattgtctaagattacaccccattcgtaaaagcctttttccacaaaaatggcacccattgtgaaagatcttgatgctcctgttgaaattggatcagttatggcatactgaagtgtcccattaaatagcaccttttggtcaatagacttcttggtctgcatgcaatatggaacatggcgtaggatacctttcaaagcagaagatgaattgttgtgaatgttcactactacattgtaacattcatggacattgacaggtcgaacaagatcaccctctatctctttggagtcttgaaaaagattgatatcaatgtccacttcaccaaccgatagagtgttgaccattttggttgaaagtcgaagccctcgggtatctacggacccgattctagtttctggttcatttttccatcgtccttgaatcatttgaaggagattatatctataccagaagagttgaagcatattctttctctcaccgggggatattttgtccacaataaactgcttctccctaaaatttgggattggttcagcgagtttctctgctgatatcttaaatcgcttgaggggtagtagtagttttctggtcttgaacgaaggaatggtctccttaattgagaagttacaatcaacgtcagtggctaaagagaattcaactttcaagggttcattccacgagtttcgcagatctaaagacaaaatgcaatagtcagatattttcttcccttctgatacaattcttgataagaacttcgacagatatccagtctgttcatttaataatcctgactgtgaactgcccagtaaaggatagaaatcataggcatccaattcgatactcggaaacactgttacatttatgggaatgtccaagtttcttagcatattagctccttttttatgacaatactgcaggttgatgttagctgacttcattcctcttttaccaagtatccccacttgaagacgaactgatttattgctttcaatttcacccaatacctcttcattgaggatcttgagtgccttcttttcgaataaatggtactcaatttcataaatctcgttgactggtaattttctgttagaaagaatctgtagcaagggctcataagtggagtcagtaatgacatactggaggtatccaattggtattgaagaataatttttcaaattagcctcaaactgtgtttcttccccttctagtaacatcaatgagctattgtgcaatgaaacagaggtaagagacaacacaggctggggatgcataacgtcaaatataagcgacctagtagagttagctgctgcatggttctcagtaccttgaacaactttaaactttgtttgcttgcaactgcaaacattcgcctggaatccatcaatctctaatgtccctatgtcaagaggaataaatataactaacacatttaagctagctttaggttttagtgtgattgcagtaaagtgactattttcctcattcttcaagaaatcaaccttgagaatcttcaacttgatatctcgagtcacagttgttagctcaatgtttgcaatgtccagttcaaaggcataagggttgtagagagttagggagacctggctgatttcatctttcatgataataaatctttgaggagagtttgatttttctttcaagtatgggttgtatacaaaggattcaccttgaacaaccaaggttttgtcttttgaaggagaaatcttgtagttgttcccattatcagggtaaccaagattttgaagcaaatggtcattgaagaattcctgatcctcggaagtattagacaaatgtgttttgaatatatgctcttgctctttagtggagagtgcttcgtgaaatctgttcaatagaaggtagctgacacgagacagtaattggcgatcatccagtttagtggaaaacgataagataaccaatagaatgcttttctggagcagtaaccagcttgatgactgttcaatgttatagactgtcaaaagatactcaaatagttctctatattttgacaatgtgtcgacaggaacgtctaatttaccaagagaagggtgaattgtgtttagcagtagctttaaataaaacgccttcttcctgtggtactgcagatctccgtaaatggacactaaacttgaataaattagacatttttggactagagtgagcttttcaaattctacatctgacaattcctgcaaattggcgacgatcgatagtctgtcaaaagtgctaattgaatccaggctttccgatacgattggctggaaattttctattggggcctttttcccgtttactaagaacgggaaagtatttttgtccatttttccgttcaaatgaaccatggtgcatagcttggtatatctcaaaacagtttcacagtagactatttgcggaacataatcgtcggcggaaggtatggacagcttgtagtaactgatcactttatcatgaacactggttaacaattctaatattctctcttgcccgaactctttatttgaattggctgtgttggttgtagtatttgcgttgatgttagtcattgattgcaatgaagatctgggtgatgctgagggggaggatacaaggttaagcagtaagctatccttggtaattgtattcaaaattgaaagaacatgattgggaagtgtgaaggagcttccgatcatggataacaacaaacaacacactcccattccttccaacgaagaggctagccataaataatcgttgcagcttttcaaaccataaatagactcacaaaactccttcaaagaatcattcagcctgcctgaaagtaaatatagatttcccaaaagtttctgttgtctggcttttacccttaacttgcgatcaaatccctggtcaaaactgacactaaatcgcttcttctgcttctcaattatattagtgacaacagcagaggaggtaattctggtaatgttaccactagcaatcgatccaggagaacgtaaagtgacatgtttataagatgcagcataattagaaagggattgcaggaaattggaactgatatcacacatgatcgtctccaaagatctaaacttttggaaaaaaacattctccaagttgttcaattgctcatcctcttttgcctcatcaccaaacaccacgaggttatgggtaatgacgtctgggttctgtactttcagcagtctcaaagagtcctccagtgcctgatcctttatgtatttttcatccgtgactccgacaagaataaagacttttctgaatggttccagatcgtaaaggaaaagactgtcgggatcacaccggcaagtcgtataattgaaaagaattcttccataaggaaatccctgtgggttgaaagtacctctatctggagtgacatctaatagtctgatctcaaagatctctttcagcaactttgtgtatttctcaaaagttgacagacttattcccaaagggaccagccgtatattgactcgagcagggacaatatacgaattggggtccgtcattggggttcgatcttgagaggctgtgtgataattgcaacgacccttgacatttcttcccgatctctggagtcgcgcgagagatgaggtttcaacaacgttgcaggaaaccgtggacgaagcgcaatacacagccaacatcatgataactatatacaacgacaaccacatacaatggtcaaaactctacaagatccctcacaggcattcacatctgataacaacaatacactgaattaagtacgtaaatagacatacgaacgacacaaataagttaatgaaacattaagcttacaacttgtcgtagtactcttcataaccaggaacgttctccttcataccctgtctctttctggcagcaagaacaatctcaccgaccttggaggctgggtccaatgggttaccattcatgttggcccagtggtcgaacaccatctgtgggaaagcttgaccagcggtagcttgtctcagttcaccggtgaaaccgaatgactcgttaactggcaagtaagctttgacagtgaacaatggggtacctggtctttgttcctcagagataacttgacctctcttcttgttcaaaacagagtagataccaccaatggcattctctggacattggatctccaccaagaagataggctcctggatagctggctcagccaacaggaaggcggcgtaggtaactctcttcatggttggaatgacttgtcctccacctctgtggatagcatcggcgtgcagggtaacatccaagatgttgactctgacggatctcatgttttctcccaaaattggaccttccttggtagccaattggaaaccggcaacaacagagtccttgatctcgtgcaagtattggacagccttagactggtcaacaactaagttggcaccagtaccgtctggaccgaaacaccagatctttctggcatcagtgacgtcccaaccgtattcatcagccatgattctggctctggctttaaagtcgtctcttgggtgaaccttaccttcttcgatagccaaagacaattcctcgtcaattggttgagccttcaggtaaattctgttatgcttgttctgagacttggacagggcagtcatggaagattcgttagtgacagtctcacggtaggtaacaactggaggagaaatcttcagagggacaccagcgtggtcgtcttgcagatcttgcaaacagatttccaagtgcagctcaccagtaccagcaacaatgtgctcaccagactcggagatgtaggttaaaacacatgggtcagacttggacaaacgcttcagaccctcaaccaacttgggcagatcattagcgttcttgacctcaacggcaacttgcacaactggagagacagagaatttcatcaccttcatgttgtgagcggcttcgttggtagtaagagtaccagacttcagcaagaactggtcgatacccacaatacccagaatgttaccagctgggacatcgtcaataggctcgacggttcttcccatcatcaaaacagttctttgaacagccttgatgaacaagtcctccttcttacctggaacgtagttaggaccttggattctgaccttttgaccggacttaacagtaccggagaaaacacgaccgaaggcgtagaatctacctttgtcggaggttggcaccatcttggaaatgtaaaccatcagctcagccttagggtcacactctctgataccaatgcagaattggtcatcagatggaccttcgtacaaagtctcggctctgtaagcttgagcggtgactggagatggcaggtgaagaacaatcatctccaacaaagcgtcggcagctggcaagaactttctcatgacaaccttcaaaagagccttaccctccaactccttctcctcacgcttcaggttgatctccaatttctccaacagaactggaatttcatccttcttgaagttcatgatggcagcaaacagacggaagatagggtccaaaacgaacatgttgaaggcacgctccaaaggctttccagcggcgtccttgtccttgttggtccatttcttggtctttgggttgaagtaagagtctccccacagacgctccatcatcttgattctgtcaacaccgaacttcttggagtatctagtggcgaactgtctaacggtgaaagcccatccgtgcagacctgaaccgaaagcgacggtaccctgttctgggtagacttggttgtcaccaatggtcttgtcagtgtaagtagcgataacgacgtttacggactcgacggttctagcgaaagactggtacaggtcctccttggtaacttgcaactccaaaagagcacggtcgaccttgttaatgacaacaactggcttgattctttcacccaaagcttgacgcaaaacggtctcagtttgaacacagacaccttcaacacagtcaacgacgaccaaagcaccgtcagtaacacgcagagcagcagtgacctcagaagagaagtcaacgtgacctggggagtcaattaagttgataaggaaactgttaccttcagtcttctgcttgatctccttgacatcgtcgtcacccatctcagagtacaaagaaatggcggtagacttgatggtgatacctctctcttgctcgtcctttctagtatcagtgaaacgggcctcaccagccttggcagcagaaataataccggcacgttgcaccagggagtcagttaaagtggacttaccgtgatcaacgtgggcaataaccgacatgttacggacgttggtcaccttgtccataagggatcgcatctgatcgacagtgaagttaactagaggagatgttagtggctggctcccatcttgaaacggtagttgttcggcacatgaactataaaaaaacacatacccattttgaattatctatgcgttctttctacgaggaacaaaattaagaacttcaaagttacttctagcaagaaggaaggaaaattttttatttggaatattagggtatgtgtgtgagtgggcaggaacaatactttcgcggatcaatattaaagttttcaggtacacgaccagtcattagctggcagggtaatgttattttgctcgccggacgactagtgcgaaaggttagaggggttgggaagagaatggaccgactaacgttgataacgtaagcgtaaccgtggtggatgatttattagaattaaaaattatatcgtttcaggttttttaagtgtgatcatcgttcacatacgtgaaccctctgaattgctcttgcatggagagcgacaagaccgagttgaccggtgttagtttgggcgcctcagtggtaaactctacgtcaaagtttgaaacatcatgacgatcctttattgttggaatcaacggaggaggtaccttgcattgcattatgtcatcccagttgataccgtggaaatatggatgtctctttatctcttcagcatcttcttcgctggcacctaatctcttgtaaggatcttttgtaagtagctgctgcaatatgtcaacggactccctgtccatttggataggatatcttggttcgtcggtaagaatggagttgaacacctcatcttcgtcttcacctttgaaaggagatttaccaagcatcatctggtataagaggaccccgaatgcccaccaatctactgccttgtcgtatttctgctctttcaaaatttcaggagccataaactcaggtgtaccgcagaaggtggccgttgtagatccgtaccacatttcctctttacaaagtccatagtctgccaacttgatatgcccgtcagcggtcagaagaatgttgtcgagctttaaatctctgtagacgactccgttctcgtgaaagtattgtaatgctaacaacacttctgctgcatagaactttgctctagatggagaaaatgttctttgttgggcatgccacattaaatcacccccactgacatactccatcacaaagtaaatacggttctctgtttggaaacattgatgaagatttaacaagaatgggtgcttgcctctgttagcaatgatgaaaacccgcttctcagactttgtgctggcaacttcgtcattcttgataataaagtccttctttaataccttgatagcacacaattgcccagtatgaatagactctgccagcataactttaccaaagttacctttaccgagcactgcgataaatctaaaatcatccaagccatacttttgacgatgtctaccatggtgtcgttctgaacttcgcctagcagcttcttgctttttgacggcgaccttggttggtgatacatctgatgcaactgctgttttgactgttttgacttgctgctgtggttgctgttgagggtggtaatgatgatgctggtggtgatggtcagtttccttggaagatgaagtgcttgaaatctgtttctccaaggcatacccagcttctgcaattgcttgattaggagtccgctcgggctccacttgtggttcctccctttgaggtaacacacgctgttcgttggaaacaggagggggaggtggtggtggacgcctaatcggtttggttttaggcgcttcatcagattgagacaaacgttgagctgcacttggcactggaggcaactgcttttgactgatatgtgtatcagactttccactagatttagacgacatggacatagcttgtctctgttgtcttgtagctgttgtctccttgatagtcgacaaaatcttactggccatctccatactcataccgcaaaagtctggaaccagatgggtgcattgggcgtgacagaccaccccacattcagaacatttgtaaacattctttctagaccaaggcaaaatgtacccacaatgacaacaccatttagtaccatgatttgagaacggttcaaacttgtgaggtattctatgattgagtttagtttcctctggatcaacatctatactcgactttgaaatacatttggtaattactttctggtaacattttttgtgacaaaggaatcgacagtcttcacattggtacccagaatatgggaggaaatcaccacacatagcacacatcatgatgttgtagaactgtctaggaacaaacttatgaccatgctgttcaagcacttcttcttttcgctgacgaatagctccatgacgacccaaaccacccatgaattctttcttttgtccagcatcattagttttattaaagcccatagtaagcagaatctgcccggcaggtgctagtacgaaccaagcggatgcggatagttgagctggatcagtatcaccattggagtgggaagtatgggtctgcaaagattgcaaattgccctgttggttatcgaaaggatgggaacccaattgctgcggctgttgctgttctggtctccctgccaggtttgaagcactcatccaaccagtggcattcaattctctatcaacttttttctttcttatttcttcaacaatatcggataacagaaaccaaatcattgctaccggggtaagggtatcaccgactttgtcatagactatcagtgacaattcgtttcctttctccacgtgaatctgaaaagaatcattcactctttgattcttggtaggtttagttctagccttctcaacgtcatcaattcggatagaaaccaacgtttctaatttcttggaaaagatggaactgacatgtagaatatcccgaatactgttgatagtgatggatagtgttcctgataacggcttctttctgaaagtgttcatgacttctgtgtcacgagcaacttcgtcaatattgacgtgaacatcgtggtaattcttcaaagccatcttcatcaaatggattttcatgtcactttcgaccttcccaccttcggcggcagcaatgctgcgcctgtcaccatcaacttgataaaggcgactaatcttttcattggcctctcggtactgtttttcgacctgtagcttaaactctaaaagctgcagcatatagtggattctgtggcccaatgagggacaatcgtacttcaacagatccaaaaaagtgaacgttggtggactagtcttaagaaccttctgctgagtcaattcgccctgattggagccccttgctgccctattatgctgctctagttgtagtttactcaaagtttgctccagatactcgatgttctgctgggcttcccgtatacttgtgttacaattctgtatgatctctgcattgtttgtctttttcctgatgttactggctccctgagcaatgttcctttctctctcaatctttttcaagatatccttgattacttcatcattgcttgtgtctgacatttagccgtccaagaaacacttacagtttcaaaaatgttgttgtaggacgtagcaaaaacgatcttgatccagaggttgacagatcatgagatggtaaaggagcgagcacaacaaaatacttcggtacacgacttttttagaattgtggatgcgtatttctaggcattcaaaggttgagttggtctggggaacctttctttttctagtcagagatgtgtaattgtttttttttttttttcttttatggttacgtggtatacgtctatgtaacaactaaacagtgtctaacgttggagttcgtcttctccatctgcgctcgtgtttctttttttcttttctccattttttctgttcttctgtttccacctcgtgacaaaacctttcaagatcgcatgctaaccccagatctctcggtatacaacctcggagcaatgttcatagccatcagttcctggaataaaagctttgcagcatatggaatgtgtaattggtagatgttcgtcttgttcttacatgatcgacactcaaactggtttttctttaggttggcaatcactgacatcaaaccacaaattccacacacatgtactcggaaagcatcagatgcttccattaatctttccttcaagaaaccagcggcaccgtgagcaatcatacagtctctttccatctctccgaaacgaagaccaccatcacgggatctaccttctacaggttgtctggtcaagacttgtacaggtcctctggctctggcatgaatcttatcatccaccatatgtctcagtctctggtaatatgttggtccaaagaatacctgggccattaattttttaccagtgtgtccattgtacattacttcaaatcctctagattgatacccattatccctcagaaggttggaaaccgcatccactgttaaatctgtaaatggtgtagcgtcaccttcataacctctaatagaaccaaccttactcagcaaacactcaattaagtgcgcaaccgtcatacgagaaggaatagcatgtgggttaataatcaaatcgggaacgataccctctgcactgaatggcatatcttcgtgcctataagtaacaccaatggtacccttctgaccgtgacgggaggcaaacttatcaccaatttgtggaacctttgtggttctcattctaactttcacaaactttagaccttcttggttggttgtaagtaaaacttggtcaacgataccattctcggtacttctcagcggagtagaggcgtcacgcttggtgtggtacttcgtcctctgaccaagttcttccgtgtcaggtggaataggcgtggtctttccaataatgatatcatcacctgacactcttacacctggggcaatcaaaccatcttcatccagtttctcataggtaccgtgtttgagtcttagagttgttgccctcgttggtttctcaaactcctcgacaatagaaataccaaatctcttttcttgatccatataggatctaaaaaacaaagatctgaataatcctctgtcaattgaggattgattcataatcatggaatcttcctggttatatccagaataacaagcaatagccacaatcgcattttgtccggccggtagctccctgaattttaggtattccatggcctgagtttttgcaagaggtttttgagggtagtacagaatattagccatcgtatccatacgaacattatagttcgttaagaatacacccatagcttgcttacccatcgcagattgatatgtgttacgtggagattgattatgatcggggaatggaatgatagaagcggccacacctaagatcatcgaaggatgaatttcacagtgggtgaatgtatgatgactactggtactcatctcaggtttgattctctttgccgtatcgttaagatcgatttctttttgttccaatgaacgggtctgcaaatcttctggagtcattgcaatcatgatggtttcttcttcctcaccatcaacatactcgatgacacccgatgtgaccagagaactccatccgtaaacatcctgttcctgctcttcactgtcatcattcattgcatcgtcgtcatatccttgttgaatttttcggatatgttctttggtaattctcagttcacctttgttgtctttagactcatcatcttcaactataaataagggtctgtaaactctaccaacatcagtaaaaattttgaactctctttctctaatatctctaataattgacacctcaggagaaatagcaccacttctacgcaaatctctcattgttgaaaccaacatggatgggtctctgtgaatacctgtccagacaccgttaacaaagattcttgtagatttggtatgttgggcgggatcatagtcttctaatggctccataccccattcttctaaaaagttgataataggctcagatggagaaccaatggaaataccagataacaaagataggttcttgaccaaaccacaggcttgtccttctggtgtctcagcaggacataccaaaccccaatgtgtgttgtgcagttgacgaggctttgccaatttaccatctctgccgataggtgtattggttcttcgcaaatgggacagagtagaagagtaagtataacgattcaaaacttgagagacaccagctctcgagctcatagctttcttttgttctccccaattacctgtagccaacgagtacttaagaccggaggtaatagtagttgatttgacagccaagttcaagttgaagtctcggtctgtttcgatacatctttgcatgtaccggtatatctctctcgtaagttttctaaaaagaattctgaataaattggccaacaaggggccagctaagtccaatctctttttcccgaagtggtcacgatcgtcctggtcctttctttctaaggcacacagaagaagtctgttgaccatataacctaagaaaaatgtttttctggtttcaaatccctcttcctgggtgatatgaggaagaagttctttttgaagaatgtctttagcatactgaatacgtttttcccttctgatacccaaggcagcactacctcttcttccaataaagtccaatgcaacttctttgtcttgaatcacgaaaccttcctcgatacatggtttcagcatttccaacatttgccaatcattctcatcataacaaatgtgttgtaatatttcaccatcaggaaccacacccagagctctgaacacaataacaatgggtatatcttgtttaacgtaaggcaatgtagctttgatggttcttcctgttcctttatcttctctaccatataatttaatttgcatggtactaataagtctagaacctttctctaaagccgatctaatctctgcaacgtgagatattggtgaaggagctgctttcttgaatacttgaacgatgttagcggcactacgttcctgagcaataagcactttttcagaaccgttgatgacaaaataacctcccatatcataaggacattctttcattttgtagaggtcaacctcgtccaaagtcctaagtgagcagaatttggaacgcaacattataggaaccttaccaatatgcactttgttaccttcttcgacaccatcttttataggttcatgaacttgttgccagtccagggtagcgtttgggttaccttcgtcgtcgatactggtgaacatagacttctccatgtccaaatagacaggtgatgaataggtcaagttacgcagccttgcttcttgaggaaacatggcatgggttgtaccatcagcctctgtcatggtaggtctggacagataaattttcccaaaacgaatttcatatctcttgtttatattgtctttttcattggtgtgttgagcaggctgatccaaaatcaagcggggttcttcccagaccaaatcttgaatggaagtttccatgaactcgtcgaacgagtctaactgttggctgaccaaacctttctcctcgaagaaagcggagatcacggtccagcaatcctcggttgtgattgtatcatcaatggaatatggatcgtaagacattatctctgatcgattctgttgtgttcaaactataatacagatggcaaaaaagagcgctgttgaaaatgtgaaacgaacaagtaaacaactgaatcaaataaaacgagaatctagagatctacactgatatcaatctggttcaaacactggataagaatggaagataacctgggttgattgatgtgatattcagtggctctgactgatattccaatgagtggtactctgaataatgttatgttaataaagtgacgactgggtttttttcaactaattgggtggtacacgagtaataggattggaaggagattggaagaaagtctgaatggatcacacgattgggcagagatatgcgtctagaaaggacaagattgacaactagtagaagaaaggcatctactgtttgattggtgccaagcaacaaatatcaagactagggagactagtacaattgattcttaaaaagtctaacaacactacatctttacaccaccatgccatgaaaagtttcaacattttcctactcgaaggttcacctcacaacgaatccaacttcaaatgagcgccccaagaggtttagccactgtatctcctttgagtaggaaatggtatgatctcagtcagaaagctattgagcaagggaaaccacatttcagattaggccaaaaaaaaatctatttcccttcagccagagtcattctccttagaccaaatgccaaacacacaccataccaggccaaatttgtagtgcccaagtccttcaacaaattggatctaagagattacctgtatcatatctatggtttgagagcattcaatataacaactcaattactgcatggaaagtttaccaggtcgttacctatgccctttagggctcgtcgtcgttcaccacaaattaagaagatgaccatcgatatgcaggaccctttcgtttggccagagcctcagaattcatacctacaagatgagcttgatctgagcgaagaaagtaagcaatatttccaagataggaccagtcctggtgccgacaagaacaagaggtctcttgcgtttggaggaatcattgatccagaacctgcagcggagaattttgtgcccaaaaaactcagtagacagatgaaaaacaagaagcagaaggctttggaacaggaaaaaagacagagccaagaggaactgattagacagtacatcagtttgtaacgaagcagaaaaagaacataaaattggaggagacgtcttacaccattagaagtctatggattcaattgtatatagtgattgttccccgcaacccatcagcttattacagcataacacctgagcactggctataatagtattattatgtgtttatattttccagttgtgtagtttgttgtttataactaaagatacaaatcaattgaactgtggtattactctgacttggttttccagaaccaattgtcttgtttaggagaattattatttggtgagttttctccctccaactcgtctctattcacaatatcaaattctgctacggatgagacagtagaggaggcagtggacgtcttctcaccatcaatcaaagataagggatatttgagtaaagattctgataacattgccagcttcccgaattccagcaggggagagaatttggacgcttggtttgcctgtttctccgggacagcagcagcaggactaggtgcaccgggagtatatctctgagctaatctgaccagcagagactgcagctggttccaaatattatcagagttcaagtctaagttttgtaggccagattcaagcatggggtcaaggtagaggaaccaaagcagtagagcgccgttaactctcttatcgccgccattcaccatatgattctgtaacaagctggataaaacttcattctctttgagagtgttgtatttggaaacatcaattagtggcaggaccaaccagcagtggaagtagaggttgaccacggagaaaaaaggaacgtatccaaaaataagttggaacggtccacatgaagtgatgtatagattgattgagtagataatccaataaataagccaattcactgtgctctccttgctgctggtcacaatggattgatacgacttgactaaggggaagcctaccgagattacccaccctataaggcctagtagtaaccccaacatttcgtgataagcgggaaagttctgaaggagaagacgaggtgagcaaggtgtcagatatcacgtgcaggagggcaggagagtgacgttgtggagtggaggaagagcagcgcgcgcaagtgaataggcgcgggtgtaagaaaggtaatcttggttaaggtcttatactcagcgggctacgactatcggtcttgttaggctctagttaatgtttctgcactgtaatgatttctgttgagccactacagtcagtataaacacctctgaagcggtaagagcggggattgctagttttgccctgatgtacgtatatgtgtggggttgatttcagccagcccgagacaagacgcacatccggagaagacttctcggcatggggtccatcattcctgttaaaacatgggaccaggatgagcggaaatactgctggatcataatttttcccgagcttcatcttcgctaacggttctgttgacccgcggaggtagagcgatcagattatgtagataatcaacgggtgatcctctcagggatctccagaccgttttgtgaggcacccgattgcttatctcaattgcattagattgagatccgttgcaagatacgccagttgctgattccttgaaatcttcccgaaacccttgatcgggtgctttctagtgagcacttggcttcaagcaagttcctttcggcgcgttaccggattaggaagtaatctcaggtgcggcaaggcagtaagtacccaggaggtgaagtggaattcgagattggaaaaaaagaaagaaaaaaagctacccctaaacggtagatttcactgaaaaaaaccgttgcactacttgacagacaggtgcgtctcaccacaatagcttagcctggcctacaacaacaaaagcctttcttccacgatcttccctactgctctggcagttacaagaaaatttaccgttacgttgcagatcatcaggatcgtatttttgtggttgtacgggtctttgccccctccacttgcctagatcacttgataaaaacaagctatatgcaaaaaccgcaccgggtctgaaaaccctcttatcttagcggcttcttcccgctgggtgcacttctcaccaaaaacagaaaaaaaaaacgccagatgattcaatagcccagataccccattattcttatcacaatcactttagcgtccgctggttttctttataaataacaaaccatcgcttgagtttgacttcctctccacaggcactgaaacgtattaaatgccttttcagaacataaagaacaagatgtttgataagaagactagtactacagtatcagtgcatgaagaagaagctctagaaagcggaaactcctctattaacaacagtggtgtccagcaactctcttacgatggaaccgattataagccaagtgaagctccggaagtggacgaggatgatatcaacaatgttcatcgtggtatgaaatcaagacacatcttactgattggtatcggagggtgtattggtaccggtcttttcgttggtactggtgccaacttggctaaaactggtccagctccacttctgatgtcttatttgctgatgtcctttgctatttggtctgtcatgaacaacctgagtgaaatggccacctatcttccactcaaaggtgtttccatctctggttttgtctcacgttatgctgacgattcccttggattcgcttgtggttataacttgttttacacttttgctatcatggttgccactgaagtgacggctgttggtctgatcattgagtattggaatgacgatattcatattgccatctttatgaccgttttcctcgcagccattgtcattttgaatttcctccccaacaaatattttggagaaatggagttctggttcgccttgatcaaagttttgtgtattttgggtttgattgttaccggtattgtcatcttctttggaggtgctccctctcgtgacagaattgggtttagatactggaaaaaccctggtgcttttgctgaaagaatcaccccaggtgctggtggaagattcttagacgtttggactgcccttattttgtctggtttctcctttatcttgggtcctgaactgattatcactgctgctgccgaagccaagagacctcgttacaatatccccaaggttgcaaactctttcatctggcgtattatgttcttctacattgcaggttccttagtcgttgggtgcacagttccttacaaccatccaaggctactgagtggaggctccaatgctagtgcaagtccttacgttattgctattcaaagtgctggtatcaaggtacttcctgacataatcaacgcctgtattttgacctctgcttggtctgctggtaatgcttacatgttcagtggttccagaatgttgcttcagttggccaaggttggacaggctccacagatctttaacagagtcaacaaatacggtgtcccatggacgtgtatgatcttggtttctgctattagctgtctcgcttacttgaacgtctctgctggttctgctaaggtctttacttggttatcaaatctgtgtaccatctccggtttcatctcctggttgtgttcatccgttgctttcctcagatggagaaaagctatgatccttcaaggacgttgggactcaagaccttataaaaccgctcttcaaccatatgctacttattatgcattgtttttgttaggaatggttgttttaacgaacggttatgatgtgttcatcaagggtcgttgggacacggccacatttattgctgcttatgttactatcccaccattcgtgattttatggttaggccacaagttctttttcaataagcataagaggcttcttcgtccggtcagtgagattgatctagtaactggtttacaagcagttgaagccgaagctgagaaggacttctttgagattgagcaagagagagctacttctacggcattcaacaacccgttccttagggctttccactacatcctttattaaatttgtaaattaactctatactatatattatcatctatatctgcttttgacgtttattgtaaagcgaggacattttaaatgttatggaaatggttgccgtaacaatccctaacgaagtagaaacttctttttgctgttgaggctggtggagtgtgaaaaagtcccgagataaggcaaatcgaaatcttgaaattctaacctcatgagcaccggtgtaatgggctgaaaacagttccaaactataagaaatggagatgttcaatgtcatatcacaacgtctattagaaagtcctcgtccaattcagtgtcgcctactttactggacatgtttaatgattcatcatcaaaaagtaattgaaccttggtacttgagggtagtccctgggtagtaaggtaataatctttgatgaaactgatcggggtattcttgctcacactaagcttgataggctctttaccgtcattacttttcatgtgaatgaaaaactgacgatcagtttttttttcatccttcacaatgtcgtctattagaagcgattcttcatggtcttcagtttgttctctgagagcttgcaaatctttctcttcgtaatcaatgtggagaatagtattttttctaatttctgactcttcgatagttgaatatcttgatattggcatttcttggtaagataaattagtcgataatgccctaggatatcccatgactagtagataatattcttgaaccctcttcagtggagtattagaacagaccatgataacctttgaaatgtcgtcttgggcacattgtagaccaatggtaaaatactcactatcatcatttaaatcatcctcaatgggtgtgattttttcaatattttgaagatcattctttgtagagagagtctggagcctcatctccctctgtaaattcatgagctcatactgttggctcgacatcaaagtaagtgatagcttcaacacatcattgtcagatgcctggggcgacaaaagattgctcgtaatgagagagctcaccttgaggtgtcgtttgatttcatgttcgttattgagcaccaatgttggctgatattttttaaatgaatccagatcagaatttaattgttttaaagcagtgtccataattttaccaaacgaggtaccgcatttgaccattaaatccacagtgctgttctcaaaataatgcatttggttagtaatagataccagacatttaacagatttgtaagggtctatgatcttcggaacatccggttcagcttcaacgggaataggagtggttgacacttccttcgtaaggtcatagtcaaaaagtggcatttcgtgttcaataatagggggcggtgtaacgcattcattatctgtatcattgttcttatcggtagcgtctgatttttcatcaatgtccacgatttgtggtccagctggggtatgctcggtggtttctgactttcttgtactgcgcctgtttgaatttttctttggtgacagcaagttcaaattcgcatcggttttggactctgatgaaccttcctgatccttggttcttttcgttttggaagtcttccttttcttcttgggaaacccaaaagtatcatcttggaaagcaaagaagtcgcctttcaaactagaagcttttttcttcttctttggtggatccataaccaaaattgtgcaaaatcaatccttaagtgaaacagtttcaatcaaccttctttggatatgtaaatctgtgtcctcttaagtgtagatttttggtcatctcgttatcccccacccttgagacatttcataaacggttttctggattacatcacgtgtgggtccacgtgaaatatggaaaagtcagcgacatccaccccatagaatctgagcatattgaccaaagtaccccatctgccagcaatgaacaaattgatggataatttagttcctgtttggaaacaatatctgtacacatggcaatcccttcggaacattccttttagaaagaagtggtttattggctacgacttgtcgggtaatacttattgggagttcatagttgagagaaatagtaagaactataggcggaagatggtcccataccaaagaaaggattttatgcatgactattacgaatctgttccaccacaatggcagcaatggcttcgatttgtgaaacagcatcctcccactctaacggaactgatagcggatcgacagaggcaggaagccatcaaggaattggcaaagaatgccgatagacgttggcaattggagacgcaaaagcaagaagattacgataattggaagcttaacaaagaactaaacagaatgaatgtgaggcaaaccccagggggaaggccgccgcccttctccggaaagtccacacactccaacgatgacccgatctcttctgccaacgtgaagagcaataggtaagttgaagttgattctaccaaaagaacatagtgtacaccattttcatgtatttatttattcatatgatgagcttatttatgcgccgtttatctgtagttttttctctaccagggcgacaagctgattgctgaaactttccaaaagtgaggagttgtcagcttgaacatccctctctgatgtatcatcgttgctggtatgttccgtatcaccatcatcattcacaaatgataatgttcgctcgagttctagtctcaatgccgtaatggtagattgtgtcagaggctcaacagtctcaaactctgcctgaaactccttcaattgtgagatcaacttctccgcagcctcagagatggaaggcttcactagtcggcctcttgtcctgtttttaggagttgttaaaattaaagactttggtctagttttttgaggggacgtattgatatgttgttctttgtctctgcctttgtcagcgaagacatttgatgatttagttggagaaatgttctttacaacagtttgagagttgagtatggaagagctacccaatggaactctaccattagggtatagtcttttggtaggagaaagcctgtgtaatgtgttatctgttttaacggatggagatcctgccatggaaactaaagtctttggttgagggctcttggggggacttctcggagagttgacgattcttctagcaaccttcgtggtgggactttctaacaaagaagaatccatcttttcattctttactgcaactttcaagggtccaaatgacaaactccagaagaaacaacaaccatttccggaaattgtgcaaaaatgtagactgtcctgcaatctggtcatagagacaactgcgtcgccatgagcccaatggctatttaataaatctccactcaaggtaaagatagatatggatttatcagtagaagaacaagtcactagcaatttggtatcatcttgttgtgccacaaaaaatttctctatcaacaatgaatcattattcaaagcactgtgtaatttaagagttttgaaaacttcaaacgaatgcaggttgaatatcataacactccgatcattggtagagacatacagttcattatcaacaatttccatgtataatggtgtacttttcaaggatatgaccttcaataagttgacgcttagttgatccttgaatttcaattcatgaacagatatcgttctatcatgagagcaaacgtataatctctcattatgtatgattgcttgtgataaatttccccgatgaattgataatgtttgaaataattcccatggtgagccttgcttgaagaaaagttggatcattctatctcttccaacagtaacaagcaaatgggcatcagcaccaagtttggcataaaccatctgattaacggaagactcatgggctttgattgacttgaccaaatttccatcgttaaaaagtaaaccagtccaaacttatctccaaaaaaaatctccctgttcttacaagaatactcaaagcatgaaaactcatgctctaatgagtccgttccaggttgctgaaaccttaaaagtgtgatgcttttgaaattatgcgagtcaaaatcaaactgaactaattcacctgaacttgataagttcaagcccttcttgccaatcgatttgaagtcaacggaacacttaaacatagcatcagcaataacacaggcaagagtaccatccttgtggattagataaatttcatccttgtcattcaaacaggcaaaaaaatctccaaacttcagaagagaaatcaaaccatctctaacttgagtttttcttggagagtagggtgtaggttgaattgttaaatcctcagcaattttgatactctccaactccatgctcttgatcagttcgccgctattgtagtaaagagagtcgccgagatatatttgattggtggtttcagccaggtgcacgtcaagtttctgtagttgtattgggtcatcatataaattgaagcaggctatctctgacctatcagtcagcaccagcaattcgtcctcgttgaaccatgagcagctcaaaaaattgctattgataaaatccttcaagataacattctttccttttatcaattgaacatgtggtttagttgggctcgtcggaggagctttctcaaatatctccttgcatagttcgatactgtcattaaacgagcaattccaaagccgtatatgcctcaaaccaaacgtaactactatgtcattacccttccaaataagtccatttatagtagacagacacttattgcttcctaagaaaagcactttgtttgaagaagacgtggggcgaagtttccagcaattcaaaaatccgtcatttgaaatgcccaacgaacataacttgtcatttttgggcgaaaacttcaccaaatttataccaaatctgtgatcacttatacaaaacagtggggagtttgtactgttaggttccagggaataaaccaacactcgaggctggtagccttcctctccgacggctaaaagttttccatctgacgaaatatcaatacagcttatgacacgcactttgtgagtcagtttggagacattggtattcgtgggggtgaaacttgcagaatcacttgcgtgtgaaattgataggccatctcgtgtataatactccaaagaatcactctccacatgcgtatcgtcatctaacaagcctgaatttatagcgagattcagatatgcatttgcattggagtcatttgactcgagggtttgcctgctactcttacttttcttattgttggcacaaaagaacctttgcgatttcacagcattttccttcaaatcgacttccgaaacaacaactcctccgctggttacatagccaataagattcttgctttggcacacggcaaattgacttgttttcttgcttgaacaaccaaaaatgtgctgtattttggtgtccatctcgatgagctatactcaatcaaaacactgtttctctgtttacctttactgaaaccttcgcgatatattattactatgataagtttaatgcagaaataatatataaagttggggatgattggaactacccagaaactccacatcattcaaggaattaatgctttataagtcattctatgtccttagaatgagagacgaagtatgaactatcaaacatttgttagattatgacgagtatgagaagggtttaccatattaaggaatgaagaaagacgtgtaagcagtggatccaccacgctcatcctcctcttcaggagttctccccttcatcaatttttccctaactttctttgcttcgtccgaacttatggtatattgaaatgcactatctgtcaaatccaaattctccgtcggaattatgtacgatgttctgtccaccgacgaagtaatcttgtctcccgacagattttgctgttgtgctggcaccttgtcagttgcaacggtttgctgattattaggatccaccaataaaaagcaaagaatctttctatggccgggcttcgttttatcagccagttcaaacggttcgacacgatgttggtaaacgttagggaatatcagagtctgttgtcaatacaatcaacagatcctggaaatctcgtcaatttatcttgatccttgaatctaaaaacccttctagccatgactctgtcaccatcaacaactgtcacattcggtgaaacagcggcattgcggaaactaattttggagtctccaatgttctctgaatcatgataataaaatacagtcgcaataatatcttcattaattttactccaacgtgccacgaaccaccttgataagaaggtctttctggagttaaatggatgttagataacttggtaattactttaagagattaagagaaccaaaatctgccaaatccactttcttttcggtcacacaagccggtggttcaaattcaagaggaaacaaagacttgtcaatgtaatcctccctttcatcatagaattcctctgctctggcgatttcatcggtgtccggctcgctttcatagccactgttgcaccaatagccatatagttcgtctggccaatcataaccatagggcatatccaaaaacactcatatgtagggtattcggccctcaatctttcaagttactcgaataagtcaagagcaagtacagaccagggacagctttagcaaataccgaagaaatcagtgagtataaattgccgtatttgactggatcaagattgttaatatagattgtatgtccacatcgtacccccatctttttttgaaacgtgaaaaatggatggaagccactgatagatctccgacaaatagtcttttcctaaacagttagtgtacgtaggtatatccttgggaactatcatcttggaaacttcaaacagatttcccgtcatcacttttgtctttccatactgtaaaggatacaatgaagggtgaaccaagtccagcacttggttatcacttccaggacgccaatccttggaatcctcaggaacgtcctccagtttttcatacactaacttcttcaaagattctgtgaaatcctcatcaagtgctctgtctaacaacagcacattctcgttgggacccatggtgaaccctgtctcttgtccccacttatcataccattctagtcttcaaaaatatagttccagattgtttctgcagaatgaagtggtaaatagtctggttctactttcaattgaccttccatttttcggcaatccacttcttcctgctctcctcattgttgtatttggtagtccagtcaggtttcgctctaatcatacagctcaacttatgcacgattagatcgtctataactcgtagatagcagactttgtctccttcgaaagagcactatagaatggatgtgggaagtgttcaatctttcgctgacatagcgacgacttgtggttaggatactaaggacatgttacgaaaagggcgtccttagaaaatctttatacctagggcttccaaatgtgtcatagtctgtaagtgaagaaaagaatatgagtcaagtataggtgcggcggctgatagaaaaagtagtgctcgagatccctcaagcatttcaagtgccaaaggagtgctccactgtgtcaattacgattgttgccagattaagtgcattatagatgagactatataagagtgggaactttttgataaagcactttacactttacgcgttcttggtggaacgtaggaccgtgttctgtcctgtcagtctgaaaaatttcgagaaacggtgccgttatctttatcgaacaactattttctgagtttttatcatgacaaatggaagtgaaggaaggtaaatcataaagtcataaaatgctggggattattagaaattgttctgtaggtcagatctataacggtagtgttaattcactgggcaagtagttcataagattccttcctggtgggagaactccaaaacttcagtttgtccaagagattaaaatactttttggaaggtgtggatttttggaaccttttgatgaggctaccagtctctaaatcagtgttaatatccaggtcgtttgatgtgttaggagcagagaatttgaacgagctgatatcaggtttcttccaaagcttcaatagcaaagagttcaagacaacactaacggaactgaatgccatggcagcagaggcaaccatggggtgtaagtagagtccaaaagggaccaagaacacacccatggctattggtagcatgaaagcgttgtaaatgaaagcccaaaaaaagttcatcttgattttcttgaaagtagctcgggatattgacaacgccgatattaatcctgaaatagaattggaatcgttcgaaagtaagacgatatcagcagcttcgatggcaacatcagtgcctgatgcaatagcaatacctatgtctgcatctacgagtgccggtgcatcattaatcccatctccaacaaaagctatcttaaatccaaattcagaccgtatttcttggacaatccctgccttttcagaaggtgaaacatttgcaaacacattagacttgaaaatgccaaccttggaagccactttttcagctgtagcctgattatctcctgtgactaaagccacagatattccttgactcatcaaataagaaacaacctgtgcagagtcagacttgaccatgtcagataactcaacgtagccttgcaaaacttcattaatcagcacgtaaatatgcgtaccgcagatttcctcattactttggattgtagagcagattttctcatttccaatagaaactttaagaacttcaccattgatagtcacgtcagccttaataccggcacccacctgaatatccacattggatacagtaatctctggtttcgattcaacactcttttccatcgagatttttgataaagctttggcaacaggatgctcgctgttcgactccaaacgaccaatgatatgccaaagatctgactctgaaatattgctgacggttggatttaaggaatatctgctaagttgcatcagacctgtcgttattgtgcctgttttatcgaatagcacgcattctatactgctggcattttctaaaacttcaccgcctttgattagtattccattagtagcaccaacaccagtacccaccattatggcggttggtgcagctagtcccaaagcacagggacaagcaacaacaatgacagaaatggctaccttgaaaaccctctctatcgatatgtgatcaccatccttgaagaaagtagggacagaactgaatgatctacacttgacgaccatgaaccagacaatgaaggtcaaaactgagagggagaggatggttggaacaaaaattgatgatacagagtcagcaaatctttgaaccggtgcttttgacatctgggcatcttttaccaagtccacaatctgttgcaattcggtatcactggatagtttatcaaccttaacatataaaactccagaattgttaacagagccgcaaatgactttggcaccttcttcttttaaaactggaagagactctccggttagcagggattcatcaacgtcagattttccgtaaacaacagttccatcacaaggaatacggctaccggggtgaattagcaccatatcattcagttgcaacagctctggaacaatttccttcgtgaccaaagaagttgattcgatatccttttctgatgaaaagttctcaattagcagacaactagtgggtgaaagggcaagtagtttagacagggcagtggaactatgtgattttgccttgttctccaagaatttcccaaaagaaataaaaatgaagagcatagcagatgtatcgaatagtacactgggctgtgtgtggttagctcctaatatggcatgaagcaaggtaatgattgagtagccataagcaatggttgtggaaagacatattaacaaatccatgttaccggttccatgtcgcaaagagttgtatgcattggtgtaaaactttctggctagccaaagttggatgtatgaggctaaaactagctgaataaaatcagttaacgttaacccattgaaaagcttaacattcttatgagtgatcatggggaagatatgacccaagaaaaatacaggcactccaaagatcagattctgcacaaaggtcaacctccagtattgaatttccttgacttttgccagtatattaagttgactttccttgtctacaagagtgttgttgagcaaaagtacatcaaatccacagttttcgattgtttccacaatttttctgatcccaacttgacgtgggagatacctgaccacacattcttcggtgactaaagcaacatgtgcagaaaggacaccatcgagctgagaaaccatcgactccacagtgtcggaacaatttgtacaagtcattccaatgacttgcaactttacggttgtttcattctggtaggaggccttttcaggttcggatagtacgggatcactggatataagctcgcagtcaaaaccggaatcctctatgacctctataatgtcttttgggctaattccgtcaccatgaacaattgtccccgtctcagtcataagcgatacagacacttcctcaacgctatcaagggattgcagattctgcgtaattgagtttacacaggccgaacaggtcattcctgtgatggtaaccttcgtctggaacattttggggcggggccagaggaagagacggaagaggacagagggcaaggagtgctgaaattattactaaaggaattcgatagattatatagattaaggttgtttagagttggttggtacactagttattattctttcatgcactttattacatgcagctaatagtagcgaacgagatagggaggatagttgaattgaaacgatgaaaatttccctagccaaaaaggttggaggggggagatggtaaaagtggaataggttgaaggtatgtttattgacccagcatttttctctgttgtggaacttacctgagtcagccatcctttttctcccttttttggcagttcagtccgaaataagatgttctattgtagatagtagtgcgtctaaggattttttatggttccttgcaagcatggccgtggtccaggggggacaccagaaggatagactaattcatctaccgtccctggccaacaaaattggtaatgtccctaccaaaaagctaaacgtcttcacttggctcttcagtactggaccctgttgaagtacatttatgcgcaaattaccgttatcacgattaaacgactcttggtatgcttatacactcttatctccaatttccatcacacaccgttcattttgggatagtccacaacctaacctcattttgcaagctcagcgccagataaactacatccttacaccatatttacatgtgtatgcctgaggatcaaggtagaggggagcctagtcgaaccatggatctgccctcagatttgaaacatctctttctgaaatggctggaagacgattgcattgtacagatccagcttgggtctaagcgtgcacttcaattgaccagggccatggagaacttgaagaggacggatgaggctatcgataatgtaaacaagcttaaaactgtgaggtacattggccccaagataacggagtttctgaataaaaagcttcttaaatactgcaatgacaatggatatcgtgttcctgattggtgtaaaacagcggaaactaccacaagctccagaaaacccgcaacccagaaagtagctaaaccctccacatcaactggtctaactggggcacttcctggtggaagaagtaagggaagacggaaatatgttcctgctaaaaattccagtgcgtatgcaatactgatatcattgctggtcaatgattctgctcaaactggcgtccagaagagcaccgttattgccgtggccagtaagtattgtgaacgatcattcaccactaacccagctacaggccaattctatagcgcttggaattccattaaaaccctcatgaatcatgaactggttgtggaatcaacgacaaaaaggccagcattatactatttaaccgacgaaggtaaactgctggcaactactcttgttcaagagatgcctgaacatcagaggcctcagattgatggcaatgatgaggactatgacgcgagacaaagcactcccgctgcatattttgccagctgcgggtatcaagaatggtccgacttcactatcaaaatgatcattgataacagggagattagatcacagaccgaaagagacttttttcagaacaaaatgagcgatgcaaacgtgccgatcgaaattcgtccattaccggttggagatgtactatgggtagctagaagcgaagccggagaagaagtggttctagatactattgttgaacggaaacgtttggacgatcttgtcgcttctatacaagacggaaggtttctagaacagaaatctcgactcaaagaaaccaagctaaagaacataatctacatcactgaagagttcacctcaacgaatctgggacaaatggcaggtgcggttcaaacaagcctttcaatgataatgacaaacttccaattcagactacatcgtaccaaggacgcagatgcgacttgtaagtttctctccattctccatcgcagtgtctgcaaccggttccaaaacaaaccaataatatgcatcaatgccatgaagttagacgacaattctctcccggcttttcaggatagtctgatgaagtttagaaaagaaatggacaaggacggttgctacatctatattaattacagcatttttcatagcatattcggcaagtctagcttggtttctttgaaagagacctacatcaagatgctgatgacaacgaaaggagtatcactggataaagctattcaaatccaaagacactatccaacaccacaaagcctcattaaggctttcagagaatccaaggaccccaaactactaagtcaacatttcaaacaggaaatcattactcacaagaaagtgacagccatactgagcgaaaaaatattccagacatggggtatatgatgatccaaaaaaagaacttactggaacatgcgcatcgatgttagcaacgcatcacatgacatgtctttctttgccttcgcgaactccttcactggcatccctaatatttgagggtaaacagaacaactacctctgtgtctctgcttaattgagttttatattcatcacccccaaatatgtcagaaaagtactcaagacctgctcagcctccgccaacgtataaccagccgggtggtggacaatcaccgtttaacgagccttattatccgcagcaaggtgtcaactcatctgactaccatcaacagcaacgaccagattatgaccctgaatcgcaatttcctccagagaaaattgtgggatctggcaaacctgataatgctgaaacgtttgatgactccttcaaggtgaaaaacaaactcaatgactggccatttactattctcttcattgctactttagcaggctttgtcgtcgttgctggaattgttctctcagcttgggccagtaactattccaccagtggtagtggtatttatgatagcggtgcatcattcactttgaatacaaatactgtggtcttgtttgcatttgttattgtaatttctctagtccttgctgtgttgatgctgtgttttgcaagaattgctcctaaaagatttatacaagttggaattgtgctaaatgtggtattaggtcttgcctcttccatttattatttagccgtgggctactattcggctggtgtcgttttcttggtgtttaccctgattagcgcctactgctattggtcaatgagaggtcgtattccatttagtgcaacggtgctcactattgtcattgatgttatgaagagaaatccttctactttgatgacctcattgattggaattatagtttctggtgcctttgcagctctgttcagtgctactgttgtagcaacttacatgaaatggactcccagtgatgaaaatggaaactgttccttcaacgagggttcaacttcgtgttctcgttcgaaagtaattggaattttagtgttcgtctttttcgcaggttactatattacggaagtgattgggaacgttatccatgtaaccattagcggagtgtacggatcatggtactatctttcacgttctgaccaaggaatgcctagatttcccgcattgggagctttcaaaagagctatgacctggtcttttggatcgatttgttttggttccctaattgttgcgctactgcagttattgaaaactataatccaaattttgaaaaacgatgccatgcaaaatggtgagggatggcaaacaattatcctgtgttgcgcagattgcattttaggacttattgaatgggctgtacgttacttcaaccattacgcatactcatttgttgcactttacggagagagttacatgaagtctgctagagccacatgggatctattcagagccaaagggttggatgccctggttaacgattgtttgatcggtgcagggttatcattttttgccttgtttgtttcttacctttcggccctattttcttacctgtacctgagatataccgctcctggatacaactcagatggttccttctatgcaccagttattgcattcacctttgtaatcgctttgcaaattgtcaacattgcatcgtccgttatcagatcgggaactgcaactttctttgtttgcttagctagagatcccgaagtgttccagatttcatatccagacgagttttcacgcatttttgccgattatcctcaggtgatgaacaaagtcgcagctagacagtagtgaggtataaagtagcagaatactagatggagagggattcgtttttaattagcctctacttattgactaatgttatgagttgagatgtgtccattggttacacactgacatcctatttttttcttaggacctttcaaagttcttcctagaataccagttgataaagtcccgaatgctagctctgacccttctgaaatccttagaatttatggcagcctgtactgttgtcaacaacttgcttctctctttctcgttgacagttccttcgggtaaacttgataacgcttcattcagccactgcagtacaaggtcgccgttctgtccgttgattgttaccagccttatgatcttggtccacaaatcagatgcatcatggttgcagtcaactggaaatctatatactagtccgttcaggagcaccttagtcaaaggcccaccagttgattcgatgaaagacaaaattatccttctaatttctggtggaacatcggtttccagcaaagaaacgggaggagtttcaaaaccccaagagtacaggtctatgaggaaatgtaatgtggcaatcaatggctcaaattgagaaaaggtagacaaggccataatagctgaattataaacaggttgtaatagctcactttgaattaaatgaattgggaaaaacatcaggatgtcagccatcatcctgaaatagtcctccactaagtcaggataattggtgatctcagattgattctgttcaagaaactggatgaatgaggcagcttgctgaagagagaatttccaaacattctccttgatttgtgcagagacatgctcatctccgtactctctgatgaagattcctgaaacccaaagataggctccctcacggtaagtctggaatcctgaaactaaaagctcagccatctgggggataatgggctcaaggtatgtgcttaacgaagacattgatttgttcaaaaacttcaacgccctttcggtgattggagtagactttccaaacttatttagtagctttgtaacgattggccagccctgttcgataacaagtttggcaattggatttgatggactgtctagattagatggacgtaatacttgaacaaaaatggtgagaacctcaatttcatctgcaattttcaattgtaaatctggagccgtgtcagatatttcgtacaggcttgacaatttctcaatcgttggtttccagaacattgccgtaagttgcatcaacttttcaggatcgccttcttcttgaagtatgtgggcaatgccatcagccacctcgtacaaagatttgatatccaacgtaccagcgctgtaaacattgttgtagaaattaaacaactgctccaaatagccaatcaatagagaagagcagtcctgacaaaaaaacatcaaggcatgggaagctgcgatggtgatttggttgttatttgattggaagccatcggtaatgtagctcaactggccttcaagatattcagggtgtttgctggtccattccgtgtatctacccaaaaccagagttacagcgtatcttattttgggattctctggaagtttgattaatagttgcataacttgaggcataagcttattttcagtggatcttacctgttcagccatagctcttaacgagaatatgggggcctcgatagattgccaaggttgattggagttaacattactttgaatctggttcaagggaatacttagcgcatttgaagcgccaataactgcacagcaatccttcaaaacatcacccatctcatatctgaagtctttgaatttatcctcctgttgtttagtactaaacagaagggaagagtcagtggtattaggttccacgataggataactcagatgtttgatcataacgtggatgagttgcgtatagattggggtaaagagaattcttgcctcagcatatttgtcgattattattatttgacgcagctggtgccaaaagaagaatgtgtatttcacagtatcgaggtcatcttcatatgaggtcaattgtaggaggatctcaactagaggtttgaaatcttcacaaagttttggaatcaaaacgtgccatgcttctccagcttcgacaaatattcttgttaacccttccatcttttcaggatcgtcccatgattcttgaatcacatctttcaaactcaacaattgctgatacaatgtttgtacaatggttagatcttcgacgtcagttgtttctctcaatatggtgcataagcattccaccgctgtatcaaaagtttcatcattatgtatggattggtagatcatatcgctcaaggacctcacctttaacagctggtctacagagacttctttgatccaagaatttaaacagtctagtaccatagagttttccctgccgccattagaatcctttacatctgaaaatttctttagaattaacaagacacgctcaacattgtcagttatcaactgggtagtcctcagactgaattcttcatctgtgaggggagttttatttacatcagacaactcctccggtaacacttttaagaactccaacaacgaggccatggatccactggaaagaacggatatgatttcatccatggcattagaccattcgacgtactgaagagccaagttggctaatgagacgcacagctgtgtttctattgccttggctttggagtcgtacttaacgattagttgtaaaagagagtccttcaagccttgccagttttcctttggtagttggaacaaatcatagttgatcttggatctcagagtttgggcacaaaacattttaattgtagtcatcggcggatcattatcattattgaggacttggaagacgatggtccatgcctcaggagatttttggaactccagcagaaacttatctgcagcgtgttgggtcgactcatcggtgcttccatacatggaagttaacgcttggttgagcttatccaaggtcatggtcatgactgatgatggggttgaattaaagggaaaattgaagttttagtgttcatgttcttaggctcgcgaatttagcacatctatgaaaaaaagtccatcaaccgagagaaagttgacctctacagaatctactgaacaattaacccaaaatgagcagcagtagaacgcagaaggtggtaagtactacagttcattaatgctattaagattgcaaccttttttttgttgaaagactactaacgaatcagatggttccacctatcaacttaatgttcaagtttctccaacaacagtcgacggttcaaatatggctctacgaacagaataatactcggataaatggaataatcaaaggctttgacgaattcatgaacgtagttgtcgatgaagctattgaaattaatcttaaaacacagaaacaaaggaaactgggtcgattgttgttgaagggcgacaacatcacattaatctctacattgagcaactgaactcttgcaagccctaagtttgcatggacctccgggatgtgccatttaatcatttgtacaataaattagaacggtaagcgaagactattcacacgaaaagtttttttatttcactatttacaataccgagagtatcaacttacttctccattattctcttcttatttatcattctgtttcaccttatcctctacggcattcttcaacttttcagtttctccactcagtatgtcttcaatagttgagatacccggtccttcattcacagtaccaaataatttctcttgcacagtcttctctatatccagcgcctgttggtcctcaaaagagttcatattagagccattgaagtaagccttgggtccggtgcggtacagttcctctactctcctttccagctcttcttctgtcacaatgaaatttttggcagaagaacacaatctcaaaagatcggacgctttttgctccttgatagccaactcgcgttgtagcctattatgttctctctttagtttcaacaaccgtttctcctcttttgttctttgtctgacgattggcccttccaggaactgctccatcgatggtaaagtcaatcggaaagcctcactaacttcgtaatgagaagcagcggcagcttcttcttttgctttgctctctttcaaatgctggatcttctccttatgttctaagttcttctcttcttggtagtaactttccttcaagtaatctcgacgcaatttgctgttcttgatcttccactgttgatcagctgaaagcttacttaactcctcacttgagtaaatcttcttgggctcgggggcagttttgctaattttttcttcgattgtaaccaccttaggaactatagcttccctggttgacccccgaggatgagggatgttgggagcgtagcccgtattagggttcttcttgatggtaattggcttgataggctgcttgaatatctccctagcaggtggaagaatacctgatttacctccgtgctttatcacgttcttgcccattctgttgttgctcctggaaaaatttgcttcctccgccagtagttgatttcagaagttgaaggatgccataaattttcgtggcattacgtaagcacatatacctaaacattgtttctcagtggtaaaaaaattcaataggtgaaataaattagaaccattaatttgtaatactattctttcctatatataatttagcctatctacaactcatcatgatcatagtcatagtcgtagtcaaagtctccatcatcatcgtcaaaaccttgaccaccaggtggagtaccaccctctggagcaccgtatagcttagaagtgattgggtaagcaatcttggaaagcttttctctttgttcgtctaattcttccttggttgcggtgtcgaagttgtcttccaagaactctagggtatctttgatggcatctgtcaatgtctctttgtcgtcctcgtccaatttagaaccaagcccggtttcagagtcatcagtaacttggttcctaagggaatgagcgtagttctccagagcgtttctagcctcaatcttttctcttagtgcagcatcctcagcggcgtacttctcggcctcttcaaccatacggtcaacctcctccttggacaatctaccacgatcattgttgatggtgatggactcggattttccagttcccttatcggtggcagagaccttcaaaattccgttagcgtctaaaacaaaagtaacctcaacttgaggagtacctcttggagctggtggaataccagtcagctcgaatttaccaagcaagttgttgtccttagccaaggctctctcaccctcataaacttgaatcaacacagttggctggttgtcagcagcagtggagaaaatttgagatttcttagttgggatagcagtgtttctgttgattaaggtagtcataacgccaccagtagtctcgatacccagagttagggggttcacatcaagcaagacgatgtcatcgacaccttcctcaccagacaaaacaccagcctgaacagcagcaccgtatgcgacagcttcatctgggttaattcccttagaagccttctttccgtcaaagtaatcctccaataattgttgaacctttggaattctggtagaaccaccaaccaagacaatgtcatcaatttcagatttcttgacaccagcgtctttgaggacttgttcaactggtttcagtgtcttcttgaataattcaatgttgatctcctcaaacttagctctagacagttgctcagagaagtcgataccgtcgacgaaagagtcaatctcaattctggtagtcatctgggaagacaaagtacgcttggccttttcgacctctctcttcagcttacctaaagccttatcattgttgctgatgtcaatgttatgcttcttcttgaaaatcttaacgaagtggcgaacaactctgtagtcaaagtcctcaccacccaagtgggtgtcaccggcggtagcaagaacctcgaaagcaccaccctcaatagaaagcagagaaacatcgaaggttcctccacccaagtcgtagacgatgatctgtctttcctcaccagtcttgtccaaaccgtaagcaagggcagcggcggtaggctcgttcacaattctcagaacagtcaaaccggcgatgagaccggcatccttagtggcttgacgttgagcgtcgttgaagtaggctggaacggtaacgacagcatgagtgactttctttcctaagtagtcctcagcgatcaacttcatcttacccaagaccatggcggaaatctcctcaggagtgaaagacttctcctcacccttgtactcgacagaaacgacaggttggccgttcttgctcttgacagtgtaaggaagacgcttcaagtctctttggacctctggggcatcatacttcataccgatcaatctcttaatatcaaagatggtgttttttgggttagaagcagctaagttcttagcagcatcaccaaccagtctctcgtcttcagtgaaactaacgtaggaaggagtgattctgttaccttggtcattagcaagaatttctacacgacccgacttcatcacaccgacacaagagtacgtggtacccaaatcgataccaatcactgttccataagattcgacatcgtcagctctaacaggtttagcaaatggcactacgaccaatagcatggcatacattaatgccgccaaagtcagccaagatggttttaacgacagcattcttgagtgttggaattgaaattaaggaagaagaagggatctgggtacgatttaaataagtacgcgaaagaagatgacacgctgtatgaaaacactgaaaattcgagaaaattcgatggaccttgaggtttcgcgcattcaaagatcatttggctgagttgtcaacttgcaaagctgaggcaagggtgtattacactagctagtaacagtaggccacaataggaaccacaggtaaacggttcctctattagaatattgtattatggtttctattttcactataattgtttatcatgtccatctcaagtcttcactaggagctcttagttgtcagtcccaggataatcgtaatgcttcatgaacttgaatacctcgttcatcaagtcgtaaactccatcttgtgaatcgaaataggtagccttaacctcgttttctaccttgataagccctccgttctccacaacaaccgcaaggctttctatgagttttggagaaaactcagcataccagcggtgattccaaactcctagtttgaccaagtttgaaattaggttgatatcgaggaacgaacgatacttgagaatctcttggatggataatgtggattgatttaagttgttgagggcaattgaggtttctggctggttcattctggagcgttcgttcagatagaattcaattaatttcttgcatgccttgaccgaaaacctcagacctagtgcatacttgaatgcttcagatgcctccttgaagtgttttaacctccatgaaaccatccctattaactcccattctaaagtggtcttcttgaattccatttgctgtgccgtcaagtgcatgtgttcggcacgatacatcgtatacaccctcagatcttcataaagaagcataaacagattgtccaaccacctttcgcacaatcgcttagctctgaaatcatcgtcattgactgcgtttccgttttgctgtccatttccacaattgatagctttgatagtggcgtcattggcaagagtagtactggaagtagctgaatgggatttctcctttttgtattcgtgttccatcacaaaaactttggctctgtacctcaacagctcttcccatccaatcttgtgaacgatttccgttaataatccatatgcctcagcaaaggtagactttaagcttgcagctggaagattcaataacgatgcgtccacagtcttatgctcttgtgtcacatcggcaggattcaatgtggtaacctcgtcaatggtgacatcaactggtagtgggagatggaggtcctgtttcaacggattgaaaacacgctttaaatgatacctatccttatgggtaaccattggacaagaattcaaagtcaatagtgcttcctcgaagttgccaacgttgatataaatcttggcaagagttgcccaacatttgaactctgagggagaagactcaactgctcgtgttgcagcatgaatggctaaatcgtgtctagacttgcccatacatatttcggcttgtagtgttaacaatgcagcatcacgagggtttatcttgattccctgacagatgatgtccattgccttaatctcttggttactcagcatgtacaccttagccagcaagactcggcaggattcatcttgttctattagtctgttgacaatttcaactccttggtcgaatcttcttgtcagttgtaaaaccttgaagaaagtgtctacaaggtagttttctagtagggtaggcaattgcaaattagcatggcagccggttttctgtccgtcccaaaacaatgcttcaaacccttcaagaaaaagagtgactgattcgtcattcagcagtgggttaactttcctcagctcaactatggaagcaaattccgcgtcatcgtcatcggcagtaataatacttctgatcatggaactgatgaaagtctctaaccacaattgttcagtttcctttattttctcaccagtgctagaaaccatgtgagactctgcacttccagggatatgcaccgtgacgacggcgtctgtcttactgaatacattgtaggaacagaaggtcgcctggattacacgccaaggtttgtgtttcccaaaccataactgagggctttcagaaatgatcattgcaaaactattgagcacggcagcaacagacgaggaactcgtgacatttgtcccagtaatgtagaaaaaagtggatatctctttgtgggaatgatggttcaatttgaccagctgcaccaaatcaggcggtcccagatcctgaatagcaggcaaacaattggtacgttcttccaaagattgattggcgtacttttccaaaacctcagggattgatccttgtgtgacgtaggacattgccaatggagttggatgtggggcttggatcaggaaatgattggaagaggtcagtcggttggacgatctgtcttaagaggcgtattggtgccaaacgactgtcgcgaattgttttcataatggttacgggagaggttgtcgtggagaagttgggggtcagagaagatagacaatccaggaggaagagggaaaggatcctggtgtgcttcagaggtcagcaaatgaggactttcatctcaagctaattagaaaaacacttcctactattacactataaacactcagactgctctactaagtcttcctcttcttatacgaaactgcctcctcttcgtcttccagtacccagtctttacctgtaagacagtacttttcggggggaagacgaatgccccacgttggaatcactgcaggtaaaggcttcttatttcgctcggcagcaagttctaacaacaattccttaggaggaacaggtttgaactgatagttggttctagcagctatggccaatcgaatgtcctcagtggtgagctgggcattagtgccggcatttcctgcgtttgaaatatgagagccgctagcatgggcatggtcactgtatattgtggcatcctgcaaagtgcctgttgtgtatctgtaagcaaagtccatcagctgaagaggaacgtgatcttggtaactgtagatgttctgagtagcaaatatcaggtgcagcagcctgacatctcttgggatggcagcttgctcgttggtcatggaagaacgatcaacaaggtgtgtgtgcgtgtggtgtgcgaaatatactgttttccgatgtccttgccaggatgtcagatgtgagtaataagaaccgcgaacgatcgctctgtcattacaaaaatttcgaggactagacccgttctgcccccaaaaagactccccgccgctgaggcgctctcggtggaagcaatcgcctcgcctttctctgcgaaaagcccgaaatcggcgaatcgcgaagaccgaaaatgctgcgtaaattcgggtgaagtcagcgacgcaatccctataaatattctcctctcctaaatacttctttttactactcacaataaccgaatagctttaaacatgtttagatcagttttaagagcaaacacaaacatagccaagaccgccttccagaagccggcaaccgctcctttgctgagacaggctctgcagcaaacaagagcttatcatccaaaggtcattgaccactaccagaacccaagaaacgtgggttctctgaacaagaacttgccaaatgtaggaacgggattggtcggtgctccagcttgcggtgatgtgatgagactgcaaatacaagttaacgatgaaaccggtatcatcgaagatgtcaaattcaagacttttggttgtggctccgctatcgcctcgtcgtcttatgtcaccgaactcgtccgcggaaagactctggaagaggccggaaagatcaagaactcagttattgctaaagagctaagtcttccccctgtcaaactgcactgttccatgttggccgaagatgccatcaagagtgccatcaaggattacacttccaagcgaagagtcactctgggcccagaagcagatgctaaagtgaatctggaaagctctgtttctgcccactaaagggattcatatggatagttaaacaataaggggaaggaggagaaaatgaggaaggagagaattgagaaaggtcacgcatttgtaatgaagcacgagtaggatgaaacaggcaaatagtcgtcctacgacgacgatagtcggtatgtctttgctcaagtctgcggccatcatatttattattattgggaatgtatagttgcagataggttagttttttatgttcactatgaatgatttgttgagttattatttacaacatattcaataaagatatcaaagtactggagtttgtgtttctgtcagcagcctctttgtcgctcggagtgttgaggttggtatttgagacggtggtccctatgtttggtgtgttgattatggtgccaggtctactcttatctccgaggtaaggatcggtgtcctggtggtagtagtgtccttctgtgggagaaaactttggcatttggtgcaaggtgttcatagcttttcttaaggcaagtgttgtgctgagcagccgtgaacttatcacatcgtttaatacgggcgccatgtagacattggcccctatgatgtaatagtcatttagtgcatcggcctcgttgggggattttctgaactgttttctaatcacccaaaaattaggttcctgggtatacgcaacaataaactctacccctttcatcttcttcagttcttgttgcaagaaatgagggttttgctgcaactgtatttggaactgttcgttgaactgactttgcattttgagcacttggttgttgctggacctgtcaaaaaacggagattgcgaaaaatactccagcacgttatctgtcctgagcccaaacgtctgaatccattcaggcgacttccattgaagttcgtcgagcggtgtattgttcatagttcaacgtttggcttgtgaagtgggtaaatcagctccttctacgatgctagatgtttcaagcgcgatatctggaaatggacaatttttcttccaattaacccaaaggctaaacagcttatcccaatgttcagagccatacgaagctactctcaggtagttaaatacaacaataaggtcattccagcccccagtaagtctgttccagacgtgaacacttttttgaccaagatcggccgaaacgctgaggagcacatcgagatctttgaaaacgactggtccaagttctggaacgcaaagtcgtccgatatgaaggagtggggcatcgagccacagacccgtaaatatgtgttagcatggaaggagagattcagacagggccaggagccttatcacattgcaaaaggtgtcaagaagaacggaggtgaaagaaatgctaagctacacaatgctttgaagagattcgaaaagctgaaagctgagagggagctgagagaaaagtacatgtcagaacacaagaacttctaaaagccccaataatttttgcattgtatatagatctttatgaagttaagtttcctttgaaagtttccagttctttggccaaattttcagcctctgctgtcatctcttccaaagttcttggtttccggtcctcatccgatagaactttgaattttctgtagttattttccagtttttgctcattgtcttccagtttggcataaattccatccccatatccatcgggataatacctggggattaaatgtgtgtgtagatgggggacactttgtccggctgcattcccatcttgaattgcaatgttcaacccatcggcattataatatttttcaataaactggtgaactaattggactgtttccatgtaatcaatggactcttccttcgtgagttctttcaacctggagacaactcttaggggcacaaccagaacatgtccgttgacaatcggcttcaaattgaccagcgcatacgagtactttgacctgtagaatacctgcgatgtgacattgaaattcgaaaagagaaccttcgacattgcaggtgatctagtgatttagccatcaggtatttaggcttgctcgacctggttatgatccgagatttggttatgagccaccgttatctatcagtgatatttcaaggtaaatgctggcaagtcaccccagatggtaaacgcgatgaagttcgtcgttggggtcacacgaatcatagtagcgttgaactattgttaaacaccaagtgttcaaatgttttcttccctgagcaatcacatttaggcctaccaagctttaaggatggtattccttaacaattgaggaatcatttaccaaagcttttggctgagccgctattgagcaacatgtgtgtcatcatccgttggatcatatctgctatagagtttttttgatgaaaagaacttcaaactgaccgccttcactgagtaaactgaaaaaaggtgacaactcaggatcatggctcttaactcgtctggcaagtgaaagaacggtagtcacaaattccacctgcaatatatccggtggagaatgatttacccaaaggtagctggcctaactgtacaaaaggctcatcactgttgtgtacattgacagataactcccgtattatgtaagccttcccagttttacccatcgcattacaggtacgtaaattaaaatatcccaattaggaagtatttcttaaaacgcgtaattaaactattcagaacgcttttttaggttctctcctattttacctttctttccctctactcattgaccatggatgaaacaaccattttaggtgataccccgttggatgctgtctacagtgatcgagtccgtcggtttcaggacttcttgacttctccggatctgggtaacatggataacatcaagaaaatgttaactctaggacagagaagactggctgtgagtctggatgaaattagagagacagacaaggacttctggctaggcttgttgaatacgccagccgattatcttcccgcttgtcaggatggtgtgagggaggcaatcaagtccatttataccccgattgactaccctgatattgagattactagtgacaccgatttctacgtctcttttaaaggaagtttcggtgaccatcagctgactccgagaactattggatctcatttcctttccaaaatggtaagtgtggaagggattgttactagagcttccttgattcgtcccaagattatcaaatctgtacactattgtgatgccacaggaagatttcaccagagagaatattctgaccaaacgactagttttaatccaatcaccacttcagctttatatccaactgaagacccagagggaaaccctcttaccacggagtacgggttctctaagtacagagatcaccagactatcactattcaagagttgcccgaattggcacctgcaggtcagttgccaaggtctttggatgttattatggatgatgatcttgtggacttggtgaaaccaggtgatagacttcaagctgtgggagtttacagatctttgggtggtgttggttctaacagttctagtttcagaactgtgattctctgcaattccgtctatcctttacacgcaagaagtacctcagtcaagtctgttgaaagattgactaatagtgatattagaaacatcaataagctatccaagaagaagaatatcttcgacctgatggctcaatcgttggccccctctatctatggacatgcatacataaaaaaggctgttttgttgatgctcctgggtggttatgagaagaatttgagcaatggggctcacttgaggggtgatatcaatcttctgatggttggtgatccatctactgcaaaatctcaaatgttgagatttgtgttaaacactgctcctttggccattgctaccactggtagaggctcttccggagttggtctgacggccgcagtgacaactgacaaggaaactggagaaagaaggttagaagcaggtgcgatggttcttgccgatagaggtatcgtgtgtattgatgagtttgacaagatgtctgacatcgatagggttgccattcacgaagtgatggaacagcagacaattactattgccaaagctggaattcacacttctttgaacgcccgttgttccgttattgcagctgcgaacccagtatatggtcagtacgatactaacagatcaccacaacaaaacatcgctcttccagattccctgctgagtagatttgaccttctgtttattgttacagatgacatttctgatgagaaggacaaggctgttagtgagcacgttttgagaatgcatcgttttataccccaaggttacagtgaaggagaacctatcagagaaagacggaatgttacccttgctgtaggagatagctctaatcaagacgaagacgactctgatgacagaaacaaagtatatgagaaattctctccgctactacatagcggcgcagcggagatggctgaaggttctacctccagttccaagaagactcctaaggttttgaatatcaccttcctgaagaaatacattcagtatgctaaacaaagaattgaacctcaactgacaaccgaatgcacaaaaaaggttgtagagatttatgccacattgagaaacgatcacattgtgaaaaattctccaataactgccagaactctggagacaattattcgtttggctacagcccatgccaaagtccgattatctcagactgttgaaatcaaggacgttcaagtcgcagaggagatgttacgattctccttacttggagaaaccccagctactaaacataagtcaagtcctcaaaagtctccaaagaagaagagaaagaccacttcaccatcaaaaaagaagttccaagacgatgaaactgaactgtactctgtctcagagtcagaacctgaatatgctgaagataaagatgatggaaacgaagatgcggatgtcgcagattaccaacctagagcaacaacagcgagaacacgatctctacaagaacgcctacagagcgcatatgatgaagagggagaagatgaagatatggaagaggagcttgtggatgttgaacagattcgggaaggattaagccaacagacgttaagagagccttcaaacgaggaagatatcttgcaagaaactaatacgaacatggatcagcctgccacaatatcggcctcaagattttccaaattcaagtcacttctgtcaatgttacgttctcattacgagtccacatctgaggatgggtctgctcctgtggcagacttggtgacgagagtcaaccaggagttgtcgcaagaggaacagtttgatgagcaggaggcgtaccttgcattggaacaaatgcaggagaaaaactttatccaaatttcggaggaaaaggtgtactttatttaggactacgggttgctgtttcacggggttgtgttgttttcatattaggttaggtatagatagaattataaaatatcaattataataatcgctcgaatatatgatccactctgagtcgtatcgcattgccatttgcattaccatagaggtattgatcgggtctcataaactcttgaaactatgaccaaagatccccaagaagaaccatccgatgacaagccgctgtttggttccaccggcagaaaaatcatctacgacaaagacggcaaaccttgcagaagttgtaacactttactggatttcaaaatggcaggtggaagtttaatgggtgctttgtcaacaaaaaagccatctctggctaaagattctgttcctgagacctacaaacaagagcctccagacgtagaacagctgggaaagtcaacatggacatttttgcactcggttgcggcaacgtaccccgaatctccatcgccctctcaacaagatgacatgcgtcagttcatgaatatttttggaaagatttatccatgctggttttgtgccaaagattttcaaaaatggagctcaaagaatgagcccaaggtgaaaactcaggaagagttcggaagatggctatgcgatgcgcacaacgaggtaaatgcgaaactaggcaaaccaaagttcgattgcaacctgtggaagcagagatggaaagatggatgggacgagggtaaatgaaacttaatctgtaattagtagtttggaattcattttgtacatagtgaaccctattggttcaattcatcaatcaaacaaatgcagctaaattcaaaggaaccgaactgccacgtccactgggatacagtttctccttgccttcaaactttctaggctttgggagactatccttattgctgaaagaaaatctagagtcgtcaatctcaattctagaactgttttgcgactggccattcgatgccttatggatagcagaagtgtcgattgtgtaagcggatacatcaattgcacgtaacgatgcgccaacatgctgttgttcatcaactttcaaattagcactggattgggagtcggaatgaatcctgggtttgctttgagaggggggaggaggaggggccttcctggatacgcttccgctcgcatttcgcattggcggcggagagtttggaagttctggagcagctgttggaggtgcggagggaggagttggaggaggcggtagagaactttgacttggaggttctggaatcctaacaggtggcttttgtgtgcgtacaggcgtaggtatctccgctggtttcactattggcggtggcaaagttggtgccgcctgcgatggtatttcaggtgcagtaggaattgaaggggttggaatgcttggaacttgaggagcggtactatgtggaatttgaggggcggtactgtttggaagactaggtatctttggagctgattgtttgggaatgatgggagcattgacctggggtacgtgagggacctttggggagaacgatgaaggctccggggtattgctcatagtcgaatatccactctcgccgtcaacaacatgtacatcgtttctcttcttctgaatctcagctaagaatggcagtcctccacttaccggtggagttgttctcggagtcggagttgactgggtctttgaagaggatccaccaaagctttgtgttggtggtgctggtggtgctggaggtgccggtggtactggtggtgctggaggtgctggaggtgctggaggtgctggaggtgctgaaggtgctggaggtgctgaaggtgccggtggtgcatttgacttggacaatgctggaattgatggagcacctgaattcggtaattttggtgctggggggggaccagaacttggcaagggtggtgccggtggtgcacttgaacttggcaatggggggacaggtggagcaccagaattcggcaatggtggtgcattcaaaggagtatgagaaggtggaactgtgttaggtagttttggtgccgctggggccgtaggagcagctattgatggtaatggtggagcactggaacttgaaaccttggcagcttggcccctggaggattcttgtgccgtctctggagacgtatcgatcacatgtttatcagacctgttcttttgaatatcagcaagaaatggaagacctccaggtacagaaggtgctgcaggcgttgcaggggaaggttgtgaagtgggtggggctggaggggcaggaggtgccctagagcttggtaaaggaggtgccgctggaggtgcatcagatggtactcttgatttatttcttgaactggttgaaggccttctgggagcagttggagttgggactgctgggactgaagaattaggcaaaggtggtggagcagatggtgcaggaggagctgtggctgttggcaatatcggaggggcagcggaaggtaaaggcggcacacctcctgggatcgttggaacagtcttgttactggaaacccttccaggtctttgtttcggaacagttggagatggcggctgggcaggtgtttgatggttatttccacggcttacatgcctcaacttaggcattcccccagccaatatgtcacccaattggggagctccagtggggacagtgggaacagtagggcctccagatggaattgaaggggctggggagctcgtaccacctgcaaacccacctgattttttatccagaataggtttgcttttatctatcgtctgcgcctttctcaatttagcaccttttcttatgtcacctaagagtgcgtctctagctggaggtggtgcagcaggagatgaactgttcatgggacccccaggaggaggtggtggtggaggaggtgcagggggaccggccattgtctataataaagagggacaatatttatactaaggaaccaaaatgtcaaatcgtctagatgtgtttgccaatagttgtgtgcgactcaaaatcgaatatcttaaatattatgtaattaggaagaaattatgaacctccacacacaggacaggaaggcttcctttcatgtttgaaggtgtatgtaaatacgctctcgtctcctgagtacatcatgtagttgtccaaaattggattaacattagaaattagtttcagggcttcattgcaacaggaagcagcaatgatggcgtttgtagatgaaatagcaggaatgatattctttaccactcccaaagtcaaggacagagtgaccccttcaatatcaaaatgctttgctctttctagacttgttttgtacatccagtcaacttgtgacggatcgtctgcgtcaaaaggtttgtcaccaaatttcttgggccattccaactgatgtgcccattcgatacagtgttcgggaagtctcggagtgttcgctatcgtacacactggatatgttacatttgttgggatcatgtctagtgagcattcaaaacatgatgataacgtaggtaaaatcaaccttgattgaccccgaaacccctccgttcccccatctatcattggaattaacgatgaaaagtcatttggatctagcaaggtgactaatttatgatttatccacctccttgcctctgtgctgtccaaaccacagattaccagttggaattgcctgtagaacagatcgtctttatcttggatcctacaaaaatgaggagttatttgaacgttaggtatacggttcatgacaaactgggatgctaccttggccttgctttttccaatatctttatttcggaatagaaattgacgatttaaattggttaaatcaattgtatccatatcaataacatgaatatcctggaatcctgaaagactcagatttttgaggatttcacatcctaatcctcctgccccaattactaggatttttgaacttctgatggcattgaatgtttcttccgtattaggctcgtaaacatcgtctgtgaatggacccttcttctccgtaaatggtttgattgagttaatggacatgtatttggttcactgtaggttgggggctaaagaggaaagaaagcatgcttggctcgagtcgcgatgaataaaataaggtggatgcgagggatgagtgattgtatgcatacaaatctccaaaagttggaactgcttacttaattcgaagctggagagttttcttttcctggggcctttgtagaattgaaccgactcaattgcttctcctcgggtttatcgttggcagtgttttggttttgtgatcccagcttatgcctttttgccgtatctggaggaattccgatcattcgtttaggaccctgcttggactgactaagcacagatgtttgaaccattgtacgtctaatgggcattgatttcgtaggatctacagttcttcttaaagaaggagactggaatgatgggttgaacttttcttccacgttcaatggactattgttttggaccttctcggcaaccttggcagaaacaaattcaaccttggctgggattttatctggagtcagtaccatgttgtccataatctggggactattgggggcaatgaactgattttcaatattactcttggtaacagcgtcgacagcgtcacccttattttcaatctcatcgtcgtttacgttttcaatttctctctgagagttcttttgcatcagcaaatccatctcgtaatcatcaatttcattcataaagtcctcactatcgatgttgatttcatcgctgaacaaatgcgaatcgtcgtcttcattgtcaccaaaatgcttgggagggacattaattcttgacttgctgctgtttttagctttcttttgattaatctccagaagcttggcttcctgtttgagagttcgtgcctcaagctgattgtgtctcataagatcgccttcattaaatgtgatagcttgagttttaacgtttgaaatctttcgtaaatattccttgtcgtacagacaattacccaaagcattaccaaaacatctcaaaactctcttgagtccgtcggtgatagcctcttttctgcacttctcaaaagctatggccttggattttgcattttccacgcttccataaccaatatcctcatgaaaagaaccgtctttcaaggtgacccgaataacagacgaaagtcccattgaaattttgccatgctgagtatctacaaaatccactgtagtactcttaacttccgaatgccacccattaaagccaaagatgtgattggccaaactaatagcagtagtgccagagagatacgacactttcataccaccttggccaggtcttgtacaaataaactctggaccaagttgcttgtcgagctccttagatatgcgtttgagctcagcgtcatcgaaagacatggagtgtggtttgcaggaaagagagaacaaaggtggaacgcgttcgatagagtaaatatttgatgttcggtgcgcgttttcgatgcccctccacgcatacgggacaagtactaaagtcaccccttgcacggtttctccgttaggcggacattgctctgccctttagcctcgccgtgttctcaaaaattaattacttctcaagttgtcctctcctacactacaaacaatgaccatagaagatgccaaacccaaattaatctactacaaaacgatctttgaacaagtccaaagaaaacgtctgagctttgtgaacagaattgttgttttgttgacctttttctcgtcacttttcattggcatttttgcaggttcatcactttggttttggcctttgaaatggttattgctgggtgtttctttgatcctggtcaggcattgcaaggagtcaactcaaacgttggaaaatcctggtttcaaaacctttttcagacaaattctgggccagatattttgtgcagattttgtctcccatcttttggcatatggaatatcaggtttcacttactgggttatcttattctcacagaagagtgacgatcttacgtattatattatcactcccacaaggacagtgctaccttatatcaacgaccagtttgtgtacttttggttcttttttggcactttggtgctatggcaatcaattcaacaggcagtattcttgcgaaacaaactaaactttcaaattggtgtgtaccgcattgagccacgttcagaattcaatttgatcaacttcaccactgtcttgagtggatcattgacctcttcggttttggtctctctttcaacaccaattctatacgttttgtcaagatcttcagtttacaacgtattgttatatcctttctattgggttcttgggctgaatcacaacaggccacatttgaacatcggatttgggttattctgttccttgttttaccattctctcctgttgactttacagtgggagttcgtgaacctggtgtatgacatttatgtcagaatagggtgcatagataaagataaggcactttctctgcagtcagcagacccagtcaatacacttctcagtggcctcaaggatgtcaatcatccattcgtacagtttactgctttccaggaactggcctacattgcaacttcatctaaaccagaagatcgaaaactgttttattctgtccattctaagaactcctacgtttggaacacaatattggaagaatgcacttcatatatcaacgaaaatatcaaacacatcgagcgacgcatggtcgaatttgacgatattactaaatttcttcagcctcggcctgctgaaatcagtggtggcctaagaagatcagaactagcagttcccccaactatttttggcaactctaaacaccaggcatcttcagagggtactccagagtatgattctgcaaatgagatatttgcaacccctacgtctcctggaaagttgtcgtcacagttctactcacttgcccatgactacaataatatcgataatattcatttggttgtccaaccaatccaaaaggtcttacttggttattaccagctgctaatccaatcaagcatcggggtgcccttccgcaaaactctcagtagagaggctgccagtcgtgtcaaaaaccccgttttgttggggaacatcattatagcattttccactttcctcctgcactctcaaacggaagataaggttggagtagtcaaagggtctttggcccaggcgctagagatattggcaaagctgatatctgccacaggaaatttcacagatcatcctcctctgcctcctacaatgttagaaactgaacaaccaaaaactcatatcattgctataatacacgatctatccatgaaacaattttttgaactggctgtgaagttcaatcacgtcttgaacgatttgattttgtcaccaacagtcttcaaacttgctaaatggtctattgatacggccattgaagagcaaaagaaacaggaaactctacaaaaaaagcaaacattgaaagccactggtgtatccattctgcattgaaggagggcgtaaactggtttgtaaaatatataattcatagatagaacaggcgttgtcattaggaataatccacttagtcctctattttgtccttgctgttgttgttttcagttagattatctaacaaaactggctttaacacttgttcgtcaaagtgtgtaaaccatttggcatggtcgtccatactcaatagattgttgaaactcatgctttggaggtttattttactggattgtgcctggttcgccataggtgggatgtcatccaagtcactggtcatctcatcatcgttcatatctggtggagcatcagccgcatcctcatcctcattgttgtaaaagctctgctgagaacctgttcgggaccttgaacctgctgcatcagaatatatggaatagacaggagttgttgccccagggataatttggttcagctgcattggttttggagcttctatatcaaactcatcatcactttcctgttcgtcgataacaccaactcgaatattcagggtttccaacataccagcagttgtcccaccaaacaaaataacggtcaataccacaaccactagtacagtggctagtagagaagacttagcttcaccttgcaatcccatagcaagtgcgacaccgactgcacctctcaagccggcccaaaagatcatcatttggtaatttggcgggatctcatcctgggtataattgattgctgaggaaccacctttgtgtttagctcttgtagtccaattgatcagtcgtgaaagtgggaaaacggcacaccatctggaaatgcagatagagattgtggtcacaataatcagcatgggtctgaatactagttcaacttctgtaaacagggacaatcctaagtaaatgaaaatgaaattttcactcagctgggccaacaactggaaaatgtacttggtagcaatctgagtccttctggacatgttgaagtatgcataatgtttcatcgtaataccgcagaatagaagagacacaattccagacatgtggcaaccattggagaagaaataggattcgtatgcgaaaagcaacacgagacatgtttcgatttgagggtaccttctgatgagggaatgttttaggaccaaggcaataaatacaccgacgacaaccccaatcaacaatgaaacagtgaatgtcataagaaagagaccaatacctttgagcacgctgctaacgctgactgcctgaccgtggaacttctggcacgtttcaaacatcacgatacagatagcgtcgtttagcaatgattcaccgaaaatgatagtgtacaactttgggtcgaccttgtaggaattgaaaatagacaaaatagttactggatccgtggctgaaagggtagcgccaacagataaagcatcaaccaaggatacatcaattccatccagacccaacttggtccaaataaacaagatgacacccagcacaatcgcactgataaacgtacctggaatagcaaaagtcagaattgagccgatgtttcgaaaaaaattagcctgatgcaactcataaccactattcaagatgataggaggcagcaagaaattaaagaaataacctgaattgaacttaaccgcgtcttgaatgtagtggccaggagtgaccctcagtatcaaccccacaaacattccatagaagatcgataatactgtttcgtgaattgacttgaccctcctttgctgcaaatagtaagacgaccatagagcggagacgacgagcaacaagacaatgaacaaagcccaagacgagaagatctcttcagtcagcggattggtttcctcttcaggagcttcgggcccgacgagcaccggattctcatctgtgggatcagttatttcattggcaagtatctgtctcgcaaagaataaagccaacaatcggatcatgaaagtgctgatgaattggtaagtttcctggatggctatctcgtagcgacttcatacactatatcggtattagtagtgtgttaaccataacgtgcggataataagttctgttacggagaggacggttttcttataaaaaggtgattatttgtgatatataaactgtataattgtattatagggatgtcttgtcattggaaagaaaattgcggttcatcaaaggtcatcagaggtactgttatcattacattattatgaattcttatttatatattgcatggacggattatttctcgaatatgattattttgataacgataatcaactttataattaataataattaaagttaacataaagaaaaatgccagatgaagtggacctgttgcaaaaggaggagaacgagctgacacgagagaaggaaattggcaggattctttccactttcaaattggacagctatgccatcttggatttgaaaccaggttgttctccggaagatataagaaagactttccgcaaaaagtctttgctgatccatccagacaagactccgaataaacgagctccagatgcttttgacaccctgaaaaaggcccatgctaaccttgtggatgactcgattagggagcaactggattcctcgtatgccgaagcacgtagattattgataagagaaagaaagtggaacattgatgatgcccggttgaattcatccagttttttggtggattggagagagaaaatcaaagaactgctcttggaagaagaactgctgaaaaggcttgaaaaaaacgaaagatggaggaagaaggccaagtgcaacagaagaaagaagaacaattgaaggaaacagaaggcaagaggttgcagcaacagaaatgggaagatactagagagtcgagagtgcaaaactggaggtctttcgttaaaaagaagaggaagaaatctaaagatgtattggcatgattacataaattcctacttacgtcctccgttcattgatcgttttcttcggattcactttgattctcgtctctggccaacctatcggtccagattttctcagcctccaagatggtgttattgttggatctcattttgttcatggtttcgatgtactcgtcataggggtcagaatcgtagacaattccacctccggcttgaaggtaagcgacaccgtccttgacgaccattgttcttaaggcaatacatgtgtccatcgattttccatcgtacgaccagtgtcctacggcccccgcataaacacctctcttttctccttccaattctcctatgagttgcattgctcttaccttcggagcaccggagacggtacctgctgggaaaatggatctgaaagcatcgaagcgagtcttgtttggtctcaatgttccactgacttctgacacaagatgcatcacatgagaaaatctctccacagtcaataaacgatcaaccgtggtactggtgggctcacacacacggttaatatcatttctggccaaatctaccagcatgacgtgctcggccctgtctttcaaagacgacttcaattgcttagcataattgtcgtcctcttcgatagttttacctctgggaagagttccagcaataggatgtgtgatgattttgttgttgttgtcggatttaactagtaattcaggtgaagcaccaacaacttggaagtctagatagtcaatatagaacatgtatggagaaggattgacagttctcaaatgacgatagatgttgaaagggtgcaatgaggtcggcctggctaccctttgagagggaacagcttggaagatgtctcctttcagaatatgttctttcagcttgcgaacatggttttcatacccttcctgaccaatattagaggtgaacgtttggccttgaataatatctttctgttcatagtagggaacagttttattgtcaaataccactttactgatcttttccacttcttctcttgtcttataatatttctcaagaatagcttcgtccgagtcatcaacggatagagaaacgtttccaattacctggaatctttgataaacattgtcaaaagccacgatcgtgtcgaacaacatcaaagctgcttccggaagttgcaaaacatctttcagttttctttcagtttttggttcaaagtacttaatacaatcgtacgagatgtatcctatggcaccaccacttagacgaggaataccaggaagttgcgcttgtctggtgcccttcagttctttttccagaagcaccaaggggtcaacttcagcaccctctaaaggcccagtcttgattatttttctgggggaatgtcccataaaggtgtacctgtcaacggtgtcaccattcttcgcactttcaagcaagaaacttggactgggagtttctgaactgttggtaagcttgatataagccagatgaggcgttaagaagtctgattggatgaacttgtaaatggggtaaagattaggaactgtctcaggactgtgactttggcgatcattcttcacaatatccagaaaggattctgctgaagggtgtatctgctttgttagttgcgttccaaaataatctgttgcaagatgactatcacttacactcataggctagagagttgggctcaagggtgatgatctgtcagaagaaatccagatatttttcatgagtcaagaagatgcccttgagctttcgcgaagagggaaaagaaatacgctacaggtaaatggttagtagtatatagtaattgagaaaccttttatttccatctttggacaacaacagcgtttatgagtccagcatccttgagtgtgtcctcattgttctcaataggtttcaccgggaaagctagagaaagcacaaattctctggcggagggactatgttcattgacaaatgcatataattgagcaacagaatcagtagaattgaatctatgaacaattctctgaccattggcgagtctaatctgaacgggagaatccccagttcccagctgctcggcctcctccttttgcttttcctcctcagcttcctcttgtgtttcttgttgcacctcaggagattgactgagctttatgtcgcccggtactggagaccctaatctctgacctttaccttgaaagccaactcgggctttcttaggaggagtgaaatttttttctatctttttatgcactgtgacatctacctcttgcccaatctcgacatctagaagagccagtggtgcccttccagcgttcaagtcggctagatatcttgcgtttgcagggtcatcatatctgtataaatctccgtctccaacttggaatccgtccttccaaaatgttatctgtcggctgactttctgagctcttcttattcttgaggcagggtcagacacaacttcggagggactgtccgtactgcccagcttgtggccagttccaacaaattgtctagcaggagcttcttcatggggccttgtatctggttgttggccagtttcctcagctttcttcaaaagatcattgaccaacccaaaagggtccccacgtttgtctgggttctcaacttgaagaccggacttttcaccacctgtgaaaagattgttgtccccatttgagttgctatttaggtcgttgaaagttctgatcttgggccctgcagaagcctttgtttgattgactggacgttctgatttacccttgcccttctcattctccagttgagaggaataataatcattgactgccgcttcaaagtcatcagtctcctctaggtactgaattgcttggaaggcagaggctcccgttacttctatgaatttgttgatagtctctgagtcaaccattttaatagggttcaaaaaggagttgccactagaaatctagcgaagtgatatctgaagggcccacggttttgctgggaggaatcgtgggtccgttcctgctctcgaactggtgaagtgagtcttccctgcgtctgcctgtccactctacactacaagactaattttcctacagatcacaaaagtagtaataaactttaattaaccgatgttgaaatcccccctataacacataatacaaacgatcgtctagaaagaagtaattgaacaaaatgataatgattcaaatatgatcattatatgcaaaacattaatgttgaataaatgcagcatgtaatcaatacgcaaagaatttattcaggcttaattctgagcgtacttttcacggtaggtcttagcagcttcaaccatattagtcaaagaggctctgacctcctcccagcctctggtcttcaaaccacagtcagggttgacccagaacttgtcagctgggtacaccttaagaatctcaccaattctggcaatgaactcctccttggaaggaattcttggagagtggatgtcaaacaaacccaatccgatgtggttagggtagttagagaactcttgaatgtagttaggatcatctttcttagagaactcaatagagacaacgtcagcgtccaaagccttgatatggttaggatccaaatcagagtaacagaagtgagagtggatctgagtagtgttcttgacaccggaagtagcaattctgaaagattcagcagcgtatttcaagtagtcagatctttcttgaccgcttctcaatggcaaaccttctctaatagctggctcgtcaacttgaataacttcgacacttgcggcctctaagtcgttaacttcatctctcagagcaagacccaattgcagagcttgaaccttttgggaaacgtcgtttcttgggaaagaccatctcaagacggtgataggaccagtcaacatacccttcataggcttcttagtgatggactgagcgtaaacagactccttgacagacatggcatgaggtctagaaacgtcaccgacaaccacaggtggtctaacgtaacgagaaccgtaagattggacccaaccattggtggtgaaggcaaaacccttcagctgctcaccaaagtattgaaccatatcgtttctctctggttcaccgtggacaagaacatccaaaccaatctcctcctggaatctgacgactttctcaatctcagatttgatgaaagtgtcatattgctcagcagtgatttcacccttggtgaacttgtttctgttgattctgatatccttagtctgtgggaaagaaccaatggtggtggttgggaacaaaggcaagttgaacttgcccttttgagcagccaatctttcagggaaagcagcagctctggaagataacttctcattgatggagtcaaccttcttttgaacatcagcatcgttagtgatagcagagtcctttctagacttgatggcagcggcatttacagacaaagcctccttgacatcctcaccagatacagccttggcgacgacaacaacctcatccaacttttgggtagcaaacgaaaaccagttcttgatctcggagtccagcttcttttcgttggtcaagtcaactggtgtgtgcaacaaagaggaagaggtggcaacaataactctgtccttacccaaagcagcaatagccttttcaacgaaagcaacagcctcggagaaatcagctttccagatgtttctaccgtcaatgataccgacggacaaaacttgctcagctgtcaatgcggcaacaacttcgtcgaattgctctggagctctgacaaagtcaaagtggaaaccgtggactggtaaacccttgatagaagccaagtttggtctgacatcaccgaagtaggaggcaacaaccaactttggaatgttcttagcattggcaaggtattcataagcagtcttgaaagcagcttgaaccttctctgggagatctaaaaccaggattggctcatcgatttgcacggaagtggcaccagcagcggacagcttggccagtagttcagcgtagacaggcaaaatcttctccaaaagagagattggctccaagtcaagagagtctttgtcagccttacccaagaacaggtaagaaactggaccaacaacaactggtctagtctcaattccaagtttcttggcctctaagtactcgtcaactggcttttgaccattcagcttgaactcagtggagtgagagaaagtgggtctgacgtagtggtagttagaatcaaaccatttaaccatctccaaagcggtgacatcaacagccttctcggagtcggtggcctttctttgtaaacctctacccatggcgaatagggtgtcaattgggtccaactcgtacttagtgtatctctctggaatagcgttaaacagaagagacaggtcaagaacttggtcgtagtaggagaagtcgttggaagcaatgacatcgacaccagcagccttttgcagcttccagttgttctctctgatctcctttccgactttgaaaagctcgtcttttccgaccttaccagaccagtaggcctcggtggtcttctttaattctctaaaggcaccgatacgtgggaaacctaagacagatgattgaaccattttagtaataattgaactactagttgtttgggaaacaattacaggaagcaaggacaagtgggcggtcggatccttttatatacgtagtggaggtgtcgcccaacaaacgaattgaaaatttttgcacgtgaacatcgaccattgacagagtcaatgaaatattattgtctatacgaagataaacgaaagaatacatggactgtcacgtggcatctcgtgctttgatctgcatctgaagcgcgctcggggttcgaaagaggcaagagagtgcgcaaagctggtggacaaaacttaaagggcgtagcttgctggaatcgagcaagtgaccgatgtgaacctgggaggtttgatcagtacacgtcctgccaggtaggcatttcgttatcatttagctctcacttgtcaaacatctcagaggaacccaatgtcgaactactcccaaacaaggtcccaagcgttgcaattggagaacaagacagagtcgctactgtctcaatatgcgtcttttggccaatcatcgtctagttctgccacaggcgaagaattgtcgttggagaaggcgttaaaggatatcctggaacgaaggcaggaattggtcaatgccttgagccgaatcgcagattcggatgacactcttgccgcttccaaactacagcaattacacagacataaagagatacttaatgaccataaacgtgattttggccgcattcaggagtcaattcaacaggagcggaacaaactaaaccttctattctctgttaggtctgacatacaggagcacaagaaacgctctcacacaagcaacgtcgatagcctgaatgaagaagagtacatgagacaagagcgcaatcgggtggataatgttaactcgtttgctgacagattactatcacaggcgtacgaaactcgggacgaattttctagacaacgacacattttgaacaatgctgcgtccagaatttctgaatcagtatcgcaaatgcccggcatcaacgtcatcgtctcaaaaatcaacactcggagaaaaagggactcgctaatcatagctggcttgatcacgatgtgtataatattactatggctttctttgtgaaacacaatagcgcagttttctctaatgcaattgaagctaccaagtaaggttgcttctccttgtcatggtctctgatggccgtctatacttgtattcatagtagtcctacttacatcgtcttacctaatacacttttttctcaagagtccctacccgcgcgcggcttttcgctgcgtgtttccactatcttccagccacccttgcgatcgcgagtttctctgatatcgagtatctaaaaacataatacataccccaatctaacgcctctataagacaactcactgcctaactctgattctctatcttgtttttcatattgacactgcactcagcacaaagaaaaaggcagcattttaaggattaggtaatctttgatatttctaacacgatgacagaactactggagttgctaaaggatccagttcggtttcaccaagattccgaatccataaggctcaaggccttagcacacataacagaacagaacacatcgatcgctagactggagacccagctggaaagcgcaaagagcgccaacaaggcgttccaacaggcactgggggagatcggaacggtcgttatctccgtcgcaatgggtgatctttccaagaaggttcaagttcaccctgtggagagcgaccctgagatattgaaggtgaagatcacgattaacactatgatggaccagctacagacgtttgccaacgaagtcacgaaagttgccacggaggtggcaagtggagagctgggcgggcaggccaaaaacgagggcacagttggagtttggagatctctgaccgacaatgttaatattatggcacttaatctaacgaatcaagtgagagagatagctgatgttaccagggctgtggccacaggtgatctttctagaaagatcaacgttcacgctcaaggtgagattctacaattgcaaatgacaatcaacacaatggtggaccaactgcgaacatttgcatttgaggtcacccgtgttgccagagaaactggtgtagaaggtcgactaggaggtcaggctagaatcaataatgtcgaaggtatctggaaagaattaaccgataatgtaaatgccatggccttgaatcttacaaaccaggtcagaaatatagcgaacgtcacaaccgctgttgccaaaggtgacttgtccaaaaaagtgactgccgattgtaaaggtgaaattttggacctaaagctgactatcaaccagatggtggatagacttcaaacttttgccctggaagtcaccacattagcaacagaggttggtacagatgggatcttaggcggccaagctaatgttagagatgtagaaggtgcctggaaagctgtcacagagaacgtaaatattatggcggctaatttgacaaaccaagttagatctattgctacagtcaccactgctgttgcccacggtgacttgtctcaaaagattgctgtggaggctcaaggggaaattctgcaactgaaaaataccatcaataagatggtggactccctgcaagtattcgcatctgaggtcaccagggtggcgaaggatgtcggaatagacggaaaattaggagtgcaagcccaagtgtcagacgtcgacggtctatggaaagaaatcaccactaatgtcaacacaatggctgcaaatttaacctcacaagttagagcatttgcacaaattacagctgcagctacagatggagacttcactcgtttcatcacggttgaagcaagtggagaaatggacgctttgaaaactaagattaatcagatggttctcaatttgagggaatcaatccagcgaaacacagcggctagagaagctgctgaacttgccaatagtgccaaatcggaattccttgccaacatgtcgcacgagatcagaactcctatgaatggtatcatcggtatgacccaattgactttggagacagaattgacacagtatcaaagagaaatgttgtctattgtgcacaacttagcaaactcccttctcacaattatagatgatattcttgatatttcaaagattgaggccaatagaatgacagtagaacagatagccttttctttgagaggaaccgtttttggagctcttaaaacattagctgttaaggcgattgaaaagcagcttgatctcatttaccaagtcgataattcattccctgataatttgattggagattccttcagattacgacaagttattctaaacttggcggggaatgctattaagtttacgactcatggaaaagtgacactgacggttaaaaaggccgctagaattgtcagtaacaacgatgaaaaactactactagagttttgcgtcagtgatacaggaattggaattgaggaagataagctaggcttgatttttgacactttctgccaagctgatggatccactactagaaagtttggtggaaccggattaggtctgtcaatttccaagcaattgattcacctgatgggaggtgaaatctgggtcacttccggctatggcgcaggttctaacttctttttcacaattgctgtttcgccggccaagattgaattatccagacagatcgaagctttggcaccttttgctcagcaccaaatcttatttatatctaccgaacatgatgaagagaccagaaaccagattaaagagcatatcgctttactgcaacttgagccagtggtcattagttctatcgatgacgcccaatacaaggacttcgtaccttatgacatcataattatagactctattgaaataggcatggagctcagacacttaccagaaatcaagaacatacctttggttttgctgaatccgtcagtaccgtcactgaacatgagagtgtgcttggatcttggtatcacatcatacggaaacacaccatgctccgttatcgatttagcatctatcttgatgcctgctttggaatcaagagcctcgccatccaattccgacggatcacaatcatacaatatcctcctagccgaggataatttgatcaatcagaagcttgctgttagaatattagagaaacatggacacaaagtggaagttgtagaaaatggtctagaggcgtttaatgcagtcaaaaagaatagatatgatgttgttcttatggatgtgcagatgcctatcatgggaggattcgaagctactgcgaatatcagagactgggagagaaagagtaatccagttgacgtactcggttttaggacgccgatcattgctttgacagctcacgctatgttgggtgatagagaacgctgcctaaaggcccaaatggatgagtatctttccaagcctttgaagccaactgtattgttacagacaataagcaagtgtattcacaacatcaatcaactcaaggaactatccaagaaaaacgttagcagtaggaacaccacattctctgaagactttgatatcaacgctgttatgtctcctaacagcactggtgggcagctgtactcagttaacaatagggtgaacgaaatccacggtaactttttagacggccgctcaaattttgcccacataccgctggaaaaccgagaaactgttagtactactaccaccttaggcgctacagttgccaaagccaagaagccttccaggaatcaacctgttgtcaagccaccttcgatctcagccatctatgatgcgtcatcaattgacgaactgacaggaagctcgttaatcgccgagtcgagtcccgaatagagaaaccaagtagatcaaactcgtaggatgagtttgtcccaattatgactttattttcattaatgtattgaatttaataaataagtttaccacaccatatcattccacctttctaactcctctgcctgatgtatgatatcctttttggccttcgttctcatgtagaatatagggcaatcattatttgaacaaagcacttcttgatggagtgaaccttgacaacgttgacattcggtccataacttactgaatttggtttccaaagagttcatcagtgacagcgcttctccatataggcttccagctttatccatgcagttgttacacagcgcagcatttccattgggggatttgcaattggactttgttaacggacttttacaattcttgcaagtattggtcttttttgcaaacctcataaggccaccagtctttggagctgcgacaaagacagttcgggtgtgtgatccactcaacaatgccttagctcgtcgttctcctaaaataggttcaaagattctggtcaacggtttggccaactggttctcgaggtaatagttagtgtcaataggtaacgaatgctccaggacatataggggatcttcagatttctcataattcttagtgctgctggtttttataatgacgtaggccactctgtcacctagcgttggagctgaaccagcatctctcttgcgcattcgttctgccagctcaacatgtgcttgctttcctgcatagtcttgtcttgaaagagcttttgtaatcactagttgagataaatctactctatcttgcaaaaggtcggcgatagtttgcttgacaaagttttcggcaccttcgacgtctcgtagttccagcatgtactctaaaactttggtaataacgttctgaaccaatctgcaattgtctcttcgcacagtttctatacctttggtgtccatcttgtcatatttgtcaggatttgtccagtaaagcccagcatacctcttcttattgatcagtaggtacgggaagtataccttttcaaattctagtttaatcgggttcttgaagatggttgacacaaaagctgcagcttcctctccaagcttcatgcattttctaagatcattttcaccaaacttcaccatgacggagtcagtatcaccatagattacctgggcatcatgatcgtaaccatttttaatggtgtatctttcttgaacagcttgcttggtggcttcaatcatttctctaccaaacgcggtcacagaggatgagatagctaaacaaggcagtttaccaatagtagcaccagtgaaaccatagacagagtttgccgaaatcttcaaagcaagttgtctaccattaaggacctgtttcttgaacggatcagtctctgttttcaggtcatatttggccttctttctagcagctaaaagttcttgcaaaattgttggcaaaataccttttcttagatcctctttgacaaaaaagtctccgttgggtgttaaaatgtaatccttatctttgacaagacccagccggtctattgttggtttattcagtaacgttgtgtaacacaagttatgggccatcatgatggagggatacagagaagcaaaatccaaagttgcgactggaacatcgtagtaaccacgaacaggatcaatgactgtagcaccttcgtactcttcattgaccgaatcgctcttcatgtttggaatgacgatatctaattctaagcatttacggaacagttgagaaatgaccttgatttgctgacctctactaagcaagaatgagaaaggaactcctgtgactctagccatctcggtataattgaccaaacacatcaacttctcagccagtcgtaaaggaagatacgcatctttcaaacaataaactgccaacctccttctggtttccgcgtccccgttctgtaaatctgtaatgatggaatgttgaacatcttctttttgttcgcccaaaaagtgtgaagagacagaattcagggtatacgatctcagcttgtactctctttgtataaattgaagcaaatctagttgcatccttccatcaatgttgacgactttattttctctcgttccatatgctttggaactgaatgttgagtctttgatttcttgctttgaggtcttaacacgactgaaaaatggaaaatcttggacttttaatgtagcagctctatttatcaaatatgggaaatcaaagttggcgatgttgtaaccgatgatgacatctgggtcaactttgataataaagtccctccattttcgaagcaattcctcctctttttcaaaagaaaatatttgagagcccacaatcggggcacatgaattgactgtgaatacgtttcttacgaatggagtagattcacctgtgcgagaaacgacattagcaatctgaatgaccgggtcatgctctggctctgggaaaatacctttgcgtccagcgcactcaatatcaaaggacaaaattcgtaatggcgcaatcttactgaactctccttctatgggtagtgaaacaagatctctgtagtcaacagaaagctctaattggcaagttgatacctgttgagaaggtggaaccagagtatattttgaagcttgcaacttgatccagcacataccgctgacttttgtgtccaccatcattctcaaaaggtactgaatattatcaaatgtgatggacccgttgggagggaacgcatcgttgtattgaatactaccattctcaaacccagttctcactctggagatcaatcgggagttactcattatgatcttcaagaaaggtagctttgtattattgttgtaaccccaaattgactctttgaaggaaatttcaatcgtgttgaccccaacgtattcatctttcaagtagttggtgaaccccggtagatcagactccttgagagccttgggcatgccaacatagaaataatggtcaaaaccagtgacattacagagcaccgtgttacccgcgtccgtgacaccaaaaaatcttgctgaagagtgcccatttacatgagatatctcctcagcatccaactgctgaaatataatgtcatctttctttggatcaaattttggcaattcgggtctagaccagttctgaatttggatttcctcactcttggacgtggcttcgttgtccatgtcctccaactccttgatgaaggttgaaggttcattgtccacttgagaggaggtcatcttagtatggaacgagttgctctggtggccaggcaactgatagccattgatgtcacgattggcaactgggatggaatgtgccgtctcgtggtagtcttccagcttaactctctttgcctctgactcctggctgagctgttctggcatagtgtgaggaagatttctaataaacgagagaaggacgcgctaagaagacaactttaaggtgaatcaggttaccttagatgcacgcgttttggttttattttatcgctgtgctttgccgggcaccggctccagtattacataagcgaagggcgcttatgaacattagacttaagtaatcacattaaccacctgaaatccttatcacaagacccactaactccgtggcaacatgtttaacttcgacggatcaaccaagaggcggaatgtaaaccttagtgggagaaggaataatcttgaaagcagagagcaactgcttcatagagccgaattggagaggaatagacggaaggaggccaaattgcaagataagagtgtgaggataattcagagttatatccgtactttcttattacgaagtcatatcagcttagaatttgaaaagatatggctgcattgtgggagcgacgttacagccttgaatatgtttgcatttttctgtccgaacctggttttgaaacgggatgaggcatggttacaggtccaactggatcacgttagtaagcttctgttgtcctcgcatggctctatttcttttcttctcaggaatgcactggtggaagtattgttcaagacttccaaacagggaagatcacctcttcctatgctgaaactagtgaactccttatcacatgagtttgccattgagtggattcaaagaaaagatttgatggaaaagttggtcgacagacttggagaaaatgaagagttggatttgcaagtattaaaattcactttcaacttcagacacaacgatatggaaacgttcgcaatggcattcatcaacatagttcaaaaagctaacttgaatgatgaggcaaagcaactcatcagggagcagttctctcgtcccagctcattctaccttcagcttccaaattcattgttcttcctgtacctgctatcggtcatcacaatatggaagaagtatggtggggttgagaatcttgatatcttcttggcgcaggaactctcaagtgcagtagagaaaatgcaagaactgaaattttgctttgaaaatgagttatctcaagatctctcactgaatagggatgctgaccttgatggtagaaaaaaattgatcataactactggttccaaagaagctttactgtatctttactccccagactaccagaccaagatttccaatttgcctaatgtgtcgactgaatttctctctaacttttactactcgttactggtgcctatagatacaggaagtccacagaatgaagaaattttaaattcattattgatatctgtcgttgttaacggactaccccatggaattctccactattggttacagcaaatagtttctagcgatatcttccgcatggaagatggaaattgggaactgaacaagccaattctgactggctgttccgttgaactatggcagactctgcatatatttcttgatgtttacttttatgttctcaacatgtctagtgacagtgttatctttgaccaggaccgagggaggctaccaagggatgaatttttaaaggttgtttcttttttgaaaggtctttgcataacgctggttctcaaagacaaggagctaaaaccgagtttgccgtctagtaccagggtaatgtacgacaagacactggtagtagctctgaagctactgcatcaaatttatctcagaaatttgagattatcttttgtttctgaagaatattggctgtgtgatcttagtctttccattgagcaaattgttcctgtattatatgaacgagatatatccatatcgaacaatgccgatttcgacttggatccagacactagtgaacatttgaatttagaatcagatttttctcagctttacggactaaactcaactcgttacatgaaacttccgtctagtgttttagcagctttgaaagttctgaagtttcttcccttcatgttctcgtttacaactagagccacaatattgcatcagctgataagacaatctcaggaaatacgagacacatatggtggaatgaatcgtattcagggtacaatctcaagagataacatcatagaggatggatttgcccttctttcaaaattaactggagagcagctaaagaattatttaggtattcagtttaccaaccaatttggagcagaggcaggaatagacggaggggggcttacgaaagagtttctaactgaaacagtcaaaaagggatttgctacaacaaatgagtcaggagtggaagatctgatgctttttaagcacagtcctagaaatgagatttatccgaaccctgcactttacttgaaaagaactaagggagtagatgttcacaaagatctagaaatgattcgttatttgggttcaatcgttggaaagtgtttatacgaaaagattttagttgacttgccgttttcgccttttttcttaaccagatggtcggttaatcaaccatacaagacaatgtttgatgacctgaaatattatgacgaagatctatttcgcaatttgaacaaattgctttcattaaactcagatcaggtcgatgcattggagctgaatttcactctaactgagagattttattacaatggagcatttaaaacaactacaatcatgcttctacctaacggtgctaatataccagtgaccactgcgaacaggttacagtacgtattcgcagtgtccaacttcaagctatacacatcactaaggttgcagactgactattttcttcaaggtctgttcaaggtgattccctcgcaatggctggaagttttcaatccaatggagctgcaaatcttagtgtcagggagagatagaggaatagacatttcagatttgagaaagaatactgtcttttcagagtataccgagaatgaccagactatcattgatttgttcgatattttagagcacgatttttctaacgaggaacgttcaaagttcatcagattcgttacctccagttcgaaagcacctctgctgggcttttcacaactgaacccaaagtttggcgtaagaaatataggccctttttctgacagacttccttccgcgtttacctgttttaatcagcttaagcttcccgattacggaaacagaaaagtcctcaaagaaaagctactttacgcaatcagctccgaatcaggattcgatcttagttaggcaaatccaataacctgattacataatgacaccgatatagaccttcataaaaaacagttagcgcgatggattagttcttcactatgacgtctcgtattaaagtaagtgaaatgcctttcattcatttgtgctcgtatgctgtgaattagaaaccattactaactataggctcttgacatagatgtggtgaacaagattgccgctggggagatcattgtggctccagaaaatgccctgaaagagctactagaaaacgcgattgacgccaaatctacatcgattgacattatcatccaagatggagggctaaagctgctacaaatgacagataacggtgttggaatctataaggaagatctaccgattctttgtgaaaggttcactacctcaaagttgagcacttttgaagatctgaactccattggaacttatggtttcagaggagaagctttggcatcgatttcacacatatccaggctgactgtgactaccaaaacgaaagattccgcatgtgcatatcgtgccatctatcaagagggaagaatggtgggagagcctaagccagtggcaggtaaagatggaacgcaaatactgatcgaagatcttttctacaatgttccctccagacttcggtcattgaagggtggaaacgaacaattgtcaaaaattctggacgtcgtagcaagatatgcaattaacacagatggggtcgcgttctctgtgaaaaaggccggtgatactttgaacctactagcagtgcgggcgaacaactccaccaaagataaagtgaggacagtttttggaagtgctgtagccagcgagttgttaccaattgccgttgagaagagcgaagaaataggtctactatcttgcgaaggtcagattacaaatactagttattatagcaagaaatctgtgtcccctatatttttcatcaatgggagattagtcagttgcgatccacttaaacgaatgatcacacagctctactcatcattcttacctaaaggacataagccttttgtttatttgcgcatagatattaagagggaaaatctggatgtcaatgtccaccccacgaaacgggaggttcgttttctttttgaagatgaaatatttcaagttatcttccagtctattcaagccaaattaggcagtcttgatcattccagaaaatttgtaacaactcagagtgttttaaaacaccagtatgctcctcaagaggaaatcaccaagaagccccagacgctgttaagaacagacgatcttcagtctaagataacggcattcattaacacaaccaacaccgagtcatttggaactattgtcaaggatagagtcacagtaaaactttccagtattctggagctccgccaacagctggagaataaagtatcagaggatctgacaaacatgtttgcaaagcatacatacgtcggtctagtcgacccaaatagacgtttgtgctgcattcagtacgatgtgaagctttttttggtagattatgcttctatctcctacgagctgatctaccagattgggttgagtgattttaataatttcggaaccctttacttggagtctgagaaacccataactatacgagaactgctagaaattgtctatgaatccattgacacaagcgtacctcccattgacgatgtcttggaagctctctttgaaatgaaggacatgctattagagtacttttccatcgagttacaaggcacagagaaggatccaatacttaggtccctgcccatagttatcaaaggttacacaccctccattggcaagcttcccctgttttggtatcgattaggtaccaaagttgattggtcatcggagaaggaatgtctagatggcattttgaggcaaattgcattattgtacgtcccagaagtatctgaggcagaaggtatagaaaagattctggaagacctgatattcccaacgataaagagtcggctgctggcggtcgacagcctttccaagagcgttgtggaaattgccaatcttcctggattatacaaggtttttgagcgatgttagataattaatgcattgtggttctattcaactgatgactatatatacattgttatagctgattcgtccatctcttttctttctatagtacaatttccattctaatctaatgcagttccttcgagcatgtcatctagcgttcgaagcgatacctggtataatagtagcatgattgagctctgtacagaggtccaaatgaatctagggccaactccagaaaaaagccccaaagcaccttcatgtttgtaaaccattagcaagctgctcaagatagagggggacgataaaataataggcttgccggaagaggaagacgagacggttgacgctgcattttgggtctgaatcctggtcttaataacgtccaagggagtagtgagtgttccagctaaacccccagcagcagctcccgttgccagctcccataagacagagagatcatgatggttggcgctactgacacgaagagcccagctccgaaatttttcataaaaggcgaactgtaaagcggaaaacggtaaatctctgaccaaagtcgccttgtaaccgaaaaacagagtctgccagccttcagatttaataatagatgttatagcatgcgctgtgcttttatagttatatccggaatgaaaataagggttgttgtaccttccttgaagttgtagccttgttttgaggacttcactggggacatagaaaacactggaaaaaaaatcaccaagaaatccggctaccaaatgagtggcagtttcgttacaattccacctgcctatcattaatcttttcactgattcatacgttccgaagaacactgccgtactggggaatgagcctaacatggctgcaccgtagcctccgtacaatccacgcctaaaaccttcctgcctgaagatagtggcgtacgctgaggtcatattcttgtaaacggccacagtaggggctccttgttgccttgtttttactgtatctaacgaatgcattgtggagtctcctaccatccctccgatccctccggccacgatgcaatgccataacggcgaagactcgttggaagggccttcttcttcttgaagtatggtatgaggctttatataatggtcattttcgaaccccaacggcagacttgcggtgttgtacttctccatgttatgaccatccacctagtaaacaaaaattttcgacccttgattggacacttcgccgcgatgccttaagatgcgaagtggaaacgcgagacggagatattaactcgttttcatgagaaccgattctgctggtgcagggaggtattttttttaacatcaagaccacgcataactctgcctagagatgaaatagatgcttcgacgactcagatgcgggataaggacatataaggtgctcgctatagagagttcatgcgacgattcatgtgtgtcgttgatcgacaggagtgccggtgctaaaccgattgttctagatcacgtcaagagtactctcaactcagtcaaagccggaggtgttataccgactagcgcacatctacatcaccagaagagtatagcagggttggtcaaacaagttctacagaagcacaatataagtggtgtaaattgtccggagctggtctgcgtaactagaggtcctggaatgcctggatccctcagcattggagtagacactgccaaagggctttcagttgcctggggaagccaatttttaggtgttcaccacatgctaggtcatttactgatacctagactggagagcaatggggaggagcctcagtttccatttctcagtctcttggctagtgggggtcacactatgttggtcctatccagaagtttgcttgatcatgaaatactggtaaacaccattgatatagctgctggagatgccctggacaagtgtgccagagaaattggcattcggggcaacatgatcggtaaagaactcgagttgtttctaaacaaaaacccacagctaagcttgaaagacataccttgggaaatgcctcagcctttaaaaaataaacccaagagagtggacactctggggttttcatttacaccatttattagcggtgtgaaattgtccctagaaagatatcacaacaacgaagtcaaagacgagctgatgccagccatggggttcagaatacaggaagcaatattcgaccacataattgatcgcgttcttgtggcttataaagttcgtccagagttgaaccaaattaagacttttgttggctcgggtggagtagtagccaatcaacgtctacgagtaaagctgcaagcagctttgaaaagtcatggtgttgaaaatttccatttcccacctcctgccctatgtacagataacgcaataatgattggttgggcaggtattgaactgtatgagaacggggtgacctctgagttagatgtcactccgcttaggaaatggtcagtagagggacttgagaagtctggtttctaatcctcatggctcaataactgaggatcaacatatggtttggtgatgttatatttttttatcaaagcctcccacacatccatttctaaacgtacgataaactggctgtgtgattcatcattgtcctttactttctgatatagttctgaatctttttgtatagtgtctttatcagcaacttgtatatagggaattccatcctctccatggactaatattattttcccataattcaacataaaagaagtgtacagcatattttcgatagtcctagcataagatcctgggtcaatgaaatattcgaatagattgacttttttcatcttggacttttcagcaaaaacatggaaatgttgcttcatcattttgacagaagagtcggtatctcccttttgaatatcatttaacgtgactctattagcagtcactgtttcgttcacctcatctacagttcgctgcgtgtgggtcctgacctttttttttcaagactcaatgcaccaagtaagaagttggatgtgtaacttcttctagatgctaaatacgacaatgctccaagttttgcccaattgtagttggcaaactgtgtatttgcaatatcttcggtaatgtcatccatatcgggattagtgggctggttttgctcgtagcttaaatactcagtgagtttagcattaaacatggtggggtttagtccctttctagaggtacccagttttagattccttgcagtgtcagatgattgctgtgatatgctcttaaatatcagagcatctttaggcaaaaaagaaaccatattatgacctttggctgtctcaaacaactcatgcacctcctcaagatgatgaatagacttaccaagatctgcatctctgattgtttgaactttttccctcttaagagcatcctctagcctattatagtgttcttgaagactttgcatttctttgtgaagaaggtctttttctgattcaccgatgtcatcatcatctgattcctcaccagaactggagtcagaactcgtaccggaatcagaatcagaatctgcgcttgttttggaacttgaatctgagcccagatctgagtcttcatcagcaactggactggcgcctttcgggccttcactattctctgtggtctctgccatttcatcaatatctgttggcaatgatcttacctccactttcccactggaccggatttcttccggcttactacctgcaaccaagtgccgcttctttcgccttgcaccagatgaaaaatcttcctccaggcgcctcttttctccaatcatgggagcgaatagagatggtagtaaacagtggtgattacagataaaccggaaaagctacttatccagaatgaaaatacgcgaaccgatcgttaagttaatactgattatctaattaacttaaggtctaacctctaataatcaagtcatctggtataccttcatattccccgtagttcatggccagattgatgttctgcagacattgggtagcagcacccttcaacaaattgtctatggtagccacaattaccacacggtcttgagcagcgttgacagcaaagccacctacaacaacaccgtgcttaccactaatatccttgactaacggagcctcaccactgacggtgatcaattgctcatcttggtagatgtcttgataaatgtttcgaatgtctctagaagtcattttctccttcaatggaatggaaatggtatgactaataccttggaaccactgggcaacatgtggggtaaaagctacttggtggcctaattgtgcagaaatttcacgttcgtggatgtggtcggtcaaggagtatggaatcaagttgttgttcaaaatcttgatatcgttctttggggaaggctttgtaccagcgccagaatatcctgaaacaccaaaaatagtaggaacaccggaaatatagtcaaccaaaggcttaatggcgacctgggcacctgtggcgtaacaacctgggtttgaaatttttcttgccttgacgatggcttgtctggaattcaattcaggtaatccgtaaatccattcaccagtggtatcaaatctgtaatcggcactcaggtcgataatcttggaagtttttggaccatcggcgtgttcaatagcatcaacaaatggcttgcagacaccgttaggcaaagccatgacccaaacatcgatttcaccatttctctccaaacggtttatgtcctcaacttgtaggttttcatagacaatgttggccttatcgtaaccttgcaatttttgaccttgcaactctctagacgatacgtgagcaatctctaaatatggatggttgtcaatcatggtgatcaggttttgtccagtgtagcctctggcaccaatcaaagcaattttagcctttttcttgttagatccttcacggataggtgggtttggatttgagttgcaggtggtagcaaaagaacgtatctgttggctggaagcctttctcatggtatggtaagctctagtctcgcttgcggccttggaattcgaagaatcagtagactggatgtatgagacgttcttggagaaattctgaatcaaagagtcaacatcctcaggagattcgacaccgtaccaaaacaatatctggccattcttagagaaagatccttgggacttcgaaaagaaccaagcagtgtttgggtcatcttctctgacgacccattgcaaggaggggttgccctttttaatagcattaaagatgttgtcggtaacattgttcaaccagccattcttcgaagccaagaacttatcgagtttggggacaccagatttgttttccttaacaatagccaagacctcaagaggttcatcaccataagccttaaatgatacaccttcaagttctctcaagaaagatgcaacagatgtcttaccagaagagatatcagaatctctgttcaaagcagttctcagcagatcaggttgttgaaactcgtccaatgattctctaatgattagcttgtagcctcttctgatcagagtaccagcaccagagtcagtgaacagttctttttgcaagtcgtcaacattaatgatagccacggaagaagatctcggaagatgcatcagcaagtctctgatctccttgatcttcaacttggtaccatactttacccaggattccttcaacaagtcttcatattcctcatccaagttgatgatggaaatcttttcaccagtaattccattgataataccacccttttcgttcagatagacaattttcagaggctcaaagactctggccagctcaccggcagcgacatcagcgttgacatttaagatttgaccagaggcagtttcagcaagagaagtcaggattggcaaagcaccagcttgaatggaagcttcaatcggagccttgttgacagaagagatgtttcccaccaacttgtatttgtctttgttgaggtaatcagcggagaaaacaccagcggtgacaggtctggcacggacacccatcttttccaaagcggtgaccaacttcaagttctgctctaaaaaacatttgcgcaccacagacatggttttttcatcagtaatcctgataccatcctcatattgaggctcgacgccctcattttccagcagttcgttaatttggggacccgtaccgtgaagaacgataggataaaggcccacgtgatacaaaaacgccaggcaagaggccaactctggcaacttttgagtgatgatggcacctccgactttgataacggcgaactgttgttgagaaacagaagtgaagtatttcaggtattgttctacctcccttttcgatccaatattattcaatagctgaataacggtagatctagtggagtagttgttccgtctgtagacgccgaacaatttaggcaagcttctgaatcttgtttgaaacatggtccctacggctggttattccaaagaaaaatttgatctaaggtatagaatgaccggttggaaaaaaaaaaaatggactcctcagaaaaaagcggtgtcagtgagtaatttcacaccgcgctaatcccaaagtggaaaggttgtgtcgggcacaatctaagataaggggaattagggatagagattaaaattgggctggatgacggatgtttgtaatctgttggcggtggaatctgattgattgggtgtcatagcgagaggaacgccatgacagctggatcaggtgctattacgcattcaaaatgccgtcctaaacgtttggatttccaggtgtattaccctacacgatcatataagatcaacgtaggccagtaagatggccagaggaccaactgggaccttctacgatccacccaccaggtcttcgcctggaaatattctgttcgcgcgaccttggatggagaacctggcttttcgcatagcaagcagttaacctgtgatctaccactcatcgcccatgacagataagaaaataaagtaccttcctgccttggaagatgccaatatgtaagtgattcagtgtcaaaataaagtggcattcaactaacatgttttagacccttgaccgagcaacagctggcgatactagagaagcaggtggaggcagaacaacccaacccaactacacaatcatcgttcaattatgcgtggggactgatcaagtcagacgatgtagaggataacagaaatggtatcaacattttggttagtatattcactaatgtgcctcaaaggagacgggaatgtctgtactacttgagtttgggatgcctgaagttgaatgaattggagaacgcaaagcgatacgtggacggaattctggcacatgaacctgacaattatcaagcattgcaacttaaacaagtcatagaaaataagatatccagggatggattagtggggattgctttgtttggtggtgccgttgctattggagctgctgcactgagcactatgttcagatataaccggaagaagtaaactttggactggtctaatgaggcggcgtagacagacaagagttcgcatgtacttctaaggaataactcatccgctgtctctttacggaaacgttttcaaagtcttgtgaataattatatagctaaattgatatgtttgtatgtgatttgttaccacatcgttaaatgcatagaatgtgtcaatgttctgtctctaacgtacgagcagtggtaatctggaacaaaaaccaagaaagaccaattgaggattttttgatgttgaattaatacgagttatagttggcaaattagagtttctatttagaataatctaaaagctgaataatatattataaaaaaataaatttaatgaaagctaactttaatcagcctgaaaccaatgatctgatctaaacacgggtgaagcaaccagaaaggtcaaatcactatagtatctgaggattcatgcttgcaagagatggatcagatgtacagtgtgattttgtgcgagcctgcgaaatctcactacctgaaaaatcattgtgggagctaaactcttgcccatggtccttgaaccagagctcccaaactctctggcagataggatggccgatgctgtctttcaagtttatgagagagataagatcctggcccaaaacaaagcagccaaacctgtcacccgcaccagtggagtcgaagaatggacagttctggctagcattctaatgatacacgataacaaagtcaaaccgctcacgttgactactggtgtgaaatgtatgcctgatgaaactttgaaaaacagccggggaagaattgtccatgatatgcatgctgaaatattaagcattagagcttttcaaaggtttatcatccaagacatggattttctgagagtgttagaaaagacacaagagggactcaaagtgaaagatggcatagaatttgcgttgtatattagtgagctgccttgtggagatgcctcaatcaaagacgcggagaggtgggagtatggttttgggatagttgatggaaaaagcaaaagagtaagattgagtgaatctgtattgcttagaggaagaagtgatgtcggcgatcttggaaaagtcagaacaaaacctggtaggggtgattcgtttgttagtttgagcaaatcttgctcagacaaactggtaaagatacagaaagttggacttttcaacggtgtggttagccaatttgtttctcagaaacacctgaaatatttagttctccctcatgtccctggctcctccgaaagtataaatagatgcttcacccgtttgaaaggagaaagaatgacgattttgacaacatcaagagactttgtacatcgcagaaaggatggaaaacttccatgtaatattagcatgatatacctcgtggaccagcaattagaactactctgtaaagggatcaagaacggtacaaaaggcgtttcagataagaacagcagtatggtgagtagatacaacctgaccaaagcaattgaaaagcatttgaatcgtgaaaagctagaacttgcaactaagagctattaccaactaaagaaaaacggaaaccgatacgagcaagtggaaaagtctaaagcagaactaggcaattgggtccctacatacagagatgacttttctctttaactgcttcaacccctatttattcatctaagctaattgataagccgctagtcgctgtcggaggctggtccagcattctcatcttcatctacaataacaacgtttgaagcatactctgcattcaatagtatctgggtcaattcagggttattcaccaccagatccacgggtttatctccgttcttgttggtggcattgacgtcagctccagctgcaatcagctcctccacgataaacgttccatgttccggttcttcttcgctgtacttgacagccaaatgcaagggagtgttctcgtccagtctgttcttagaatctaattcgacaccttcctggtcgagtagaatgtctaatatttcgaatgctccataagcagcggccaaatgaagagctttgttgcccattacgtcctgtgatgtgttaatcaattgggttatgccatctttattttcgagaattatggattccagaaggtcaacgttgtttctacgggctgcatcgatcaattgctccgatgaactggctccctctgacattattggagtagtgaaatgatgggtagggttgtatgggaacgtctagtgatgtgctacgatttaggtgtaaaatgttgaagaagattcgagggcttcgtaggagaggcggagcgagagaggttaatgtcacccccactaccaaatggtggatggcagttggatgagtgtgataaatcctcgaaaaagagtcaaggccagcaagcaacaccatccccggcaaccatccagtttaagatccagactgccagattctagatcttgataaaaaatcacgctgcagttggaagattagaaaaaaaatgaaaaagggaccttgttctttaatgcgtccccctgattcacgtttgaaaaaagaaaataaaatcaagcgaaccagaacgcaggtccttattatgcgcacggaacaataacaaaattttgtattttgtaaacataaattacgagatcagccagtcagtggccgttgttaggccccttaatttagatttggggcaatcttaaagatcaacaatagacatatgcaatgacatgcaggaggtcgcgtcagtttcgaccccttccagcaaaacctctgatcaaaacaggtataaccgctactatggcatgaaatacaggctattttatcggatctaagctacggatatacgggtaattctacacgagagttacaaatcaaccactacgcgttcgaaaacaaaacaaaagaatgtagatggtcaatactataaaaagatccggaatgagtactttacaataccttctcaagcataatcgatgttcctcaaaagtctccttagttttgcgtctatcctaacgctttgcaaggcctgggatctggaagatgtacaagatgcaccaaagatcaaaggtaatgaagtacccggtcgctatatcattgagtatgaagaagcttccacttcagcatttgctacccaactgagagctgggggatatgactttaacatccaatacgactactcaactggttcccttttcaacggagcatctgttcaaatcagcaacgataacaaaaccactttccaggatttgcaaagtttgcgtgcagtcaaaaatgtttacccagctactctcattacattagatgaaacatttgagcttgctgacacgaagccatggaaccctcatggaattaccggtgtcgattctttgcatgagcaaggatatactggtagtggtgttgttattgcagttatcgatactggtgttgactatacacaccctgctctgggtggtggtatcggagataatttccctatcaaagctggttatgatttgtcttccggtgatggtgtcatcacgaatgatcctatggattgtgacggtcatggtacctttgtatcctccatcattgttgcaaataacaaagatatggttggtgttgcaccagatgctcagattgtcatgtacaaagtgttcccctgttctgatagtacttcgactgacatagttatggcgggtatgcaaaaggcctatgatgatggtcacaagattatttcgctatcactgggatctgactcggggttttccagtactccagcttccttaatggccagcaggattgctcaagacagagttgttttggtggctgctggtaactctggagaacttggtccattctatgcctcctcccctgcttctgggaaacaagtcatttcagttggatctgttcaaaacgaacaatggacaacctttccagtaacctttacctcttcaaacggtgaatcaagggtttttccttacctcgcttacaatggtgcacagattggatttgatgccgagcttgaggttgattttaccgaagaaagaggatgcgtctatgaaccagagatctccgcagataatgcgaataaagctattttgttaagaaggggcgtcggctgtgttgaaaacttggaattcaatttattgtctgtggctggttacaaggcttacttcttgtacaactcattttcaagaccatggagtctcttgaatatttctccactgattgagctagacaacgcttactctcttgttgaagaggaagttggaatatgggtgaaaacccaaatcgacgccggtaacaccgtcaagttaaaggtgagcacgagtgaccaaatgttgccatctgataaagagtatttgggagttggaaagatggattattactcctctcaaggacctgcttatgagcttgaatttttcccaacgatatccgctccaggtggagacagttggggcgcttggcccggtgggcaatacggtgttgcctcaggaacaagttttgcttgcccctatgttgcaggtcttacagctctttatgaatcgcagtttggaattcaagatccccaggactatgtgagaaaattagtctccacagctaccgatcttcaattatttgactggaacgcagtgaaacttgagacctctatgaatgctccacttattcaacagggagctggtctagtgaacgctcttggtttgtttgagactaagactgtgatcgtgtctgctccttatttggagctcaatgacaccatcaatagagccagtgagtataccattcaaattaagaatgagaactctgagactattacctatcaagttgttcacgttccgggaactactgtctactctagatcagcttctgggaacatcccatacctggtcaatcaagattttgcaccttacggtgatagtgatgctgcgacagttgctctatccacagaagagttggttttgggaccaggagaagttggtgaagtcactgtgatcttctctacagaagaaattgatcaagaaactgctccaattattcagggtaagattacattttatggtgatgtcataccgattgctgttccttatatgggagttgaagttgatattcattcctgggagcctctcattgagaggcctttatcagtgagaatgtatttggatgatggttccttagcatatgttgatgatgatcctgattatgagttcaatgtgtatgactgggattctcctagattttattttaacctgagatatgcaaccaaagaagtatcgattgacttggtgcaccctgattatagcattgagaacgactacgaatggcctttagtttccggacacaacaactattatggtcccgtgggatacgactacgattatacctcgggtcaagcctttttgcctcgttactttcaacaacgtattaacgaacttggatatctttctttttccagatttgctaacttttctgtagttcctgctggtgaatacaaagctctatttagagttttgctaccatatggagacttttggaacaaagaagactggcaattgtttgaatccccagtgtttaacgtcctcgctccaccgaatgaagaaaacactactgaagagccaactgaggaatccagcgaggagcctaccgaagagtcaacgtctgagtcaactgaagagccctcttctgagtcaactgagaaatctagcgaggtgccaactgaagaaattactgaagatgcaacatccacaattgatgatgatgaagcatccaccgaaagctctactgaagaaccaagtgctcagcccaccggtccttactctgatttgactgtcggtgaggccattaccgacgttagtgtcaccagtttgaggacaactgaagcatttggatacacttccgactggttggttgtgtctttcactttcaacactactgacagagatattactctcccaccttacgctgttgtacaagtaactatcccaaatgaacttcaattcattgctcatccagaatacgccccataccttgagccctcattgcaagttttctacactaagaatgaaagattaattatgactagtcagttcaactacgacaccagagtcatcgacttcaagtttgacaatcgagaccaagtaataactcaagtggagggagttgtttatttcacgatgaaactagaacaagatttcatttctgcattggccccaggtgaatacgattttgaatttcatacatccgttgattcttatgcttcgacctttgactttattccattgattagatccgagccaatcaaattgatagcaggtgcaccagacgaagttgaatggtttattgatattccaagtgcatacagcgatttggcaacgatagatattagttctgatatcgatactaatgataatttgcagcagtacttctatgattgctcaaagctcaagtacactattggaaaagagtttgatcagtggggtaattttacagctggatcagatggtaaccaatacagcaataccaccgatgggtatgttccaattactgattctaccggctctccagtagctgaagttcaatgtttaatggaaagtatctcattgagtttcacaaatactcttgctgaggatgaagtattgagagttgttcttcactcttctgcgtttagacgtggttcattcaccatggccaacgtggtaaacgttgacattacagctggtggattggcaaaaagagaactcttctcttatatattggatgaaaattactatgctagtactggatctgaggggttggcatttgacgtatttgaagttgctgatcaggtcgaggagccaactgaggagtcaacctcagaggaatctactgaacaggaaacttccaccgaggaacctaccgaggaatcaactgaacctactgaggaatctacccaggaacctactgaagagcccaccgacgagcctacttctgagtcaactgaggaaccttctgaggagccaacttctgacgatctctcaattgacccaactgctgtacctaccgatgaacctactgaagagccaactgaggagcctacttctgagtcaactgaggaaccttctgaggagccaacttctgacgatctctcaattgacccaactgctgtacctaccgatgaacctactgaagagccaactgaggagcctacttctgagtcaactgaggaaccttctgaggagccaacttctgacgatctctcaattgacccaactgctgtacctaccgatgaacctactgaagagccaactgaggagccgacctctgagactaccgatgatccatcgatagcacctactgctgtgccaacttccgacacatcttctggacaatcggtggttactcaaaacactacagtcactcagactaccatcacttcagtctgtaatgtttgtgctgagacccctgtaacaatcacttacactgcaccagttgtgactaagccagtttcttacaccaccgttacttcagtttgccatgtatgtgcagagacaccaatcacagttaccttgacgttgccatgtgaaaccgaagacgtgacaaagactgccggccctaagactgtcacttacaccgaagtttgcaactcctgtgctgacaagcctatcacttacacctacatcgctccagagtacactcaaggtgccgaacgtacaacagttacatcggtttgcaacgtttgtgctgagacacctgtaacgctaacatacactgcgccgaaagccagtcgtcatacagttccttcacaatattcaagtgccggagagctcatttcatccaaggggatcacgattcctactgttcctgcccgtccaactggtacttatagtaagtctgttgacactagccaacgtacactcgctaccattacaaaatcttcagatgagtctaacactgttaccactactcaagccacacaagttttgagcggtgaatccagtggaattcaagctgcttcaaacagcacgagcatctcagctccaactgtcactacagctgggaacgagaactctggatctagattttcgtttgctggactattcacagttctgcctcttatcttgttcgttatataagctctatgatatcttatgtagcccattgggggctgcatttttatagcttattgactatataaatattttgaacattcgtttttcaatcgtagttgacgtcgcaactgctttatcagaacatgataagattgcgatatatatgtaagggtgtttttcacgaaagtttcaagtcggtcttcgtttagcgtgctctgcaggtataatgacatgataattccaagactgaaaactggacatcccgaaatacaagaaacggcaggaattccaagaatgcgagcagctgttaatttcccgaaatcgtctctttgcgtcgactttttgaatgatagtgttttcgcccttgctaagtgcttgttttttactcttactgtcattcccttcctttacctggagcggaacttcttcacgcccataccctggctatgcctgcagcttccagaatctttcttaggtgtcctcctgtaaacgggatatctacatagttgcgttgcagcttctccggttgcatcgggcgcgcactaggcgtgggtaaccctgcaatactagtttctccttttactgtctaagtcttccaagtactcttatcacttccaccgattaaccccaaaaacatatgagtgaaagaccaaagcttcatcgcagaacccttaccggattcacccctactgaaatcaagtcaattgacaccgcaattcctgccaagtgtagagaattatggcaaaagttcggtactcaggagtttgcaaccaaggaggagttccaaaagagctttatcaaccacgtcgaaaagaccctggcccgttctttgtacaattgtgatgtcctggctgcctaccaggccacctccgactcaatcagggacaagctggttgttcactggaacaagactcagcagttgcatactgccaaagaagcaaagagaatctactatttgtctctcgagttcctgatgggaagggccctggacaacgctcttattaacctgaacatcaaagacctcacttccaaaggtgttgatgagctgggtttcaagcttgaggacatcattggagtcgaaccagatgccggattaggtaacggtggtttgggtagattggctgcttgttttgtcgattctctttccaccggtaactaccctggttggggttacggtctgcgttatcaatatggtatctttgctcaaaagattgttgacggttaccaagtggaggttccagactactggctcaacttttccaacccgtgggagatccctcgatttgagattcagattcccgttgacttttacggatacgtttcaactgtaaaaacaccctctggaggatttgtcaagcagtggaatggtggtcaaagagtcttggctgttgcctatgataacccaattccaggttgggatacatcaaatgtcaacaacctgcgtctgtggtccgccaaacctaccaccgagtttgacttctccaaattcaactctggtgactaccagaactctgttgcagaccagcagagtgcagaatccatcacctccgtcttgtatccaaatgataacttttacaaaggtaaggaattgagattgaagcagcaatacttttgggtttctgcttccctatatgacattgttcgtcgtttcattaaatctaaaagaccttgggctgaatttcccgaaaaggttgctattcagctgaacgacacccaccctacactggctattgtcgaattgcagagaatcttgattgacctgcagaatttatcatgggaagcggcttgggacattgttaccaagactatcgcttactcaaaccatactgtcatgcaagaagctttagagaagtggccattggagctgttcaataatctgttaccaagacatttggagattgtttacgagatcaaccaacgtttcttgaactatgttggtgagaagttcaaggatgaggatcttttgagcagagtctccatcatcgaggaaagttctcctaagaatatccgaatggctcatttggccgttattggctcgcacaaggttaacggtgttgctgagttgcattcagagcttatcaagaccactattttcaaggactttgtaaccatttatggtagtgaaaaattcaccaatgtcactaatggtatcacccccagaagatggttgagacaagctaaccctaaattgacagaactcattgcttcaaagcttggtggatatactttcctcaaagacttgaacgagttgaagcaactggagcagtttgtggatgatgcagactttagacatcaatgggatgaagttaaactccacaataagaagagattggccgtacttgttaaagacttgacagggttctcggtcaatccaaacgttttgtttgatattcaagtgaagagaattcacgagtacaagagacaacaactcaacatctttggtgttatctggagatacctccaaattcttgctactccagaagaagagagagcttccaagtggttgcccagggttgtcattattggtggtaaggctgctcctggctactacgctgcaaagaacattatcaaactggtcaactccgtgtcccaagttgttaacaacgataagtcagttggtgacctgttgaaggttatcttcatccctgactacaacgtttcgaaggctgagatcatttgtccagcttcagacttgtctgagcacatctctacagcaggaaccgaagcatcgggtacttctaacatgaagtttgtcctcaacggaggtttgatcattggtaccgtagacggagccaatgttgagattaccagagaaatcggtgaagataacatcttcttgtttggtaacctttctgaagaggtagaagatattagacatgagcacaacaagggtaccactcatattcctcaacaacttgagttggtgtttaacgagattctgagtggaacttttggtgaccctattgtattccaagaactcattgacaacgtcaagtaccatggtgaccattaccttgtcagcgatgactttgagagctatctagaaacacaagaccttgttgatcaagagtacaaaaataaggaggaatggatcaagaagagtatcatcagtgttgccaacatgggtttcttcagttctgacagatgtattgatgagtacgctgagaacatctggaacattgagcccatcacagatcaagtttgatctttttgttttatctcaatttttttgcctgaattttttggttacctgagtagttttgttttgttttatagttttggttttgaacatctaatagacggttgttctattcacatctgaagagtaagagtttacagtctctgggctgacatcggagatcccgttcgcgaacgatggtaccttacatttatatcactacatagtcgcctatcttgaatccaattcacacttttctgaggagctagaagtcataagcgttgatagtacgaagtaaaggcctacgcacgatgatgttgaaactactttgtctactgcttcctttagtagcggtgtcagcctctccaatcgatctagggtcccagaaagattacttggtattggatttaccaggtctgagccacctttcagagacgcaaagacccaccatgcacgctggactactgccactgaacttgtcatttgttgcagatgatgatactgagtacttcttctggaggttctccaaacaagacgttgatagagcggatattgttttttggctaaatggaggtcccggatgttcctctatggatggtgccttgatggaactgggaccatttgttatcaaccccaagcaagaagttgaatacaacgaaggaacgtgggtggaggccgctgacgtagtgtttgttgatcagccaggagggactgggttctcttcgactacaaattacctcacagaactaacagaagttgcagatggcttcgtcacattcttagctaggtatttccacctatttccggcagatgtgtacaagaaatttacattaggaggtgagagttatgctggtcaatatgttccatacattctaaaggcaatcatggacgatttgaagagcgactctggtcagctccctaaagagctgtatttgaaaggtgcactaatcggaaatggttggatagacccaaatgagcagagcttgtcctatctcgagttttttatcaagaaggaattgatcgatatccatggcagttacatgcctggtcttctgcaacaacaagaaaagtgccagaatctcatcaatcattccagcggggaggcctccgaatcacagatttcgtactctgcatgtgagaagatacttaacgatgctttgaggtttactagggacaagaaggctcctcttgatcaacaatgcatcaacatgtacgattacactctacgtgacacctatccatcttgcgggatgagctggccgccgtatttaccagacgtgacagcatttttgcagaaaaagtccgttctagaagcactccacttggattccagcgcttcatggtctgaatgttcagcaagggttggaagccatttaaagaataagatttcagttccctctgttgatatccttccagatctacttcaagaaattccaataatacttttcaacggagatcatgatattatttgcaattgcattggtacagagcgcatgatagacaagctggaatttaacggagaccagggtttcaccgaaggaacggaatacattccctggttctacaatgaagtgaacgtcggtaaggttatctcagagagaaatctcacatatgtgcgagtgtacaactcttcccacatggttccgtttgataatacaccggtgtccagggggcttttagacatttactttgacaatttcgaagatgtcgaatacaacaacgttagcggcatagccacaccagtgtacgatgtggacaagaacattacatacattgacagcaacgatccaaggttgcagaatggccccaaatcatcgtccaccgatgattcagctgcccacgggaacccatttttctattacgtctttgaattgtttgtaattgtgttgttactatgtgggttggtatacctctaccaatactacagcaactctgcaccccattcaattttggcagacaaacataagaaaaaatccaagaataagagcaagaatgtcaggtttttggacgacctggaatccaacctggatcttgacaacacagacgataagaaggacaatagtgtgatgagcaaacttctcagctcaatgggctaccaggcgcaagaaccttacaaaccgctagataagggtgcaaacgccgatcttgacattgagatggacagtcatggtacctcggaaaagtagggctaagccaaccaatgaaatgtatagagtatgttgaaaaggtgttaggtgaataatattaaaagtgtactattcgactccggcgtttttccacgctttgaaattttccatagcctaccgcttacaaaagttgactctgtcaccccccaacaagattaccaatcttcaatggaaaaactaggtgtgctcgaaacatgggcgacggggaaaaaaagtgaaaaaaaagaaagagtcatccgagaaattcctcgtacttgatcaaacacccgagatgtctttcgaacagccaatctacaatgatttggattacaaagggtttgagctggggcaggactcgacaattgatttgtcattgttcaccaacaaccaattttttgatctagacgtttttgctgacggagtaaccgaactgaagcctgaagtcgttgatccatcaccacagaatgacatttcagtttcccaaacgcctattctttccgttgaaagctctccggacaacaaggtgcagaagcctctagatgataagcgaaggagaaacacggcggcttctgcccgtttcagaatgaagaagaagcagaaaggaaaagagatggaagagaaagccaagcagctgacggagaccgttgagcgtctcaaccaaaggatcaggactctagagatggagaataaatgtttgaagaaccttatgtcacaaagaggggccattgaagacaccaaagactcatctgccgaccctatttccaagattgccggctctacatccaattacgaactattgaaactattgaagagcaatagcaatgacgacggttttaccatgacgcatctatagtagcatgtatctcactgattagggaggggaaggttttctgtatattaaaagacaaaaataataaactagaattattcataaagtctcgtctagaactgttttggctcgggaaatgtaagaagcggagtcttctgtaggatggtctaattgccatactagcaacttgtccatcaaaggcttcatccatgggccgggtttcttgcctagttctttgcaaagtgttttgccgtccacgagaggtcttaaagagtgaacctgggacagatcctgatttttgatgtgttgatatgtggaatgatacttttcaatggcgttactgtcagctccctcaaaaatgctgagcaaaagacagatgatcaggtttaattcccattggccgttgtatttccgtatggccattcccaaaacggatcgtggcagtgtactcacatctctctgtactagatgctgaaactcttggtagttgtcaactattagggagacggtatcggagtccttgcttgagtattttaaaccgtctcttactatcatttcggtggcatatctagtattctttgtgggttttgtggagaatttgagtcttaactgagcaaaggggtaaagcagtaggttcaaataaagcacacgaagatccagctgtgagtaaacggatttcaaatcgtctggaaactgttggatcaattggggtaaacttgatattttggaggcagattctggtaagtatatagtaaatacttgatttaagcgctctctgacctttggattaagttcatagaccgcatcttgcaaatccccaaagttgaagatagcatcaagaagattggtatccctcaagatcttcaatccacggatgggatccttactgacgagaatcttgtcgatttctacgcctattctttcacgactgatttttgcattcaaggcctctttaatcttgggttgtttcattgcctgcagggcatcttcggagacagaaaatccaaaaacagaggcaaatctgatcaaccgtaaacaacgcaagggatcatctaaaaacgttttggaaggttctaatggagtgcgcagaactccctgtttcaagtcgattaatcccttctcagtaaaatcctcaatctgatctgtcgtaagattgtagaacaatgcgttcagtgtagcatctcgacgtaaagcgtcctcctgaggggtaccataatcaatggtgggtatacggctctcctctgtgtacttttcattccgcaagttgacaaaatcaatgtcaatgccgtatagtttcgttgtgcaagtttctaaatgcttggatttgtctggattcttgttgattttgtggatagacgaacttagtattgattcaatttcgtctttgtgattctctttgataaaagagaccaacttctcagcaaatgactcgccactcagggtattgatggcgatgtcaatatcatgagaagacctccccagcagcttatctctcacccaaccaccagtaattctcagctgcaaatccggttcattgggttttctcagtttggtgttataatggttacagaaatacttcagcagagagcaaatctgagactctttgtcgtctaacttgatggaagagagttgacttgacatgcttcgaacaaatcgaaacattaagagaaagatatctgaaattttagcgaattctctataagtctatacaactaagttgtctgtatagggttaagggttagaccttcgtctcagaaaggttactgtggtcagccatttgagacggagcaccgaactgtcttcgaggccagctctttcaaatagctctgttcggaacatctgaatcggatcctccttgcctggattttgttggacaaacttatgggcactgctcatggtgtagagatactggaagtaatcctttaattgaaagtctctttccaacaccaacgacccaggttcgtttcctctcagagctattacgtcctcgaagagatctgaaggtatctgcttgtcaattgggcgaaaaaggtccaccagaatcgacctacccggctcctcccaatatggacccagataatcttcgccgtaaacgtatttgtgatagagttcatttcccaaaggaagatcaacaaaatatggatcaacatacccaaagtagcatagggttcctttgggtttgagaattctggccatctcattgaaccacttgggcgcgttgaaccaatgcgcacattcagcggccgtcaccaggtcgacagagctgtcctcgataaagggcaaatcttcggatgaggactgctggaaagatacgttggaaacgtcccgtctttctttgagactagttgcctgggacaccatacctggtgagatatctgttccaattgtgttcttgaactttcttgctaaatggaacgtggcttcgcccggaccacaccccacatccagagctttgtcaaagtccccctgatggtagccaaaaattgattctatgaacgatggtggatattccggtctgaactcggagtaattgttagaattgtacgacgtatctctgaaactggacatattgtgggttaattaaaagacctgaaattgattcacctcgcttgatctaatcttaaatgtgttttctctaaaaggggaaaacagctatctcaattacgatctttgatgctacttgagccttgatccactctcaccccagattagcaagtgcatccatcaccccccacgattcggcacactactcttgagctcatgtgactcaagtcacatgacaggaagcttatttttttttttttttttttttcccttgaaactgtctctctgtctctaaggcctcccacgtgggacatcgcatcccgatctgaagcaggttaccaccaattatcatggattattactagtcacaataatgcacgggatcaatggatctcacgagtcttaataaaaaaaatctaacctcgagagcctttacttttccacttccactcaactcaagaacccaacttcctttccttctctcccatcccagagtataattcttcagcccagccggtacactcagcacagattcaactatcatggatattgaggatgaaaatcatgctaagaacatcagtcaatggctggaggataacgcgttgtctgcagactcagagtacaagcaaatgtcgagtgaccttgaagactccaccatgagatttcacaataaccaagaccaaaatgagccaggccaagaggaagcgtatgggaaaatgcaacaagaggcatacaatgcgcatgccgcccagatagacgacttcatcgatattgaagggttggaaggcggtgacaataatgcgcttgcctacaatgatatgctgcctacaacgtctgatctcaacttcaccccactgttgtctcccaatgcaagttcaattctaacgccttcacttccaagccaaacttattctttcacacccctgacgtctcctatgatcgacgctattccaaatctacgcaccaagagaacaagcgtggagagcgaccataaatatactggacataaggactcgttgcgatctagtagaggaactgatattccgcctccaatgaaaaaaacgaaaactccaagttccacgccagcatttggtcctgtgacttcacgtaggagctcacctcttttgcagcctaagaagggttccaataacactactcctgtgctgataagcaacaacaacagctcgttcaatcaagattttgctctcccggaatcctccctacctggtcctgtcactcctttagatttgatgggtttcaaagttcagaaacaacaatctgaagataaaggaaaatccaaatctgcagataagaaggctactcataagcttgctgaacaaggaagaagaaatagaatgaataacgcaattcaagagttggatgcgatactcccactagaaatgcgcaaatatgtcaccactccctccaaggctacaactgtggaacttgcatgtcagtacattcaatctcttctggaaagaattggagaactagaaaaaccgccccaaagctcaccgaacgataagactactaatgattccacattgcctgccaatgcatctcctgaagatcaggcagacaataattacaacccagcaaacgacacagactcaattagtccattagagtttgaaaagtgattgatagatgtaggagttctaaacttgatatgactttctattatgttcggtttgtatagaatatacatgtgctgttcatcaatgaccagctatttctttttgggcatcagaacggggaaagcgctcattgatgaatttatagattcttgcttcctcggaggcggaggtggaggtgccgctgaagcagtatttaaagaatctgtcgaaatcgctttctggactggcgggaccgtctggatcgtgttttcgggagacatcgcttttaacgaacttggcttatcaggtaccattggacgaacaggtttcgtagatatttcagccttagcacggtccgtagaaacctcgaacggacttgacggcctggtattattcccgctgttcgcccttgatggtattaatggagccatattaagggcataccccggaggaggaggggtttccggtgtacttggttgtggaggagtaaccctattccttggaggaggtggcggaggcgggaaatgacccggaacgggttgtgaaacctgctttccttcagtttcagtgtaaattgaagtattagaactgctggaagcatcattgaaatcaattagatcgccaaatttatccccattgcttgatgccgatgatgcttctgattttggatcacgtctataatcatcgtagatctttctcatcaaagttagtttagtgcgttcatcgacgtatgtaacatgtgctttaaaagttccataaattggtttatggtcagaaattgttatgctttgaacagaattgtagtttacctgctgcaatcttttaccacgataaagtattctatcagtccaagaaggcaccctctgtttttcactagtgtcaaacacactagtacctttatcatacttgtaagtaggcaaaaaattaattttcatttcataaaagtcagcaaaggctcctttatgaaccatctcagtcttcaattggtcctcggcaagcagttcgtcgtacacaccatttagggcagaactgcgaaccagttcgtttggcaagggaactcgatagttgaggtcacctaaccatataacgcaatcatggtcatatatagttttgtttcgactgaatctgattccttgggaaatggttgtaaaatcgttatttctttcaacaacactatttagtccagctgccaaatgggaattcaataaacagaatgttgtcgatccaaaactgaaccgaagggcaacagctcctttatttgcggttatacctccaagaccagttttcttgctgcatccttcgacttgagtcacctttggcattttatcttctttgataaagaacaagagcagcaaggaggtcatttgttctgatcgtaataaaatatacttgctagagctgatcttgttcagctgggttttgatctcctcagaccaataatgagatcttgatgaatcagagttcaaaatattgcttgcagttagttccaccacttcttggaacccaagaattaccacatcaggggcaccttcaatgccaccgttttctttgggaaacaaccaatcagtaaagtcgtcagcatatgcagttccaccaaggttgtaacttcctgtaaatatcctaatgtcatcttcagcagagaattggcttttcaacttgcttaattcgttatctacatgatcagaaacagggtcaaaaattcttacttcaacctgatttgacattttgcccaatagagtatcaatagttacttgtttagctttatcttgaaaattattgatgtacattctgctgatggatttggtagcatcagataatgccccagcaatacccatctttccacttctagtaaaacttgacttcaaggcgtttgtgcccgtgtagatttgggaaatggcatcaccatgatctgcccagagtgtgttatgtttgttgaaaaggtctgaatcataattggtgtttaagttatgtctctgcaagaacatgttcagggttgcattggatataacctgttgaacaacatttgtcctgtccaagcaatctaaacaattggtcctgaaaacacctttttggagtgttaatactttttggtttttgacatcgtaactaaaatagtcaaaatcgtaaatagactcttctagaaaaggaatgactttagtagccaaagcgtaattctttcctgtttctttatgaaagtcaaattcggtaagatatgcttgaggagagccctttttgttaacaatttcgaaatgttttctgtaagtgttgctcaggccaatctcggaaggtttagtggacagtaggtttacaatatgaacaggaccatattttccatttaatgctgcaaaatgcttttcaaaaacaggttcagtggcctctaatgatcttgttatagtgaccttagggttaaccaaggcagtatcctgctcccagaatatcggcacggatcctcttacttcggtgtaggcataaatgaagtcttttgaatgcaaaattaattctgtttccacaaaattggcaacatagccttcgtcgtcaataccacgggcattataccttgtacctgcacgtttccaagattgcttagatatgatcgtggcgttacatttttgatggccaatcctagttcgaaaagtttctgcaaagccccgtattacagtggtcagaaatccatttctatccaagatcttcttgctatctgtaggcagtctatccctgaaattaacgacttctttcatcatgtaactgttccacatgtagtccaaatggaaagagtcaaaacttaaggaatcagagttgacatccctagactgtaaagtacttgtcaagtcaaaatttgtgctgtagtaaaacgaaccattgctcaacaatctccttaactcataagtcggattctgctcataagagagatgattatcgctggcctcggtggaacctctggatcttagagcctcttcgttaacatcggaagtggtaataggatacccattgccatccagctctaggaagtcccatgcatctctattcagacaatgaaactccacattgtagattttattcacggtttcaccatctgtcggagtggcaacctctgtttttccagtaataacgcataaaaatacgtcttcattgacatttatcagaccaagaaatccatgagctttgtttctggacaaaggtttcatatgcttggggctgaaactctccttttccacaaaatctacggcacattggtttttatctttgatatacttgatcagcagacaatgcgtactggatacaagtgctatgagtcttgttttttcatggattaaaactctcatactcaatgactcaacggcaaatgggaaacgacgattttgatgtttcctggccttggttctgctggtcttgtatggtatccagctcgttatctgtgatgagacagttcttggtgcctcgttctgggcattaagtggcacacgacagatcgtatctactataatgatggatggtaaaatactacaaacggatcagccaagtaacacaagataaaagtggcaagagatatttggatgattgaaagctcttttccactatcattgtctctgtgtccatctaattcactaccgtgtcgtcactctccccacatctggagtgaaaagtgtaaacctacctaatctaatagtgtaccacacaatatgttcctcactcttccgctactcattggatgaaatgaaatcatactacgaactcatagtcaaccccagaaatggctcccttacaacaagtcggcagacacggaggccctaacaaatgtttcggtgaatttcagcgtgttgtcgaatgcatgacgaatgccaaacatgactcatacgaaccatgcaacaatttgaagaacgattacttggaatgtaggaagcacaaggtggaaagatacaaggctttcctaatgcaaaaacatgctgaagaactcggaaaggacccagaggagattggtgctccattcgtgagaaaaagaagattcctgacttccaagaccttaggacttgtcgatggtgacgactacgaaattggcgtggaaaagatctagacacatttttatttattttattgattaatttacacatatgctaacatgccttgaactgcacttcgtatgacataaaataactcattacaagttccatcaatcatgatttcaccgtcattgagtttcttgatcatgatctcgtcattaattaccaaggtacctttacctttgaactcagccttgagttgaaggcccaacaatcttgtttttaaatcactcaatctgatgtcaccaatggctagtggtgctgtactctttaaggtcgaaagctgatccagaggattcaacaccaactcttggtagtgtgactcatctttgttcttgtctccttcgtcttcgttctcagtcgtctgtgattcaatctttttatcggtgatagtttctaaaacaccattgacataggcaacactgtatcctcctgcaatgttctgccattgcaattccgattctaaagtgtctgccaatttgacttctaaagtagcttgcgcactttccatttctatagcctcatctggtattgttacgtagacttgtgtgtttctactgtttttggactttatggaagtgacaatagattctgcagtcttctcacggtgtgattttctacccggaagaatcaacaaattccttggtttcaaagaattaagaatcaacaacacagaacgaaggtcaaccgttcctgaaagatcaataaacgacaacccgcatcttgcagtaatcatattactagttaattgcagtctttctgggttcactagagggtcgaagttgtagattgtctctttcacacttttagcatttcttctcctctttctggcaggaccgttttcacctccatcgtcattatcgtcgtcatcatcatcatcgtcgtcgtctcccatatgaccatttccctttcctctattgtttcttttcaacttattatctagcattcgactgaattcttcacttttgtcttctttgacaaagtcagaatggtcaattttgataccataatcatccgtctcttgaattcttgaatggtaaggaaacaatctgtttcttcccttggcatttctaacgtcaaagtccaatggaatcttataaatgtccttctcctgtttcttagtggaagccactgcggtagttgtagtgtttcctctttcgtcattcgctgtctcttcaacaccaatatcctctttatcctcctcttcatcttcatcttcatcttcttcaagggcctttacagcagcaggatcaaattcagagattggcttgttgatatcaatgcttttatcagcgagaatggtagtattcatcttttcaacttgcctctttttcctcttctcctgctttctctcgttcactatttcagtatattgggctagctctagtccagtcaacttctttaaagtgactctggagaatgtaagtaatttctcaaatggaacagggaacccatcttcaagctttccatttcgttctaaagtcagtttttcccaaatctcataaatggaggcaccaaaacttgagtttgtaggtctttcagtaaatatgatcgtatttttctcgtcaatacagatgcttgccagggttgagtgagcagtagagcctatagtcagatccgcatcagctgtgaacactaccttagctcctggtaactggaccaaatcgtcaacatcgaccaattgcaccctcgacgggtcaaacggagtttcgtttctttcttcccaatcttttataatctttggagacatccactccagcatatttcctgctaatgacagtgatttggaacctgtgaatgcgaccagcagcactggaatcggttgatttcccaagtgttggtccataaggtgaagtagttccaaaaatctaccggacattgatgtgggcaaaaatacggttccattctgagcaatggtggcatctaccaaagtaaaaaacttttctaactttttgttgtaggatagggaagagcctaggtcgcttccggtaataacactggcaggttttaccaattgagggataggatgaccgttggactgaaggaacgttgcagaattcaaaaaactatcctttgagtggttccatgctggagcgtatactattttttcattattgtagttgatagaccaaaaagtaccacctaaagagtgccccgcattgtagggtgtgacactgagtccctgtgcaataccggtaagaggagttgattgggagtacttcaaaggtatgattgagtcaaagcattcgtcaatgtcagatttttccataatagaaccttctaagggccccacaagtccttttgccctgtacaactctgtggtggacacctttccgagattggtaattggatatgtcgagtagatcggaagtgttttcagcactggatacttttgcagcagatacacaaacccgccaataaaatctgccgtaggatgtgacaagagaatgacgtttatttgaggaatgatcttgtccaagtaagagagatctgccacaccatcccaacttggatcggcaaaaatattgatacctggatcaaagtacaacaaagacgcccgtatcacagtgttctcattgtcaggtgacaaaagagtgtaggagaacattgtactgtgggttctttcctaactagaaggtaatgttgattaggtcgagtagaaatatacggtgaaatataagcggtgcacgactttaagtaagcctttacggaagaagaagggcaggggatgatagggatggttcatgttaactatataatgtaggggcttagcaaccacctctcagcgttagcaccaagtgcaattgtgatcccggtcctatcttgtaaaattctagagtttggtcgtcacttcttaggaattgtcagtatgaactatcaaacggttatctttctatcacttacaattgcttgccactgaataagaatctctgttgactgggagggattccttccttttcctccatcaatgctttgatatcaatgatctaattgttcgttagtttttgacggtttgagggtgataaagtgtggcttggcttaccttgtcggttggttcaacctctacggggatctgattgctggttagaaacgattggccggaataataagagatttcaggatgtcacttacttctctacctgtcagtgtctgactgttagtattgaaagggttcaaaattagattgctcactcactttgactttgatctccatagttgatgtaagtaacgatgttggaaacgacgtgaacttctcaaagggttctgtgattacataagcacatagtattatgttgctaggacagtaattaaatgaaggaagaagtttggggaaaacgtatcttgtccgtctacagttgagtgtcaaaagttcaagtttccctcttcgatagaggcactggttatccttattaactattaactttgaaccctcccttcaatctaaaaaatatcaaatcctctacgcgaatcaacctcatcgtcaaacatttttcaagtccatgctaccaacacctttgaccaaagatctagactttgaaaaggtgtatgagccagcagaagactcctttctacttttggacgtctttgagaaagaaaagccgtggttggaaagctacaagtggaactcagatgtccctctcgtggtggaaataggaactggatcgggagttgtaaccacatttgttaatcaacacataatccctcaaggactgtttcttgccactgacttgaaccctcattgctgtaatgctgttttaggcactcataaaaggaatattggaaagaaaggtaatttacaggtgcttcaatgtgatttgacaacgcctttaaggagaaaccaagttgatgtcttgattttcaacccaccctatgttccttcggagacagtaccagaggtagcacgggatccagattccgaagattggttggatattgcactgttaggaggacctacaggtatggatattaccgaaaaggtattggattccttatatgataccctcagtcgaaatggagtggcatacatactcttttgtgcgagaaaccaccccgaaagagttatggaaaattttaaagccaaggagactcagagaggaaatggatgggagattgaatgcgtacaacatcgtaaagctggatgggaagtgttgactgtttggaggtttattcgaaggtagatgcctcaaagacatcagcaaaactgtctgctatgggggcatcataatcaggtgcattgatattgtagttgcactcaaagtcatggaagctcaaactatcgaaaaactcttttagttctcctatattgtcgatagtgtttattccttccaacaatggctttctcctggttttctccgttagctcataattgagagattttagcacagagtaacgattcaggtccttaatatgggacaatctctcaattaatgctggtattgctgtgtcagtcttatcgtctgactgtgataaagcagagtcttgaataaacagccattccgacagctggaactcttctggcttcatcattattaaaacatccaacagcttgcatccactcaataaagaatctagatcgatttccagctctggcctggcagcctcttttctaagtttatgtttaccatttccatgattgtgatctttttcaacagccccatcaagaagtgttgacttctccaaaacatcgagcagcaattcctccatctgactaacaatcaaagtccaataaggtgagaggtgaataggactaaactttagtaccaatattctgagcgtgagaaacagcagtggcttcatggttgaatcttttataatttcattcaacctgaacataatttctttcaacgaatccatgaaagtatcctgaggaccaattagtatcaagtagcatattctttttaccagcaacgagcgaccccttatttctgcatcgttccaattaaacaagttgttgctattgttgaggctttggaacttagtaacaagctcagccattttctctgactcagcaccaatatacttgacaaatatcctatcccaatattcccgctgtgaaggctgaactttgaagaagtcagtatcgtttagcacatctcctaagaagcccttccaacttttgaattcaagacagccgttttcggtccaagctagaatcagctcaaggactaaatcaggaatatttggaatgctttttgatttgacaattggttgtaatacatttgaaatcaaggatgatacaatcccggaaagcttatctctgtcggtgatcaattgggttagtttaggcgaaacgtctttcatagcttcacataactcgctggacctcaaaactttgcccgagtcatcacctatatcttcaaaatgatctaatcttgcattaatagagaaattcaataattttacaaagtgatcacttaattctctcttgatcttcttttgctctccaaatctggtatgtgtgttctttacaccgatggaatgagtgatctttataagaccaggcagggtttgcctataaagtacattgttagactccacgtcttttaaaaactgggtaaatgtaagccaaatgtcttcaatgctatcgttgtctaatgattgacagtatcccagtataaatgtcactatttcatgttctgtaagttcaatatttaatgttgaaacttgatcttcatctaatgaatttggaaatacccgtgatgtcaacgagttcaaaaggaactgtaaagccaagtcatgtttggcaccatccaaaatatgaatcaatttgaaaatagaactattggtgatcctaaatgagacaagggattctaaagtctcaatactttccaaaccgtaaagtgttcccaatagtttttttggacgatacttcagagttgaggcagcataactgatagtcagacccagatctgtaatggagctggcttcatttgagttatccgagatggaaactgagctgttcaagtcagaccaaagccaaatcttataactaatatcaatgactagttgaaaagattgcaacatcaaacgttttgcagaaacaagtgcagacagatccttattcccgcctgcctggaatacaccattgatcattgaaccaaagaaaccttgatcattcgcgttcttgcttagatcaacagactctgatgcttcagtagctttccaataaccatgcgtagatgttagaagatcttctaaaccattcataagtaacgggatgatctgttctaaatcaggagtcaactgtttactgtcaacgctgtaaatatctccagtaacataacttttgtagctttcaaaatcatctgacaacctacggcaaattgtggatgtaagaggaaccacaatcgaaaatatgctgtcgtttagaaagagagaacattgagagactagctgcattaagcattctatctccacaatatctcgggatgttgctattctttgtttgaggaaatctatgaaaaggcaactatcatcccttacctcaaaaattgaaatcccgatatgctttgaatgggctagagataacagctttgtcaaacattccaagtaaattacgggtgagcttgggatagcttccaataaatactcaacaatctctgaaaacactttctcttctccatcaataagaagttctagcagtgaaactaccgatatcgtgcaccgttcatagtcttgaatgtcgcttgcaacctttggtattgatatgaactgttttaatatattcacaagaagcattttataagtgtcgacgttccaattgtttgtgtttacaatgtgaatctcttcatccgaatccaagacacatagctcgtttgcgaacgaatcttgaatactgcttgactccagagttaataggttaattatcgtttcaatctgataggcaaacaatgctaaatcgtcctcgtctgttatttcaccagttgataaaaaacgattgctggtgagtattggattgacaaggtttttatacagcctgttaatactactagatcgcaacaggttgtctatccattttgaaaccataacgtaacgggggctccttttctcggctaagttgtctaccactaactccaaacttcttgataggatgctatcagtactagatccactaatggtgttggtgtgagtccataaagtagcaaatgcacgaagtttatcagggaacgggaattcggagctaagaaaaagatatgccaactctccttcgatacaatgagggtcaacgaaaatttctagctttgtaatcgaattgacaacttcaacctggaaaatacctcttggatcacaaattattggccacaatgaaccgatgatttttttcaaaagttgcagtagttgaaaatgagtagcaattgatgagagatatggtaccaatttgatgagaccaaatgataagtcaatgtttaaatcattgttgaagggcaaatcaacgatctgttgtatcagctgatcgttgaccaatttgggggactcttctgtggttggcagtctctctacgaaatccgctagaagatcactcgtaaaggcaagatgacctgctgaagagttcaactgttttgaaaccaatgtctttaatagattgtaggtgatatctgctaccgttgcaggattatacggtaaggaatctgtcttctcagagtagaacttatctatattttctttaatgttctcaactgattggtcctctgcgtctgcatgttctaatgggaggtaagctcgagcgggtatgatatttgaaatgatgcgtgcaatctcgatccaagaaccatattcagagtcaactgctgagcctgctgatattaagattgtgatcaataccaaaggaacatgccgtacaatcatgtcttcatcatcaatgttgaaatttttcagcatgaatttcataagctcataattcttagtctcaatcaattttataaaatctgaccagatgtcaactgcttcgacactatcaaataatgatccaaatcccattaaaatttcaggtgttgcggtttccttgcaggcttccagtgaaggaaggaatattcttggtattacaaactgcgcaatttcccatttgtccagcaccgcaagtgatattttgaaactttgtaacttttgggcatgaatagattcacctgtaaagtttccatctagaagtttcaaaaggctggatgtcaatatctccaaaccataatttttaaagtattctgagcgtgaagttggagacgattcagatgtttccgggcccaataaccaaaaccaaagtcgtctattcaacgacatatcctttttcaaaacggtagaagtagcggttaacagcaatttttccttatctgattgtgaagccagtttctgaatgacatctgatcgcaattccagacgggatgtcaacaaatcaaaaaatcctcgttgaacgaaaatactctcgtcttgaagacccttacacatggcagtaataagcaaaccgggctctggattcacacattctcttgcttcactagacaaaagagctaatatgttctcgttctggctttctgccagctctttttccaaaaaaatgttaaatgagggcatatgacggtcacaatacaataaggcaccaagttttctatcaccagagttaataatggacaagaatagacacttccagaagtgttcgttatcatctactgcttttttcagattgtccaccagctggaaagcagattcgaaacattcagaggtgggatcatccagagcgggccagattcccagtaacaaagcccttaaaacgggatgaagataagctggcgctatttttgccacaaaagaggagaacaaatcgatcaattggggtctcactgtgatactggcatagttcattaatggcagcaggcccggaagccatatggaaatgtcttgtcccagtttctcctggccaagcatgataaaaatgtcgtgataaagctccaaacactttttgtgtactccatttggtagagtatttgacaagcattggctcaatagcttggaaacttggtaagcttcagggatccaatgggtatccttggaagggttgctctgaagagccttctgtagtcgtcctaggaaagagatgtaatcagcccattcaaccacagaggcaaaactagcaatagttttttgcacattactcaagtactttttatcccttgccgacacatctccctttcctaaaggagacatcgaccttaagaggtttgtgggaatcataacaggagagttaatgatgatggtttatgtgtaggagccgccgtagatcagaagtaatcgagatttcagatatcgagaacggcagggatcatttcctatccataagatgaacaaccaatcgccttatgcaccaacaaatatccatagcgagagatcggtgtcgctagggctagttagaaattcgtctatatcattggatgtaccttttaagctttatgagaattccaaggaacagcatttatacgaagctttatcggaactgtattccatcatagtgacattgaatagcctggaaagggcctttatcaaggatacattatacgataactatgaagccagagtaaacaggctgataagtcaatacaatgctattttaaaacaggaggaagttcttagtttgtttggttctttagagcagtttaccaccacatatcagttggatgcgccttacgctaaaaacagattggaagtagggttgcccttacaggagccacaacttacatataatggaactggaaatgttagtataacaggcacagcagatttgggtgccggagctggagccggaactggatccaattactcaagcagagcagtcgcagaggctacggggaactttattacttgtatggacgccatcaaattgcactacagaactaaagagcagctacatccgttattttcggatttaatcatgagtatcaataaagtcttgaataatggcgagtttgagggtaaagcaaagatcgttgaatggctgataaagcttaacggtctaggaatcgatgaaagcatatccgagcaggaatccaaaaccttattatttgacttagataactcgtataagggattttacagcaaattggattcttaggagtatgctttggacagaaactgatagatatggcgtagctcctcgtcagaggtagaatgttgcataccttcatatgagtgaaactggtagttggtgaatccatgagacttgaagaaatctctgcattgttcaccgtaagtgaattgaatcaccgggtctgccgttccatgtccttggaaaaacggggtacttttgttggcagatgtaatcaaaggtgtgacttccttggggattgagataaatccactcattgctatgactccaccaatcttaatatccagtgtactagcggcaatcagagatatacttgctccttgagagaacccgccaagaacgatcttggatgggtcaattcccttagaaacctgttctttgaccagatcctgtagaacgcgtgcacttttcagaattccatctgcatcctgtttggcctttgggttaccaaactcatagatatcgaaccaactgcgcatgacataaccaccgtttacggtgactggcatctccggagcgtttggcagaattgttgtgacatcggggaagtagcgaccaaaaagttcaccaaagaacctccagccttcgccagaatctcctaatccgtgaacaatgatcatggcccccttagcagggccctttagagcgggaataacaactggtccaagcgccattttaatagagaagtacgtgaataattgaagcagagcgaatagttactagatgtcgaccttagcgatcttgatcatctcttaccctcacccattaagcaactgcctgctcccctcgtcaagaaccagctattatggccactccaccggtacctcctttaccatccttacctaaggaagaagttcctgcaaagattgaatttcccctagagtcggtcaaaggtctggatccttccatctcatctgttccactatcaaagttgaaggagctgctagataaccaaaagttgctgaagagttaccttctagattccttacaagagttcaatcaggaaataatccacactttggacgagaatatccggtccttacagaacctgcttcaacaatacgaggacaattccaaggatatcgaccaattgaacaaatcgctggacgagttaaatgttctctttaggagatggaaacagacggaaattgagatgtataccatactgcaaaggtaccagcccaattctctatcgaagaaattgtttgagcttctagaacaatcgcatttggaatcacagcaattggtttcgaagctagaaggttcggtgcaagaatctgatctacagtcgttcattagagaatatagggcaaaaagaaagctgtaccatctgagaaaggagaaataccacaggtgtcaagaggaaagagtccggtttgtataactacaaatacgaataaaaattggagtaaataaataaattgtcatatgtcattaagttagctcgtctctagttggatccaacagctaaatattgcttgaactgttccagttcttctggaatctccacatagtgattggagatttcattcaactcgtaggaaataaccttcttgtagtatctaaacttcttcattatagtcgtatcttgtgtttgctgttgctgccaattattgtcttccatcaacttaaatgccttcattatgccgtaaatgttatccttcaccaatctgtaatcttcacaacatttcttgaagaaattggtattcattagttggcttaccattggaaccggcaaactatcaatgacaattgaaagatactgattgaggtttgcagacttatttccttggtttactaccacattcagcagtactgtgtccagatggtatgctctaaggtattttattaagctcagcagaggttgcacttcgagtcggattgacgatttgattatcatttccttgcaaaacttgacaatgtggttggtgtccctcgagcttatcaggcttaccactaacatgttgtagacatcagtacccacgtactcatccaatagctgttcagacttcaaagcttggtctgaatcgaaatcgcttcgggtcacggcaaagttccaaaatttccaggccaattcaggttgattgttgtccaaacacttcttgaccgcaaataggaggctctttaccgaaacatcgggcagccaagaaatttgatttatggttgccaacattgtctcgcattcctttatctgattaatattggccaatccaatcaagtaggatgaaaggagcatctttatttgataagacattcctgatttgactctgacttcttcgatgatattgttcaagaattttgtagccatgtccttttcatggcagccgattaaagtttgaagtaagacggagtaaacctcaaattgatggtttaccagtgacttgttttcattgcattgagattgataagtgtgatacaactctattgcgccctttgaatcttgagaaagttggcatagcttgatcaggcccatgtagtagatgggctcatttatgatggagccacacatgttttggaggtcattgtttgtgataccaaaattgaacttgtacatgttcaagctcgttaacagatctctatataactgtggtgcaaagcttgcgttgtaatcctttgtaattatcaacagttctatggcaatttttaggaaatcttgcccagttgtaaactcatatgtttgtttagtggcacccgccaacaaggatccaataaccagttcataaatgtccttatttggtttgatgttgctggtaagcaagtctgagtaaacgtttaacaaatgcgtcaatttttcctccactgtctcatttgtctctctcttggtaatcgctcttaaaaccatggtataaacacttcgatccaatttaatttccttggctttagctcttaaataaagggcaaaaacttcattgtaccttttttgacttacaaaagaatggatcattcttatctcatcttccatgccgctcgttgaactttgttcctcctgctggggttcagccgtttcctccaactcttcaatttgagcagacttcttgccttgctctaatttgttggtctcctcgttcatgttcagctcatccaaaagacgagcagctctgtcagtgctgtagaatcgtttacatgactccaagtgcttcaaactgttattactgatcgtaaaagtccgtatcaaagcagagttggacttcctgatcgagagtttactgaaggctttatcgatctgagtcactgatatggaaacgtggccattcttgctaactttgtgcgtagacttcttgatcaaaagtttacgggacttggtgtcattgggatcaccgtttttctggtcaataatgattaagttattggcagtggtgctcacggcggcaacgtacttcgtcttgttttgcgaagtcttgttgtcattatggatgacattatcaaacccacaaatattttgtgtcttggtgtaagatggctcaaagaatggatggtgatagatcccatacccggccgtcttatttgcctgtttggacaacgaggccagagtcttgaacaccataatcgaatgagcttgggtagttcggttcaagaggaagtgggcgggctgagtcttttgtaaaagagacaggaattaattaggtaatgttgcaaatccttattggttaattggaaagggcgccggcccaattcgggatagcatataatgttggggtgtgtactccagttttatgcaagattggctccgggtaacggggttcataaggttgtacggagatggagagaaggaaaacggatcaagtgaggtatgggtgtagacggtaacttccaagcagggagattccagggacaaggagttactcacttgttgctttgaccaaaacaaagtgctttgtagatggtatccattcattaatcatatggtgggaaggaagccttaagaagtgataaatggatgcttttgaacgagtctcccagcgagcattaattatatatattataatattataatatactgtttctaatttgtgtgattcaaaaaatattaatgtcgcgtcacccgttctcttaatatatattttaaattatatttttatttggacagctaccttttgaatatatccaccgtatcctacactattgtggttctaggattactagtgtcattatagaactgaataatcttgcagtataccctgcagtttcctcctctggctacatcatcgtatcacgcccatcatgtcattttccagctctttcaaagtttgaaccttgctagttctgggtatccttataattcgtacatcaccagtgaatcgaccaacataaagctagtatctgttcactgaacagtagaacccttcactcccttagtaatatctgatatctgattacataatctcaaccgtcatctgacacctaaaacagggcgtgcactacacagatcttaaggaaaaacaagtaaacaagtaaacaaaccgcctcttactgcttacaccaagttaccatacacctatccatatttcgacacgatgagagaagtaattaatgttaatggtaagtcaatttttttgttcaaagaatctgcgtgattggccgcttgaagtgaccgttcagctgttcttttgcccgtgaaataattactaacgggaatattcagtcggacaggcaggttgtcaaatcggaaatgcttgctgggagctgtacacaatggagcacggaatcaccccagacggatacttgcagccaggactagaaaagccaaagggcgctgaagctgggtttagtaccttctttagtgaaacagggtctggaaagtacgtgccaagggctctttacgtggatctcgaacccaatgtcgtggatgaagtcagaacaggcccctatgggaatctgttccaccctgaacagttgattacaggtaaagaagatgcagcaaacaactacgccagaggtcactacacagttggaagagaattgcttgatgacattttggaccgtgtaagaaaaatggcagaccaatgtgacggtctacagggattccttttcactcactctttgggtggtggtacaggatctggtctgggatctcttctattagaacagttcagtaatgattacggtaaaaagtccaagctggaatttgctgtttaccctgctccacaggtttcaacctcggtggttgaaccttacaacacggttctaaccacccataccaccttggagaatgctgactgtactttcatggtagacaatgaggctatttatgacatgtgccgtaagaatttgggaattgttcgtccaacctttgctaatttgaacaatctgatcgcccaagtcgtctcttcagtaaccgcttctttgagatttgacggttcattgaacgtggatctaaatgagttccagaccaacttggttccatacccaagaattcatttcccattggtctcctacgctcctgttctatctaaacagagagctactcacgagtccaactccgtagctgaaattaccgctgcttgtttcgatcccagcaaccaaatggtcaagtgtgaccctcgtttaggaaagtatatggctacctgtttgttgtatagaggagacgttgtgacgcgtgatgttcaaactgccgttgcccacatcaagtcaaagaaaactgttcaactggtggactggtgtccaactggtttcaagattggtatttgttatgaaaaaccaactcaaccagcctcatccgaactagctgacgtcaagagagctctttgtatgctttccaacactactgcaattgctgacgcctggaacaagatcgatcacaagtttgatctgatgtacagaagaagagccttcgtccactggtacgtcagtgagggaatggaagaaggagaattcgctgaagcaagagagaacttggctgctttggagagagattacgtggaactgggttctgacagtttccctgaagaggaggaggagtattagtgttgtgattattttgtctagttttttgtctacgttttgatacccttagtatgttaataaaagaagtattataaggatgggctccttcgcgaacatggtttatcagatctccagagaaaaataattatcttcctaagaaccatgagtgactattacggaagtaggggcaattccagggtttggtaagtttgaacaggtgtttgaatgtgtactagagagattattaacaacagtagtgctttttatcgaaggataggagcctgtagacatggaaacaagtgtgtcaaagaacacatccacccaacaagttcttattgcgtagttctccgcaacttctttgacttttctttgctgaaggtggcaaatgagggtactgaagttgcagatgagggggacaagcagaagcagcagctcagtggtgacaaaaagaatgagcagaacaacggcacagaaaaagtaaatcaagatacatctacaaaagattccacaagtccacaaaacagtgagcctgaacggaatgacccatataccaagttgaaagaaatttccgaaagtgagcggtttaataagctcctacaagacatatttgttgaattgtccctcaattatggatttattgaagacattgtcatttgtgaaaataacaacgtccacctcaaaggaaacgtttacattaaattcagcaccaaagaatctgcggccaactgtaatcaagagctaaataacagatggtacaacggacgaccgatctattctgaactgtccccagttagaagttttgaagaggcaacttgtcgaaaacacgatttcggacgctgtgagcgtggtgacatgtgtaactatatgcacataaaacgggcaccaccaacagttacgaacaacctgtttgattctcagctagtttactacgaccaacaagcctagcatggagatgtgctgattacgtaatacataaaagttcatgattaatcactacactacgatattggtatcgctgtttgccactatcaaacgccttaactaccttcaacctgcactcatcatagcaattcccccaaataaatggctgatagatattccttttccctgaccacgttttccccaaggtaagttgcacacaatcattcattactgtttccgagcggaactaacatcttttttttctagtggtaagctggtccagattgagtatgccctgaatgcggtgaaacaaggtgtcacgtcgttaggtataaaggccaccaatggaatagtgctggctacgggaaagaaatctgcctcgtcattggtcaattcagagcatcagagaaaaatagcacaaattactccagacctgggaatgacctattcgggtatgggtccagatttcagagtgttggcggacgcttctagaaaagtaagtcacacaaactacaagagaattcacaacgaaaacccgccaacgaagattttggtaagcgaagttgccaagctaatgcaagaggctacccaaagtggtggtgtcagaccttatggtgtttcgctattagtcggaggttatgatgacaacaacggattcatgctgtatcaagtggatccttcaggaagttatttcccctggaaggcaactgccattggtaagaattccaatgccgccaaaacgttcttagagaagagatggaacgaagagttggaattggaagatgctatacacattgcactgttaactttgaaggagtccatcgagggagaaataaacggtgaaacagttgaattgagtgtaattggcaatcaaaatgatgatttacttggatttaaaggagcagaaggtgttcatggtccaaggtttagaactctgtccccccaagaaataaatgacagattggatgctttataggttagatatcgactatacataatgataagtttcatcaaagaactttccttcgaaatccgctgtttttagaaatgttgacttgatatcttcgatggttttggcgtcgttctctttgaaagcctttatgtaacatttatcaacttcatctttaaggaattgagtccaagagctgaaatcatcaccgtagtggagatctatccagcctttgtaccaccaatgaagattatctggttggaaatttttcactcctctagtggcccagtctaggtaaacttgctccataacccacatcatggtaattacctttggataagtgatggaaggatcagttccaaacgacttcaaaaagttaatatatgcagcaacatcgggaaaaagcattgcgtcgatctcttggattcgttcagacgtgaagagtgaatctgagaccaacttctctttcaagtctttgataacgttcacaaaataatcattttcatcattagcaaaaaatccggcctgctttgctaagcgattagctgctgggtagtcatcacaaagactgattgctctacctactatcctcagcccgtactcaaagaattttaaatcctgactcagataaacgtatagttttctcagatcaaggctccctgctgagagttcatctgttaaaatatgttccgtagctttggcccagacatctttatgctctaatagcaatcgatcagtgtaaacaactgcgatgttgaacgacatgggtttagtaggtttcgaatggtatgaatagggaagggtctttttatatcgagtcatagcccatgactcgaattcgtctcccaaaagggtaacacgggatgggtctagccgacaaaatgtttctgcggctggcttagaggtggaatttacagatggacaagcggtgcggcagaaggactagagaaaccactgaaaatcctacattcaacctattttcaatgagacaatgttgagtcttctgaaggtttgacgtattccaacttgctctcccccaccctcccccacttttttcactagacatcgaaattttgataattgctgtaaacagattgccttctccacaatgaaggaaaatgacacacccagagttggtatttctgtaagagatttggcagtggtaaccaagaaaagtagaagagcattcttcagctcttcaagcaaaagaaatgacgttcctacttccaaagtgctgttggaagcaacctcttttgacattgagcctggaaccatcactgccatcatggggggttcagggtcaggcaaaactacaatgttgaactgtctagccaacgggaatgaaaattctgggaacataaacattcaaggtacaatagcatacaacggcaagacaaatatcaacaccatcagccatgcatatgtcattcagcaagatatacttctccccaatttgacatgttatgagactctgatgtattctgcagaactgagattgaaagagcctaaagagaagctggttgaaattgttgatcaggtgattttggagctaggcttgaaagattgtagaaatactctggtaggaaatgatactcataagggtctttctgggggagagaaacgtcgtctatcaattggaatccaaatgttgtgcaacccttccgttttatttttggatgaaccaacaacagggttggatgcttatagtgcccttcttctgattcaaacactgaaaaaccttgcaaaccaggggaaaacgtttgtgttgagtatccatcagcctcggtcagatatttttttccttttcgacaacctaattttgctttctagaggtaaaacttgttatagtgggcctcttgataaggttatcccctattttgaacaaattggctatcacgtacccaagcaggtaaatccggctgattatttcattgaaattgtcagtattaatatgaaagatcaagagactgaaaacaaatgctgggagtccctgtcaaaaatttcggaccattggaaagattctcatgactttgaaccaatttctgttgatccaacgtttgtatccaaggtcaagtctcccgtctcattttctaagaagattaagatattaaccagaagagatatgcttctgtcgtttcgaagtccattaattcttctttcactattaattgagacaatagctgtcagccttatctgtggatgggtgtttttcattcctggaagttcactcagaggtattaggacaatgactggtgctttgtataccactaatggtctgcaaccatatttatttctgctttttgaagtttacagattgtcatcagtagatattaaaatatacgatagagaacgttcagaaggagtcgtatctgcgccttcctttttgatatccagacgaatctccaaattctttaccgaagatgtttggattcccatattagagtcaattattgggtattttatgtttggactcagaacggatagcccgaggcacttttttatttactttgctgctgtatatattgcacatttagtgtcgatgtgttttgctatggcatgtgtttccatctcacgggagtatgctttggcgtcattgatggccaatctcaactttacattacaatcaatggcatgcggttaccttgcaaactcgagggtaataccagtttatgtgagatggacgaaatacatagcatacttgtggtatggctacggtgctgtaatttcaaaccagttcactggattcaggggtgaatgttttcaggatacatcacaaccgaatatcgatgaagtatgcgccgcctactacggcaataatattattagaaaccttggattttggcccaattttatagccctcccattgtgtgttgaagtggcaatggcatttgggttttatctatttgcagggttgatgcttacctacaaaacaaaaagtaggtctgcccttagccaagaggttagttcttcttccaaacgaaaatccttgaagagttctactcaagatgcaaccaaagaagcagaagtcttggttcgtgatggattaacaatcacacttaaggatgcatctttgaaggtgagagtaagaaaagtacttgaacgtacgtctactgagaaagagattctccatggtgtcaacgctgagtttaagccaggacaactgaatactatcatgggcccctcaggatcaggaaagtcatcgttactgaacttgattagtgggaggttgcattcaaacgtcacaacttcgtacacttcaattggtgatatctttttggatagccaattagcaagttttcaggatatggatgagatctgctcgtacgtttcgcaagatggtgaccatttgatcccatcattatccgtcagagaaacacttctttttgctgcaagattacgattgaacctagaaaggcatcaagttgagaaacgagtggatgagataattttgaaaatggggctcagagatgtagccactgtgttagtcggatcggagttcgtcaagggaatatccggaggagaaagaaaaagactttccatagctatacagttgattaacgatcccccgatcttgttgctagacgaaccgacttctggtttagatgcgttcacagcagggtcaatattgaaagtattgcagacactttgcgacgaaaataaaaccgttgtattgactatacatcaaccaaggttggatctattccatagtttgggttctatccttttgctggcaaagggaggacatgtcgctttcaaaggaacaccgaatgagatgctagagcacttcgagagcatgggatatccatgcccggcctttgtcaatgctgccgatcatgttctagacgtgatttctgtcaatgttcaaaacgaaatcaacgagacaatttcaagaaaacgagttaacctgttcttggacgagtggaaatcccgtgataatcaggaaaccaagcttctggctgtcaatactttttccatggaggatgtcgccattaagaagaggtctagcttcatgaagggatacacgatcttacttcagcggcaagccctttgcattaggagggatactaacattctgttcggaagaatagctcaaatagcaggacttggtatcatcttggctctattctattctccgttgaagcacgattatacctctattcaacagagactgggagcattgcaacagatgacagctctttacttcatcggcatgttgaacaatatcatgatttttcccctggaaagaacctccttctacactgaatacaaagataaggttgtttccgcagaatcattcttcatggcctatcttacattggaattacccttcgagctcgtatcgggtgcgttcttctctgttttcatggtaatggtcatcggattccctaggacgccggggttattttttgccatgtactatgctagtatctgtattgtgaactgtggtgaatcactgggcgtgatcttcaatgtgatatttgatgaagtgggatttgccgtgaacattatttcgattttcctgtcaattgccacatttatgacaggtgtgatgtcattgaacatgggcgcatttctcagaggtatcaactggctatcaccactctactatgccgtgatgggagtgctcaacttggcctttccccccagcttgaggctcacctgcgaggacgacttcagaaaccccgatggatcctgcatcttctctaacgggacagatgtgctggaaatctaccaattgaaaaagaactggcaacttctgttgggtctattgattgtagtggtattcgtctaccggggcattgggtacgttatgctaaagctgaaggtaagaggcttctaatctgtcttcgggtaataccccaccatgacacgcgaatatgatatgataattataaacgacgggaacgagaaaaaaaatgaaccgtaatctcaactatcagattttcaagtttactcgtcacccacttaaagctctatacgagatagcaatagaccaacaagtgttaacaatctccacctaatttatccaattaaatccaagaaaatgtctcgtccaagtaacataggtatcaaagccatggaaatctatctgccaggccaagtaagtcaatctctagtccctttggccgtcctttgttccttcaaaacgcgtccgttcgtttgagggctgcattgccgccatgccactgacaacagtcccactaacattctaggctgtcaaccaagctgaattagaaaaatttgacggcgtggccgctggtaaatataccattggtctgggtcaaaccaacatggcctttgtcaacgatcgtgaggacatttactcaatgtctcttaccgcattgagcaacttgctgaagaactacaacatcgacccaaactctataggaagactggaagtcggtactgagacattattggacaagtccaagtctgttaagtctgtccttatgcaattacttggagaaaacacagacgttgaaggtgtggacaatattaacgcttgttatggtggtactaatgctttgttcaacagtatcagctggatcgagtcgtctagctgggatggcagagatgccgttgtcgtcgctggtgacattgctatctacgagaagggtgctgctagaccaactggtggtgccggtaccgttgccttgttaatcggtccagacgctcctttgtcctttgaatctgtccgaggatcatacatgacacatgcttatgacttctacaagcccaacttcacctcagagtatccagtcgttgacggccacttctctttagcttgctatgtccaagctctggacttttgttataaggcttactccaagaaggccattgccaaaggaattgctgcaaacccagttggccctgaagctgttggaatcaaacacttcgactacaatgtgtttcacgtcccaacttgcaagctagtaaccaagtcttatgctagaatcctgtacaatgactttagagccgacccaactagactgcctgacgtcgaccaagaactagccactttagactacgagaagtctctcgtcgacaaagctgtggagaagacttttgttggtctttctaaggatctggccaaagagagattggctccaagtttgacccttccaactaatactggtaacatgtacactggatccgtttatggtgccttggcctccttgctcacttatgttgggaacgaccagctacaaggaaaaagagtaggtttgttctcatacggatctggtttggcatcttctctgttttcattgaaagtcaacggtgacctttcttctattatcaaagttttgaatgtgaaacagaaattgaaatccagaaacatcgccactcccgaagactatgagactgctattgctctcagagaaaaggcacacttgcagaagtcattcaaaccaactggttcaactgattacattccaaacggttcttactatttagtcaacgttgacgacaagtacagacgtgaataccaggttaaaaactaatttcaacttcttatttaactgaaaatgctagactatatacgctctttcaataataataataatcatttatttcatgtgttaatacttaatggacaaatggtatatacgtagccagatatgacttgaattggtagtagtaagagagaagggaatagtagaacggagtttgcttatcaaaatacccaaaagacaggcggttgaccaaacttggttgagtatcgaatggagttcccttcagcaccctctcagacacggacctagcctgattgatcaaatctgtgtgagaaaggccggtggtgtcgattccgtaggatttcaagtattttttcaagtccttctcagaccaggaattgtagtagttgtagaacgattcgtaccaatcattagcaccagttttaagagattggaaagcctgtttcagatcatcagttttttcagatgcggtgttcttgatgttctcttgctgcttggaagcagtcttggctgcgtctccataccattcaatggcctttttgataagatcatctctcttcttgacacctttgtcaattgggacgttgttctgcttcagccagttctcaacttgggcagtgctccagccttcaaaaatccaatcagggattgaatctttgactcccttttgccacgaaattgggggagtggatctgttcttctctaccagcttaaccaaatgtgactttgtggcaaataatggaatacgaattccacgagattttaggtaagaagtgagacgggagcgtgaccacttagagacatcaattaagaaagtatcattgatgaactctccagcctcttggctcttcttgccagcagtctttttggctttctcaagttgctcagtggatttcgacaagtacggagaaacaactttgttcacactgctcaaccagctctcaacatcatctttcagaagagctttgttctcagacactttcttagataggtagtctttgttgtgatagtactgctcatcgactttgatcttgtggatctttaaccagtccaacaattgtgactccgaccagctgttgatggtgtcgtctttgaattgagaaacgtcttcaagatccaggtcaaggtcttcaatcaacgagtcacggagatcccggtagtaggaagaaacggagtaaatatgatctctgaccttcttcaagagagcatttctgttcttgttcaatctctttgcttcttgctgaccaataacctcattgtcaagtagccattcaacgagatcgtcgttagaccatttgttgtacaaccaggcgcctggatacttgccagaagctttagactttttgctgatcttgccataattcttctttgcagcatcaatcaaagaagaacggctttgatatggttgaaccttgatgcctgcgtctttcaaaaggttgttcaattgactgcttgaccaagtttcaaagatccaatcagacacgttttcagtcttgccactgtcattattgaatggggattcaaggtaagactttggagccgaaaacaacgatttgaaagaatcccagtaagaattggtttgcttctttgtctttacaaggttctctatagcaatggatcgcaaaaattccacgtctttagatcgtttctcgtcaattgaggccttagagtctttgagatattctttgaggtcattaatatcccattcagagaccacatgggcgtactgttcaaccagagatggagtgttatcagaggcggaattgctcaggattgattgcctggcaagcgaagtggtaataaagaagagaatccagtgaaaaattctcatgttctctttagtaactgattaacaagaagtgacagcgcagatacccttactgcctttaaatacagtaattgatgggccccaacagcaatgttagtagagcaatcatgaagttgcacgtgagttcctaagagatggtgcataatattgagaagtttttcctaagcttgcttttaggttcctgaggctgcagatatgacaataaactttcaaacctagcttgatgagctgggcggtgatgagcaacgtctgatttggagagcagatggaacatcttccccaagacgtgaggttagagattcttagtggtctatcacgtgagaagataggtagatcgttgatttgagattgtgtgatcattaaataggcggtttgatgtagacccacttcgcttagtatcccctgtagaccaataatgcacccatcttcatttctctaaccttgacaataacttccgaaggagtttgtcattccctccacactttctccttcctctcaactctagtttcaccttacataatcccaaatatctgtggaacgcgaaattcttctcaggccaacctttaacgcttacttgaacttgttttcgttcaggttgatcacaacatgagttatctaagtaagtcgccccggccagaatccgctctttcacgaaagaaccctactaacatcataggctcttcagttccagagccttccatcatacctaaaccgatcgatattccgacgttggatgaacaagatcaagagtacttgaaaaataataactacctgaagaatgaatcaagtttcaaatatacagggcttcccggtttgaataatcccggtcccaacctccaatatagactgaaaatggccttcaagagtggcttgagcgaagaagttgactgggccgtcgatacctgtttacaagctagtgttcagcagcctggcctcttgaatttgagggctaatccttggttgatagatgagctcgcagcaaacctcagttgctccatctttgatccttcagaaactgttaatcataatattgaacgaaccttgaacgttgtggttgtactgcgaaatatatctcaggatacagataactcgtcagtcgtcgcattgaaccctagggttaaggagatattacttctaatccttgacaataaaattcatttacaggtcagtatgctggatgacctatttgaagcctcaaaagaattgttgaggtattcggtggatctcatcgagacgattagttcctatatttcacctgctccgaaggatgatccgatgttcctttctttgatatcaatcctactaaaatcaactgacagatcattggtgataacaacgttgagatcactatccagactgatggtaagatctaatctaaccaagcctttcggtgctgacgatataactgatgaagtattagacaacgtcagttcttatctaatgcttacttccacgacagccgtgagagactctttcaacgatgatctgatactcgcaagtgttgatttcttatatcaatattgtctaccaggtggcattagagttttgaacttgctgaaaaacgaaaaacgtgcattgttgattaagagtattttaccaaggttgcttacatatggattaaacttccaaactgaattcaccaatgagttgcctatgttaaaactgaataaaagagtccggcctccagctcctgctcacccgccacagctgactgctgatctgtacagtgctatagaccagttgggcgaaccagcaagagcaactgtatggatgagatgttgttactacgctgtagaagatggtgaagtcacccaaatatcattatggcgctcgtatgagaaacaatttggcgacagttcaagcaagcgactcttaccagcggtggatttcatcaagaatgtctccaacgcttttcctagcagttccgccgtagtcatcaagttagataatgatcaaagaaaattcatcataaagggaatcaaacccagagaataccctgtcagggtgagagtgggggagatggaagctttaagacaacccttacctagagaaagtgataaactagcgaaagataacattgaagcatcacaagagtccattactttattcaattactcctccaatgtcagcatttcgttgactgaaattaatacatctgctgctcttcttctcaactgtttaacggagagcgaaaccggagggaaacttttggaaggatccaaagaattgcttttagaaaaagtcctacaagtcccttccttattagagcacattcaacctagccttatgagtttataaggatgtgtactagcttttattttgtgtatttttaaccaaatcctatccattattcatgcttgcgtggtctgctgtctgctcttctcctcctgctgaattttctgcttcagaacgttatccacacttttcatgatgttgatcttttcctggatcatttgggttagctgttcactatcttggttcaatttatcgattctgagcttgtagaattctttggcgtcttccacgttcttctcgacatagtaaccagttccaacatccacaagaaacttgtcattatcaacaattttcccaggaacatacaaggatgaagtcagaggagtcaatatgtcattttctgggctctttgacaccctgtcgatattggcaatgcattcgttgaatttcgcttttgcagtgttgagggcctgaatagacgattggagatgttgaacttcctgctgaatctgtcttttaaactcaaaaatttgctgcggtggcaatgtggtcaagtcgactaaattgttagtatattttcagggtacaacgcaattgtgaactaacctttctgttgtgacattgtttggtgaagtggataaaaagttgacaatgaatttcgattatgtaagtatagtggagcagaaagtgagaatccaactatttagtcttttctactatgagtggtgctgatgatgggaaagataaaacggatacaacatcgtttgaggctattcttgccggggttaaacgtttaagagaacaagatcaaaataaagatgcaaagcaaggctccgaaaaactcaaaattccgttgaaacggttgcctaaaagatcccttcctacccccaaatccgaccaaatccagaatgttaaaactacagaagatgctgctcccgtatcgtctgctcccgtaacatctactactacaagcaaagtcattcgcatggataataccccttcaaatttagctataagacatcaaaagaaaacaggaaagacaacctttaacagcattcaagtcaacaagtcgcaaaccggtaacccattgctgaaacatttgaagacagtttcttgggaattcagcagcaacatcaagcaggtagactatctagtaaattcccagacatttgttttatttctgtctttgaaataccataagttacatcccgagtatatcatgaataagatcaagtcgatgaatggaaacgatacctcttttaccaacaacaatttgaaactgttgctggtggtcgtcgatatcgactctcatgaggatattttgagagaattaaccaaaacttgcgtcaataacgatcttagtttggtactgtcctggtcctttgaagaagctgcaaattatattgtctacctgaaacaatacgaattgagtgacctatcagagtcaactttgattaataacagcaagcaagactcttcgagttacaacagtcttgtcaaatccgttacctctataagaaatatcactaaaacagatgcggtaaacttgatatctgagtttggaagtttgcgagaattggtaaatgctaatccggagtcaatgtctgcggttcaaggaatgggtgatattaaggtgaatagatgggccagtgttgttgaagaccagttcgtgttaaacaaagagtatacttgaacgtcatatttcaaaaaatgaattcaaagaagttattttcactttccgtttgggcaccaccgatagtttattttcctttgtgactttgatgaccttgttgggttgaggtggtaccctttgcgagagtagatatgagtatactggattgttgcccagttttctttgcagattatgaagccaagcacttgttagctgagtgttgattttgtcaatatccgaataaggggatattttgtcttcaacaattctataatcctccacaattgtgcttttcattcgagtcaggtaaaaatttaacgttttttgtgcggtataatacaaaaggttaacgtggtaccatttatccaaggagcataaggataacagtgcagtattttgataagagctgttccattcgttgagcgactctttaagatcaatttgtatatgcgattcaaggtaaaaaatatctcctctggtcaaatttagcaatttcataaatccagattttgttattggacaatcattcaagactaggcaattcaaatgtggtaactttccgacattgattgcgatgcaccaagagttaataacgctatcgtcgacatttcggcaacccgaaacgtccaaatgtgtgatgctagttagattcgacaacaaaatcaatgactctctactcaattgtgatcttactttgatactaactagaccgccataagaaaaagattgatgaacatttatgaaggatgccaagtgaaaattaccacatattgtttcgattctatgctttggacttgcgccaatgagtaaatgacgatgcaaaaccacatccctttcttgattgaccaaccgacggtattgatgctggaagtctattgatagttttgtatggcatggaaaatctgtgcactgagagaattgggtagcaaatagcttgaacaggtagggcgaatccatattattgtacagaatgatctcccaaatctgtttccaaaggttattccaacactctttatcaatatgggctaatctcaacgattcacaattccttgcaatttccatagaacataataaccgcaaggattttgttccgatttttggtgccattgagtcagacaactccacctcatgaacatagtaaggtctgacatgctggaagttgtagactcctccatggaccgtagaatctttaattgatagatcgttataacctatcgtttttgaagtcaaagcttcgaacttggggatcctcttttggaggctctttactttttttttccttctaaaaccctttttcaagcgcctgttggacttctccttcttggtgtactttccactcaagtaactactgaatttctcaaagtcaaatccattattcatccctcttactagcgcatacaagacgcgtcagttaaaaagataagagattttccgcgagggagggggtgtttttttctccggttccactccgcctatagttccctcccgtgttattatcactgccttcgcgggaaagggcggttgaaaaaaatcctccaaactaggagaacaaaaacatataccccatccaaccatgagctttgtgccccaagaactggctgggtttgcagtacctaaggttgtgcataccacctgggccaagacatttgtatgccatccagagttatattttcagccatccacactcgaggaaattcagctgctagtgaaaagtgctctcaaacaccaaaaaactattatgactgttggatctggccattctccctctgatatgacaatgtccgacgaatggctgctcaatttggacaagtattcaagtattctgaaggtagacgaacatgatatgtataccgatgtcacagtggaggcgggtattagagtttatcagctgaacgaacttttggctaagaagggactggctatccaaaacttgggttcaatttcggaacaatcaatgggtggtatcatttcaactggaacccatggtgcctctcccttgcatggtttggtttctcagcagctcgtagatatcactctggtaaacggcttgggagaggttgttaaatgttctccgacggataagccagagctattcagagctgccatgctgtctctgggaaaaatcggtattattgctcaattgaccattagaactgttcctcgatacgctatcaaatcgtaccaggaggtaatctcgtttaaaaccctactcgatatctgggagactgtctggacgagtgatgagtttgttcgtgtatggtggttcccatattccaagagatgtgttttgtggagagcttctaaatccgtggaggagtacaaaaaccccagaagcagctggtatggtactaaatggggaagattgacctatgagtttttgctctgggtatgtgtgcatgtttaccccaagttgacccctatagttgagaggtttatattcagcaaacaatacggaaataaggaaaccctgggacatggaacaacggctgttcaagagtccgttgagggtctgaacatggactgcctgttctcgcaatatgtcaacgaatgggctgctcctttgaacaacggaccggaaatcctgagaagcttggaacgttccatagatacagctgcccataatggagactttttcgttcatgctccaatcgaagttcgttgcagtaacaccacatacaacaatgaagtcggggaaccagacgtttcccacagacacattgatacaaaagggccagtcatcggtaacaatctccgcccatacttagacacgacacctgaactttcttgggtacccaaggacaaaattacaaactcacaattaactctgtacatcaatgcaaccatgtacagacctttcaggaccagtgttccgatcggaaaatggtacaggatctttgaatctagcttggaagcagctggaggcaagccccattgggctaaaaacttcatcggttctgaagaatgggccggtggagaattgaaatctgatggatataaagacggggaaatgaagggatttgctgtcaagatgcgtgattggtatggagatgacttggtgaaattcaaccaagttaggagggagcaagatcctaacggcgtgttctgctcagggagatcatgggccgtgcgtaatgggattattatttagtgtactgtaggatagaaatattagagatggagccgatttgtaggaaggcctttgggaaacgtttgaaagcgtgcgtattctagatgtcaggtatttagcattctggttcatcttcctggatcatttggatttccttcatcgtgctccataattaccccagaaatcaggcaaatcagaggggtagaggggtagctcaatcgagtgattcgattgagccttcgatcaatccagacagaaaacagatgccggagtgaaagacccaatcagtgttcattggcaaccatctgtaaaccattgtgagagctggaataaagataatccatggagaagttccgtctagttgcaattgagcggtcagttgaagaggtcagaccaatttaagtttaagtcagacaaccaattatggggtatggggtatgggtattggggtaacccagagtgcactagagcgtatcatcgaaccactagtttactaatgctccaccaccacaatcggactttggtaagattcatctccaggaacaatttatcctctcagcagagagtattatctaatcgatgccacagtccacctctcatctcgcaatccgttgactttttttgataacgttcgctctcaccacataatcacgcatactgatctcctgtagtataaatagcagggattactcagctaaatgaaccagaatacaattcaactcaacttcaaacaatcatgtccattactgctaaactcagtacggtaaatcttaatactgacaaggaagccaaacaggctgccatcaatgacaaaaaaattagatatggtggagatgttgtgcatttttcaccggggaccgacattgttcgagaagatggggttctaactgtttccaaacaggctcaagctgagtctaaatatcctcaatggctgccaacctgggaccccaagctacgtttcgatgacgagcctcgtttcagccacgttgatcgtggtttctttgccgatcccgagctgaaacgattgtttcctcaaggcggagaccataagctcaagaatctcacccctaaactgggaactgaggttgagggagtccaactgtctcaattgaccccagagcagaaggacgatttggcgcttttcgtcgcccagagaggtgtggttgtctttagagaccaagatctgcgagacagacccttggaagagattaaaaagtttggccaatactttggtcctcttcatatccaccagacatcaggcgctccggacggattcccggaatttcacattgtgtacaaaagaccaggcgcctcaaaagcattggagaacaagatcagtgtgcctgcatggcactctgacaccacgtacgagctacagccaccgggaacaacttttttcggtgttatcgaaggtccagaagcaggtggagacacactgtttgctaatgcaattgaagcttacgagcgtttgtctccaagctttagaaagtttttggatggcctccgtctaattcattctgctcgtgcacaagcccaggcggctttatcccagggatctatccagagaaagaatttcactcctgagacagttcatcctctagtcagataccatcctgttttgggtaaaagatctatttacgctaataaggtttttggtacaagaattattggccttaaacaggaggaaagtgatctgattcttgacttcattcaattcttcattgctgctgctctggatttgcaggtacgtgcaaactataagccaggcactgttgttgcctgggataacagaactgtttaccactcccctgttttcgactttgattacgatgcaccagtaagacactgtttccgtattacgccaattgcggagagacctgtaggatcgaaggaggagtatgaatcctggtcgcccaatggggaggaaaaaacagtggaagaatgggaagagctgtacgcaggcggagtcccagacttgaaaactgttttgtctagttgatgttgataactaagttgaatgtggactgtagcttttgtatagtcgttttaattaatttggattggtcttttggatttatgtgacgaataaagtgaacagctggatcttattgtgcatttagcgacgtgatgcataataatgcacatactgtgcatttctgtagggcggttgaaatattgatagatcttgactgaaacatctgagaccagatctgtttaaggtttgaggtatcctttacggttggctggaaggaatgcagttaagagtgcaaatagtatttctctcagcaaaatcaatcagtttttttacggttgaccagcaatgggagtagaggtgagggccattaattctacaatggttgttaattttagagaagtgatatcgataccacttgaactaatgataacgtagttggttttgccgatttttcattgagtgtgagatataactgtctcagcagactgaatgcatactgaccgaaataaactcgacggcataactcatgaaatatctctagctgctaatcagtattacctgatactagggataaagctagaattgtcatttctcctgttgatttttcagttcattttacattgttactctgtcaccaagtttatcaaatccgattctgaatcatgacgaagagcacatccgttagagcaaatcacagcaaatcacaaagcctcttccacgtactttccagtttcgtattcctgtcattgaccatcaacttgcacctacttgcactcaatagaaacctaccctggtgcctatcctgattcaaagtgcatgcatatttatacctaacagttctgcttacgaacggtttcggacgacggctctcacctaccttcagaaaatccaagcatcacacctaatacctttcggtcccctcatttgatatgttgacacactacttgtgtttgcagtactacgcagacgaaacatttcactttgcagtccacgcggtgctagcgaatttccaagctcgggccagggctcgaactagaactttctcttccttctctcttcttccacaacctctagatcccttctccaaccccctttctccaacaatacccattcaattgcccatcatggtagaggataaaacagaattgctcaagacacccctacatggagtgtatatcccctgtgcgctcatcgtgtttggggttgcaatccatgactaccacttcatcccccataccctactggttttggggttgtttgttggtattcgtctattaatagcctacaacaaacgtgcttcaatacaaagtgataaatggaatgattttgagctaatagataaaactgtcgtctccaaaaattctgctatatatcgattcaagctgtacagagacgaggaaattttggacatacctgttggccaccatctagcctgtcaaatcaatgttgatggtaaaaatgaagtgagatactacacccccatttcctcccaatttgaccaagggttctttgatatcctggtgaaatcttacaaggatggttccgtttccaaagcctttgcctcgttgaatcaagggcaaactgtcaagtttaaaggccccgttggaagaatgtcctacaagaataacatggcttcagagataggtatgattgctggggggtcgggtatcactcctattctccaagttttgagctacataactactactcctgaagataccactagaatcaatttgttgttcgcaaatgagtacgagaacgacatattactacgtgacgaaattgacgaattggcccgcatatacccattctttgacgttcattacacccttactcatcctcctgagaactgggatggtgatgtcggatatgtcaccaaagaaatgatcgaaaagtacctccctccccccacgaaaacctccaaaattttcatctctggtccattagaaatgaagaagctttgtctggaactgacagaggaacttggatttgataaaggaaagttgaactctgaccaaaatgaccaggtgttttgtttctaaggcttcgtttggcttaatcaatattctctccttattcaccattttttttcaggttgaaattttagtcgccatccgacatcgcgctatgttctagtttcattttatatagtgcacgcctatgtatctagtcatatacctcttatagaacttattccaattacactctggacaaggtttcctggactgataatggaagaagaagaggtgaattctttaggcaatcgaattgcaacggcgagtcctttgcccgacaatgtgcccgtacgggggcttccagaactcccctctgaggttctggtcacaatctttagcttcttagaccctatgacattggatggcctttctttggtttgcaagaggtggaagatggttatcaacgataacgaactgtggagagagaatttcatcaagtttttcgggtctaagcagttccagtcactaacaagatctacccaatggagaactgagttgctaatgaggaaagagttggcacagagatggatcaagggaaaagggatgtaccacacctatgctgtcagaaacggtgtgataactgatattgcagcggattttaggaatgataaactggttttgttttctaaaaatactggagatctcacaataacgagccttcgaagtaataaaggcgaaaccccaatcacaggagtgttccctaatggaacaacaagctgtgaactatccaagaacgccatgatatttggaagatgggacggaaaagtttatctcaagctgttaaaccagaaaaacgtgtatttgaatgactccatatcccttaaagagtcgacccacgagggtatagtcacagtgaccaagattaataaagatagcatcgctggcaaacatggcagtgttagagcatttagtggtgatcatagaggaagggtgattggctgggacctaaaaaattaccagaaagttgttgactggccgatatctaacgcttcgattactaatatcgaatccaattatcaagactgtgtgattgtgagagaccaactgggaataatttacgttattgaccataatctgaaagattctaagggacccatgcgatcaccaagaattatcaaaactgaaaaaatcgatgagaatgccactttttctatgcaagtggattttggagatgaaaacatagtaatatcatacgagaataaagtaagggtttactcgtatagtctgcatatgtttgggcattttagtgagcttgaagttgccgaagatgatcaagtttatagaacagtcataagccagatgaacttgcaatgttgtagaaaagacgatacattggcaggtcacgatggacttttatgtgggactattttcaaatcagggaaaacggtaatttggaacgtccgctcgtgggaagatcagcagccaatacctataatacacgttattgtgccgaaattccagcactatgtgtacctgaacgaggactcgccccgcgttgtctctttggatatcaacagttctgtgatcatttttggttctcacaattcctactgctctttgtacgacgctgtgagtggagagttcatgaggttcgtctcaagaaaattacctaggaagatcctacttcatgaccagattcttcccgtcactgaaacactgttggataaagaggacaattttgcaactaacggggtcatagtaatgggaaatattatccagtatttccagtttggagagcaaaaaaactatgacaagttcaaaaagaagatggcccgcaacagtctgaaacgagcaggtgttgacgacaggaaagtcaagaaccgaaggcatattaaggacgatgttgaagattttacgtttcaacagattcaagagcaacaaaagtcagaattgctggataagtataatggtgactcatttgaagatgaggaagaagaaatgtcaatagccatagctttgagtgaaagcttgaaggtaaaggagagagcagagggaagcgaagaggaagaagaagaattgaagagagcattagagctctccaggtctcaaagtgccatcttgggtgatgaagtcgtaggacacgaagacccaacgctaaattcagaagatcgtgaattgaactacgcactagatctctccaaaagagaaacccaaagatcaaacattttccctgacggtgaggggtcatcttcaagaatagagagtgacctggacaacacatcaaataatgacgatgagatggagttggctctaaaattgtctttgatagagcattgaggatagtgtataattcatttatttcgtagttatatcaatgttcaattctataccgaccctgactctttctgcttaagaactcgtttagctttcctgcggaatgcaataatacaatttcttttgctgatgcaactggtactccatttatcactattccagggacagcttcttctggaaggttggaggtggaactagaagagccctggggcgctgccaatgagttgatgtaggaagtcagcttctcaacatgtgggtgtcgattcactgccaccagagctggctgaggggtgatggaatacaagctgatggtctttttcaactgctcggattcgttatcgttggtggtaagaatgatcaagggtgagatttcccctatggctcggaactccttggcaacatcaaaccgagtttggtcctcatctttgttcgtcaaagactggcctgcagtgtctgtcgaagtgggaacaccgtcgtttgtgtacgtgacgactggtttgacgatctctgaaagggctgtgtctagatccttctgagtagtaaaaatgatccttgggccacggaaaaggttgtagatgataccacaagaggcaaacatgatgatcacgataaacacgtagtcccaagagtcgaattttcgccttcttaccttgtttttcggtttagagactcttttcttctctttgtttattggggatagatcatctccctgctcagacgacgcagcaagtttctccagatcagcagcaagcttactcttagtgtcctcgtagggagagaaggaggccttcctataatgcgatgacttcgaagtttcagtcatagtaggaaatatttgatgaaaccaagtaaaggtgggaagaccggcggacagagttattaaataaaattcaaatctctgtctcagttttgtctcgcctcgtttgagttctggggttgggggggctcgttctagacaccgatatggacgtgcgtgcctaggggcaaacgcgagaatgtctaaagcacgtgctggattgttaagcagagggaggggggaagcgaagcgcgacggagcgtatactgctgggatgcaagacactaaccacaatcacgcaccgcgggataccccacaagaccagaacgaattcgtaaagcaaattccaaaattaatttcagaacaagcactatgtcgcgcgataaatccttgattcttttttcacgtgaataatcacgtggtgttttttgtttttctcacaccttctccctgccatactgggagttactcaataggaagtgagagttttccagaggctcaatttttttttctcttgagtgaaataaagttaacctctcttcagaaaacccctccggaaaaaccctcttttcaactttacgtcctactacgacatcacgagagatcttccgctactgaagaaataccgttctgttttcttatgcccagtgtgaaactaacatttttgtacaacagaccagccaaacccagataacattgtattcgaccttttccaagagaaacatagctacacagcaaaagaagcccctttacgacactaaaagagcacaatttttcattctaatcccggcaatatgacattgcacagtgtcgcagtccctgatttcatcaaccatgaactctcaaccactctagactcaaccaacgctttcgaaggtcccgaaaaacttctggagatctggtttgctggctctgctgaggagatggaagatgacggacttagacagatcccgttggaagacattgaatcgcttctggaactggtcaactgtgaaatcctttctaagattagctcctccagttttgattcgtatttgttgagtgaatcttcgctgttcgtctacccccacaagttgatcctcaagacatgtggaactactaccacgttgaactgttttgacaagttgtttgacctcatgaaaacccatctccagtgggatctctcgagtagatctccttatcgtatcttctattcccgaagatctttcatgttccccagtcagcagaaacatgttcatcaaagttggcagagcgaagttgagtggctgaataagtactttggaaaatcgtcctccaaagtttacattgtcggagatctttccaatgaccattggtacctctatctgaatggaactgatggaagccacatgccctctcctccttcgtcccccaacgatttcaagggcaaagatgaaacttttgaactgttaatgacagagcttgaccccgtgaaatgtgaaaggttcatgaccgacataagagttgaccagttctcagatgtcaatcttgacatcgacgattatggccatgtcattggaatgaaaactttgaaagagacgggcatcgattcctttttctccaaggaaagatcaaagcatgacgcatttgcctttaaaccgtgtggtttctcctccaactccattgttgataaggactactattacaccatccatatcaccccggaggaggcattttcctatgcctcgtttgagactaactatcccaaactggcagataagacacagctaatcaaccagattttgtcattcttgaacccaggcaaatttgtcatggtatttgtccaagaggtcgatgaagacgaagtactttcaaatgatttcatgaacttgaagaggttcaatctggaaggctacaccaaggtggacaatatcatttacgatttgaagttcaattataagttgatctactcccaattcgaaaagattaagcaatgaataaagtatacagaagtatgtattttgactgtgctatttgttatgttgatgatctgattctttgagttccaaatatttcagtacagcctcgtaacatatgatatattgactcaaattctgtaccattgataccctgagtcttcgtagttcgttcactgtcttgtaaacaagatccagatccgacttgtagaagttcaaaatggaattgtggtgatgaaatctttgaaggtctttggcacttgctgctttatcctcgatatcagcttgttcagctgtcttatcgtagaataacttctggctcaattgtgaaaacggcgaatgtgttgtcaaaccacatccaggagaagccaaaacagcatcatcttccaacgttcggttcaatgagtccaaaagcaaatcaatcgttataaatgttccagtccttccacacccggctgagcaatggaccattatggttgaatctttgtccgaagtagtacttaaatttttatcctgcagtaatcggttcttcaaatctatcagttttaagatagacaatgctgatggtgggataccgaaatcaggccagtcctgaaactcaatctgggtgactgtatgaaccttgtcttccttactgacctgaattgtacggacgatagaggaacagtcgtcatttttctcctctttcagtaaagttaccgatatattggagtctttgaaatgctgggtgtggtaatactttggaacgctatttggaacgccattttcaagaccagaagatgtcaaacaaataatcatagggactttattgttcaagcaacatctccagaagtcttgcaaggtcgtctctaacggttcctgcgtggcaatatacctcttggaagaaatgagaggaacagtgacatagctagcgttgaaatattcattgctcttttccaaatgcgaaacggattgcgaatgggatagcttgactctggaatgctcataaggccagatattggagtaccgattctttatcccgttctctaggccttcagaaggcaaagagtagtcgatcttgtcgcaaatgttacatgatccagcaggagtgttcaattcgtcgtccgagccattagtaaaatgcttgtggttatgtgaaatggcgttttgttgctggaaatgctgagttttctgattgagggtattgctaatcaggtttctaagacgtctgttttcaatcttctcaattttaacaaacctctttttggccaatttgtaacccctaattttgtctgtgaaaggtagcaaccaaaccggcacgtcccttatatgctctgggactactaattcgccttggtctaaatcatcttcgttctcactttgcaggttcgaagctgattgtttcttcagaagagattcatctacgatgccggagaaacggttaggaggtaaagagaatccagataaaggggcgggaatagaagtgtgttttgtggatatgcgccctaaaccagctgcggttgtagttgctgctgtttcaggcgaaacactgggagatgtgagttgggagttttgagataatgggcttgaaggtgataaaagaactggcgtcgtatcgatcaagtgcaggggatcgaacaatttgtagcgattctggaattcagaaaacccgttctgcaggatgaacaagttgaaatgtttagcagactcatctgtggcagttttggaattttcttgcagaaacttcttgatcgtctcataaagatggaacgagcaactatccaggctagaagactcgtcatatattatgatgtccagacttgatatcgagcaatcaagcagtttcgactgcatgacttccttgtgctgttgagacattgtagagatgacactttgcatggtaaacgttttccttttcaagagagtcgttgggacacagatgttcaacgcacctttcagtcgacttgtcagataaaatgagtagggacgaacgtccagcacgatcaccgattccttcccgtcgaaaagatcaaccaactcctcgtacccgttaattggctgaacggcatcttcttccagtttgaaagtctgagtcagcttgttctttgtcatcgaggataagaagggcatcgaagcgctacttcgatgcgtgctaaggctggtctcgctagctgtttttgggctgtctgtcagtgctggctttagctgtggtgactctggttcggtgaccttcaacgttggaatcaagggagccaatagtagaggcggcgaagcaggagacggcgtcgatgtggtccgagattcctcgtacgcattctccatacttgatgatcttagatttggatgtccttcaaggctggcagagcacatgaaaagaagttcgacacagtctggagtaaagtaaattaggccttttttctaaatataacgttgtaagagaaggctgacatgttctagattagaagagaccaaacaaagaaaatgcactcgagaaaatgacgtaaacgtgcatgtcgtgttattgtcttacggtcatttatagggcagagaacgtttcaaagacagaaacaggaatgccagggggtgggtactaaggtgaaattctcatagttcaagcgtggtcacaatagctcttgtagatctctataattgctattgattggtagataaaggaactttttggttttctccggagggttttaaagaaggcgtttgctgctgacgtggtccgctgcaccagtggaaatagctgatgtttctcgaaagggtggggggtcatcccacttggccttttagtagtagagactgactagggtctgtattggtcacgagatggtctgtctacagactccatttcagtctcaccagcataaccgacgtatggctgaagggtcgagcaatctggcatctccggtcagattcaaatgaaaggctgaaattgaagctgtagagtgactagcttggcaaaatctggactgaaaaatattttcaggcttaaatggctctttctcggcttcatatgaatgcaaaattgtagctgcttttgactctctcggtcctgggcccaccctggaagacggaccctttctgcctgcaaagtagaattgactgaaaagatgcattgctctgaagacgcggtgaatgaacaatcattcctctagaatgagcttgaacacaatacttcctttcctgccagaaaagattgggatctgctcaaacctggaaggctcattgaaagcactccatacatggacaccaccataattgatttggttcttgctcttgtcaaattcaaactgaattggctgttgtccacggtgacatatcagttctccatctacagtaacaccacagaatcccttggaggacttcaagttgtagcccccaaacggcgccttgaaaagctggaacgtagcacacgttccgctggtataccactttccggtggaaatgagacatcctgactgacctgacaatttcaaatagccatgtttgtatacaccatccgtaggacgaggcaggtttggctgcgtatgagttggagccggaggtttgaaatctttaggcaaatacttgataccatgctcggggcatcttgattctgccaatgcgggaattggatataaatcaggtagactgttattgtacatcctgacagatccttttaaatggtggaaataccatacttcgtccaaagcgccgtacttgttgcatgagatacggacaggttggccaaactgagcagttaaagtgtcctcgatttgttgtcttgaataagtctgagcagtactggggacaattccattgttcgccagccagtcataagttggaacggtttcgaaaacggcaaccgtagtcctgaaaaagtctaccacattaacatgcttttcatactggtcataacacttactttggattgtcgtcatacaagtagcatgcttgttgaactcatgaatccacagttgttcatcattgtgattgttattcttccaaacttgcttcattttctcaagcagctcttcttcaccaaaggaacggagaatgccggacacttctgtaattgtatctgagttgctacagaactgatcatagctcccgtcacagttatctggccacaatccgtgaagcgtgaagagcttgtcgggtccaattgcagggtagtaattccagaattgggtcaacaccagaactcccccaggatgttcgaagcagcacgtatctttgacctctgtcttattcgagcaagtcaatgggacgtcaattgggcaataatcggtactcagaggaaactggttgggcaattggggtacctcgatgggatttggggtgtgatctagcacaccttgaagcaattcagatatcatttgataagcagagtgaaatttgaagagcatcactccagtttaaatactccgcgactggctggctatcttatctaagataccaaaacctcgtgggtcaacaaacgggaccaaacgggaccaaacggtcagtcacggtttggaaaggaaatcgacatttttggtgtagttgatcatgtggtggagaaggggattcaaaggagagaagcctttgtctccgaagcaggttgagcgctcagcgtgttccactattaacgcgtcttttgtctagagcccacagtatttgggtgaaaactaaccttaactgcaataattgtaccatcggtgattagaattaactgcagtaaaacagctaacatccttgcaaacctagcatcctctctgcattgtaagacacaacttttatgtgcaagcttgaccttcaatctttcgatgtcagatgtctgttagacatcttctcgattaactcaagtttcgtttccatccatccccattcacccatcatgagtgccacagagataacgcagcaagaggaagccaaaagtacgttgccactcttcctgttctcttaacccttcactaacctttagtcacctttgaaatacatgaaaaatacagacagcaggagaaaattatcaacgaggagttcaagatatggaaaaagtccgtccccctgctgtacaacttcatatacacatccgtgacgcagtggcctaatctttcggctgactggctgacgtccgtgaaacaaaacgatcagtcgttcacggttcagtttgtagtaggttccaacagctcgagtgacgaggattaccttgcactgtaccagatagacctaccgctgtcagtgacaacaacatctgctgaacagaccgtagacgaagaagacattaaaaaagctatagagcaagatagcaaatcaaacaagtttcaacttgtccataaatggcctcatccgggtgaaatcaataaactagctttcaacagtgataatctagtagctacagtgaccaaaactgggtccattttggtgttcgatatcaataacgtatcctccagcaaaccaaagttcactttgaatttccacaaacaagaagggtttgccttgcaatggaacccttcgaataaccaacaattggtgaccggggccaacgatggtaagattgcagtttgggatctctcaaaaaatacaaccgccccagtccaggagttctcccctcattcgtcctcagtgaatgaagtctcttggaatagcgagtacaattttctcatcggatctgccagtgatgatcgttcattccaaatacatgacttgaggtcaggggagacaattatcaaagtcgacgacgcgcacaatggagacgtcaacgctattaaattccatccagtcctaggtgacttactagtcactgcagggcaagatactttggtcaaagtttggtccctttctaaactgctgtctcccgccgatgagccttcgaagaatgacgagtcgacgaatgatgagatccaagaagaaagagaccaagctatccgctacttacatggacatttcaattctgttacccaggttgacttcaatcctgaaaacccaaactacctcttatcgtcgtcttgcctggataaacgagtaatggtctggaacttggcaaatttagatgaagattttgaagaggacgaagcagaaaaaaacccagaatataacgaccctgctttgatcttcatacatggtgggcacacctcatctctcagcgaagcccgctggcatccaactctacacgacgtgattctcagttgtggagaagacaacttactagaagtctggcaaccattattgccccgagaggaagattcctctgaagaagacgaaaaaatcgatgagaatgagcaagatgaagtaaccgaagataaggaaatgaaagacgtttagcttaatacatgctctcttattattgttctgatatatgctatgaaactattaatttgacgcaacttttgcttcaagattgctccaccgttcaatattatagtctgtcattaatgtttgcctctcatcttgcaacctcttcttttttcctctaatagctgtgtttgtaggtagtagtcatcagctaggatattgagccaactatggtgtttattgcatttcctcttatccttcaagcaaaaccttgccagccagttttccggaccaacagagtccaccatgtcatcatcatctggatatatttctcggtacaactttttaaaatcctctgggtctatagcattcttgcccaaatatggtgatatctttgctttaaattgatccatgtctgtagctctgtcaagatccagaattactctgttgaatccacaaatatcagactttttggaattttttgacttcgacttgcttgactttgtccttggacctggtatataatcaggaattgtaattatgttgatgttttcattcagtagtttcaaaaactcctttaaagctaggacaagacgaagcctgctatccaaacgttctaactcagtcgtcacttgttgtatctgcttatcccaagcagctactttttcagtcagatgtgggctcaatttagcatctggatagaaatcggagtagataggaagttcttcgcccagttttgccagcgccttgcagtcatcaacctcacgaagaattgaggagacctctttcaatttcagtaaccgctgaccattcaaatcttcttgcttcaaaaccttgtccagcaatgcttgtttcatgtacattaaaccgtgttcctcactacaatacttacttttcttctcctcactcaactcaattggattgaagcatccctccaatttgcactttctcttccacaaagtcttgcccttgttaaacaaacgatcgcaaaacacacaatagaagtttgccaccagtttctcatactttgggtccagtttcatgcatcggaaatggaaccattcgtcgcatccatcacatgccaccatgagttgaccctcatcatccggttttctacaaatacagaacacctcctctgagttgaggttgtattttggggccttttcgaactcctggaacttcttctgcagcctcttcagctcttccttggagagttcttccgtcatgtcggtgattattatggggaaaacagagcgatttttgaatgctaagtgattatcccgaaaaaatcgattttattccattttaggtaaaaaggggctgttgcaactgaagttgtgccaacagaaactagcatgattttgtagtcttgagtacacccacatagacaactatcgacgctttcctttaggtcgacagttttcgttggacaattcatcgtagaatatgcttccaagatcacgtcatatggtgcccatgatgaggcgcacatttggcgtgagattgattcaacatcagatacccaaaaaacaaatacagtttggccttatcaagacgaggcctttctccatctattcctttggcaagtttgctggaagggtggtcaaagctccagctgcagttggcggtggtcttgctgctgcaggatcgtatgtagcttacaaagtggagcaagcttccagttatactaaagatcaggtggacagagcaaaggatttggccggaggtctgtacgacaacatttctgggttctttggcaaattcggtggcaacggttctgaaggagttccgcctgatggaaacggatctaatgcggcagcactaggtggtacagctgctgctgttggatttaaatccgacgatgatgaggatgaagaaacgttatacttggacgaagatgaagatgaggaagaggaggaagaggatagcgagacaatggatgatgagatgcttaacctcacaagacaaatgattgagatcagaagcattttacaaagtattgaccctaatgacaacactttgaaacttccctctattgtggtcattggttcacaatccagtggtaagtcatctgtgctagaagctgtcgtcggacgagagttccttccaaaaggctccaacatggtaaccagaagaccaatagaacttactttggtaaattctccggacttggcggctgaagtcgcagagtttccagccttgagaatgaacaacttaacagactttgaacaggttcaaaaaatattatatgatctgaatcttgctgttccaataactgaggcaatttcaaatgacccaattcagctaacaatcagatcccctagggtgcctgatctatcattggtagaccttcctggttatatccaagtcgaagcagctgaccagcctacagagttgaaacgtaagatcagacaactttgcgataaatacttggaagaacccaatatcatacttgcaattagtgctgctgatgtcgatcttgcaaactccacagcattgagagcgtcaagacaaatggaccctaagggtgaaaggactattggagtggtgacaaagttggacttggtcgatggggcagaggcaagaggtatattgaccaacagaaagtatccattaaaaatgggatatgttggtgttgttacgaaggttccccagacctctatttttaaaaagaaaacgggttaccaggccttcatcgctcaacaaaattttgagagtaccttcctcaaagacaataaagatgagtttgcaggaacttcagtgggaactaggactttgaagaaacgattgatgagagtgttggaacgttcaatggctctatcgttaaaaccgacatacgatagagttcagcaagagctggaagaagcaagttacaagtttaaagtggagttcaatgatagaagccttaccccggaaacctacattgcaagttcaatagataccttgaaaggtgcagtaaaggagttcagcgagagatttggaagaaacgaaataaaatctgtgctcaagaatgaattggaccagaaggtgcttgatttattagcatccaaatactggaataaaccacatgaccagtctagggaaattgatttggatctacgagacattgttaacgcttcacctacagatgtttattggcacagaaagttggatctcaccactaacagtttaaccaagctgggagttggtaggttatctaccacattgctaaccaatgcactgttaacagagattgataacatgatagacaataccacattgcgcacacatcccatgattaaacaagtggtgcgtgatgcagctgaagaagtgctcaactcacgttattattccactgcagaccaagttgagaattgtatcaagcctttcaagtttgaaattgagctggagaattctgaatggaaacaaagcagggaccacattataagattattgaatgaagagcttagatcgtgtgatcaatatcttcaacttttgaaaaagaacataggaagcaggaaattgacacaaatcatgacgtatttggaaaataaggataacagtataggagaaacgattgagagggagaacattggtttcagtccgggtattctttcaagaggccgtgatgctttatttttgaaagatagggcgtcgctgttgcaattccggatatcttgtttgaaatcgtcccaatgcaagatcaaagagaataaatataaatgtcccgagatatttctggcagcagttgccgacaagcttacgcaaacagcagtcttgtttttgaacgtggagctgttgagtgatttctattacaattttccacgtgcgttggatgctaagctgtctaatgggttgacacaggaacaaattgaggcgtttgccaaagaagatcccaaagtcaagagacacattgaacttcagcaacgaaaggaattattggaattggcaacttccaagattgaggatgttatgaccttacagaaacataggacaaaacattgatggcacttcacttcactcgcaacaactattgtataggctttttgcaatgtacagacatgttatatagtttacttagccaatgttatatataaacccactatcagaatgtcagtcgtttcgctaaaaagcacctctacagaaaagcacccttcactgcacagcaatgagtttccccggaaaggtagaactatcacctgtacaacctctacccctggatataggtattccggttactccgaatgaaaaggaactcagggaaagaaggcgattctccaagttgattccttttctttataccgttcaaaaatggtctatattgcctttcgggtgctttgcattgctgcatattccagcagtggttgtaatgcccagtttaagtgtcaatttggctaagcaactgttcactatgggcagatgcgtatatcaagctcctggcctggaatctttgatgatttgggggagtttgggggttcatattcttagtggagtgacattgagactactcaagatctacagaaactattcgtactatgggatggtgcacaagaggacgagacgaaggaaatcactgtttgccaaggagaataccgatgatttggacccttcttttggtatgggtggtatcactagtttattgggtttaggattcaaaggatcttatatttcaaagattctcggtatttctccgttatcgtttaccggttatctgctacttccagtgttggcagcacatattaatgacatgagattactacctgcctcaattgacggagacagtaacctgattgatgttgaatacataacgcaagccttggctcagcataagtggactacctccttaggcctgttggcgctggttggattagcaagctaccacaccattggaggaatgatgagatacttgaagctatattcgctgagaagtagacaatggtcttatgctctagtggtgggtatgttcactgttgcaggattcagtctaagagcaatcagtcagcttcctttgatacagggctatgtagggaagagatactcggtatatcttgcttagagcccattatttatttacatatttattcttttgatatatacatgattaacccgaacaggactcacaattgttcagctggcatgaaggtgttgtctccaaagcttcactttgcacggcctgccgtttagtaggggtattataggttccgtctctttttctctttgaaatatcaattgaaaacttgatggcagaagaagctgctttagttcttaagtagtacatccccgtctttaaaccttttttccaggcataaaagtgcattgctgtaagcttccctctatttggtttagccagatacaaattcatactctgagattgatcaatgaatcggcctctatctgcagccatgtttatagtaattctttgagagatctcccaaacagttttgtaaaggctcttgacctcttgcggtatctcgtcgatctcctgaattgagccgtcattacctatgatttcctggcgcaaggaatccgtccaaaggccaagattaattaaatcgtcaataagatatttattcaccacctggtactcccctgagcttacccttctggtatagaagttgtaggaaaggggctcaaaagattcgcagaatccaaggatttgtgaagtcgatgctgtgggcatgggtccgactaagagggagttcctcaacccatgtttaacaatatcagatcgcaatgatttccagtccaatgtcaagtcctcttccttgacattccaaagatccatttgcagcaatccttttgaggcaggagatccttggaatgatttgtagggaccatctttctttgcaatattcattgaagtttccaaagctgaatagtatattgtttcaaatatttgagagttcaaagcggcggcttcctctgaatcatatggaatctttaacagcataaaagtgtcccataatccttgaacgcctattgccattggtctcgtcaagtcattagaatacgaagcttcagggacagggtatttggagatatctatcactttgtttaagttttcggtaacaattcttacggaattcttcaaactttcaaaatcaaacttcccatccaccacatatttaggtaaaccgatggaggccaaattacacactgcgatttggtcccttgaagagtactccacaatttcacagcacaaattagaacattgtattgtacccaagttgctttggttagatttcctgttgcaagagtctttatacaacatgaacggagtccctgtctcaatttgagcgtctacaatagcattccataattgttgagcaggaatctttctaacatacattcccttcttctcgtactcagcataaaggaggttgaattgttcgccgtaaacatcattcaaacctttggcatgcaaggggttgaagaggcaccagtcctcattcttttcgactttttccataaaaaggtcgggaatccacaaagcgtagaataaatctctggctctgatctcctccttgccgtgattctttctcaagttcaacaaatcaaacacttcttcgtgccatggctctagataaatggcaaatgcactgggtcgcttattggagccctgttggacataccttgcagtttcatttaggactttaattaacggaacaatgcctctattgcatgcatcctccgcgggaatatcgtgtacattgataccaataccacctgctgcatttgatatcatggcaattttgtgcaaagattggtagacggagttgacatccgcatcctgcaaacccatcagaaagcacgatgagagatagggggtcggcgtacctgcatggaaaagagtgggtgaagcatgaataaaatacccttgagacattaggtcataagtttggatggcagacgacaggtcctcgccatggatccccaacgccactcgcatgaacaggaactggggagtctccaatatgaggtcgtcttttttcagcaaataaatggactggagcgtcatataaccaaagtagtcgaaatcaaagtccctctctggcttgatcgacccgtcaagctgttcggagttagatctagctatggtcagaagacccttatcgacaaatccatgttcagctaaacgttcgcaattagcaaagaacgaatctcctaaacgtttcctcaggtgatttgacaatagtctggcagctaaattggaataatcgtagtgtctagtgctcaaggaggcaagtatttcactggttaggttcaagagatcctggagatggaggttctcaattatcgccagggataccttctccacgactagggcaatatcgacaaacttgaggttcagaccaaaggagagcttgagaaggcttctcttgagtctagcctcatcaaaactgattgcctcttttgattttgtcatggataagagtagttttgaatcccttttcccatgtagaagattttatgcacataattatctcgattaggtaattgattaataacgtatatggggaggatgattattataagccgtttacttagatattaaatcgggagaccaggtagtaggtggacgatgaaagtttttgtcaatgacgattacaattgacttcttcatgacaacttcatgtggtttggacaatatttcctgttgaattataattagaattttatattccaagcgaaaaggtgaaatagtgaaaaaaattataattattatatacaataaaggagccctggtccgttactctcctctaattaaacgaaaagacaattcaactgcattccactggaatctaaggtcaactaagattgtcattgtggtgatcgactgtcaattagaattacttccacaatcacgagaaaatgtgtaggcagaacgcgggtcctgcaatcaactggaattgcaaattcgacagaaactggatcagtgatgtgcatgaaaatttcattgatcctcggtgatcagttgtgcccgaaatacaaagccacgaaatgaccctgaatagtcgagaaggtgttgagagcataaagatcagcgccatcgcaaacttatctgcattggttactccctctaagcttgatttgtaaacatcatcgccaggagtaaaacttccttttctggcatgccatatccggccaaaaccaaagttgattgagggagttagaaactttttgaaaaatacccattgacgcgtaccggactcgaataaagttttgaagcaaccgacacagcgacaacacagccaatacagactacgacacagccttcttgctttcctctagtgttcagatcattcacaggccttggcaaatgcacctttacccctttttggcaggacacacacgtcttctgtcaaacacgttgtccccaatccctattgccaattcatgctatagcaaaaaaataccccagaattcgaggcgcccggggatactctaaaaaaggtccccgtctatatttggaatagcaagtccacgatgtgccaaaaggggaagtactttacgtttgaaaagatctagacgtttctgcacgggcttagacatatcatcgtctgacgttttgattggtaatgaatttttcagatataacaccacactttcagtgcttccacttctctcttctttctttcctcatctcattttagaagtaacaaaagtaaaatgcaattcaaaagtttgatcggtgcaactctcgcattaagcgttgttaaggctacaactgagttggagccaatcttcacaaatgatgtcaatgtcacagtccccacggtgccaccagagatcacttcaacccctgatgttagtgttcctggaaacttgaccgaaactggaggactcacaaacaccacaggaacaggaggatttactaataccactgcaactggcacaggaggtttcactaataccactgcaacaggcacgggcacaggcacaggcactggaaccggaaccggcacaggcacaggcacaggcacaggaactggcactggaaccggtactggtactggtaccactggcacaggtacagaaactggtaacggtgcccaagcggtactaggtagttcagtcttagccgcagctggtctcttcgtcgctatgttaatttgaacttgataaatagttttataatccaataaagtttctgtttcttttttttaatacactagttcacgttgaactactgaaggcaattatccatttgagattggtcaacagatgtttgcatgccaaagtccattcctcgttggatttacgtttggaaggtttgatattcaagtttgatattgtttcgttctccattttgtagggcaattcgtttgttggatcttgttttgtgaaatgatctgcaatttgaatagtgatttctaggattgcgttcatagcaggatctagtttattagaatgaaaaagcttatccagtaactgttctcccgaagaaaagcagttaatagtaacaggtttggaatctgggtcaacttggtattcaatcttggaagtcgagccaatgggaaaaatcttgtaatgtttgagctcaagctcaagtctgctcaataacgtgaagagtaacaaaacaacttgacccaacgcagcatttatttcataccaagaaaccctcttactgtctaacgtgcccaacctgagcccatttatagtgccgaattgaccatcatgcgagatattgaaagcgtcattaaagacgttcacttttcttaaattatctaattgcgtcaaaccatcctcatacattgcttccattctgctttgctcattcttgaactccattaactcatattcatatttgttctctaattcaaaaatttgctgctcttcaatattcaactgttccatttcattctctaaagaagctaataccttttccaaactatctctttcatcatataggccttggagcttcttttctttatctctctcttcttgcttagttttctccaattgctccagtagttgagcagttctttctttcatatttgtacctgcgtcctgtttgcgaagcttggatagaaactttgcgtaaacttctttatcagcattgaccctttcgtactcattcttcaattcctccatcagcaatgtggcgcattcgtagcaaaccggaaaatcaatttcgtacttgttgctgaggatattgaagatattcgtcattgtgttgattctacgactgatagtgttgttttcttcgtaatcatactccacattgacgtcgctgttatcattgtgcttgttcaacacaacaaattcatctctggcattggtaaaatcgtgatccatcttctggtagacctctttaaagaggttaagtcggctctgaggcaccttgggtaaatcttcttccacggcatcctccaaggggattgtgttctttgtaaagttcccatttcgtcccgtcaaaagattggcctgtgatatgctaaggtcttccagagatccgtctatggtcaacggcagccggcatctttggcacttatattctgcctcattcatgatctatttctggaaagggaattagtaaataggggacagaaatacaaatccgatcaacttatcagtgatggagttgatggtctcgagacatcaatccaaatattgcttacataagacaaataaccataaacttgtgtcatagattttacgtacagggctatataaacacagcttagactgtctctcccagcttctcaacgtcaggttctccgacggtagattctgagtgggttccttctttaggagtggaagtttgtacaggggatgcccatatttcatactgagatgtgtgactggggaaggtgttacagtcaaagtcccacttgagtatcttggattcgttgcattggtccttggtccatcgtcctgcatagatcaatggagaatatctttggaagaaagaaagcgcaacggcaaaaaagagaacgaatatggagtaagacacaacctgtttgtttttgaagacataagagtgaataatctcaaacacatgtccgagagccaatataccaaagtacaatgatggtagatagtggtgcaaaaatagctgacgggccataaggaaagatggcaagtaatgcagtacccatcctaggatgtaatgaagcatttgaacattgaagttgaacacagttgggtcaacgctgaacccaaaacctctttgccatctcagaatagagaaaaccaaaaagacagagaacaaagcaatacttgcggtgactgtccaccaagtgacagcattacctatgaaataaatttgtgagtgattttttgaccagtagcttatacctctgagcaggaagggccaagaatctggactggattcatagacatgatgatcagttaagcccttgttgatcttccacattctggcgtgtagctcggcaaccttttgaaagaaagtcggaacaggatagctaactatttcatcaacctctttatccaagaatgggttttcgttggtctcaacgtaccagtaagatagtggtttgataccttgagtagcacaagtaacctcttgttgctcatatgcccacttgggaagcttgacttcgtgggagaacaagtaacaaccagtcatcgcatgtctcaatctaaaaacagtttgaatggccctaacgttttccttagcttcttcagtagttgaaagatccttggcaatctccacaacaaagtcatcattggcatcaccgccaaagccctcatgtccataagcagatacctcattttgccaatcttgttcagtcacaggaggtctgaggttatgagagtgcaatcttcgggaagtcaatttgtggtttaatctgattttgacaccgtctttcaatggaacaaattcagttggctcctcagtcgcgttgtaatcctgtacaatccattgattattagaatcaatgtgtgggtacaaggtgacctgctgttgaccagaaccaccctcgtaaagatgattgtgagagtgtaagtaaccacctctggtgttcaaatgacggatagtgactaaagagcccaaaccaacgttggccagcgactgttttggaacagcattaccttctaaggtcgatctgaagacggaagacatgaaagcaccaccatcaccttccttggttaagacttgcaaatggatggcaaagaaagtgaggtagatcagagtggggacgactaagaaagctacagctctggtgataaaatggccgaaaattttctttacagaaacagtcaaatcaccaatgatgaaccataagtcccaaattgttatcaatccaatccaggcaacggtgaacaaaccaacccatttactggaagctgctaaccctaaagaaacaccagtagcaataagggtcttgtaccattggaaggtaaacggttcctgaatttgaaatttcttgaaagagtaaactgttgaagcaataaaaaacagcattggcgaatccagcaaaatgaatctggagattgtaacattagcattctcaatgatcaaaagagcggttgtcagagcacagactattggttgacaaccagaagctctcagagtcaaatacaacataatacatgttccaactcccataccagagggaagatatctcatgagcacataaggaacattctctgggaattcgtcaccaattttcttgaactcaaactctccatcgtatccaccaagactgccaacaccagcaaataatagcttggccaatggcggatgaacatccatgaaaaaggttcccaaaatgtactttctggcaaaccccccaaagtgaacttcatcaaacacaacgctgtcagggtgggcgacgttgtggaacctgatgaccattgcaaatatgaacaaactagccaatatcagcttctccttggttgaagtcacagaacgagacttgctcaattgaggagatggagaggtcacaataaaaggacggagctctccttttgagattttaagctcagtagtgttttctggcacctcttgaggacttgttttactcattgtcaaaagggaaacagaacaacgtgttacgttttgcgggagaaatatctggcacatgagacgcgatttttgacggggagacacgcgaaactctaaggaatttcagaaagtgcttgattacataagcattctatttacagatggtttcatcccagtatctgttgggatactggatatcgtagcggtattctttgtcttcctcggctaggtcgtcctttcccgtcaccatggtgagcagttcatgagacggtacgttggctggtacgggaaaaagctttgtgaatacaggctttttgggtagtcttcgtagtatggtttggcctctggcttttatgttctttttatgcaggagattattggttgagtcgtgttcggcatgggtcttgtagacgtatttgaggatggaatcacgcaccatgagctggatgtcttttggggcaaaaatttctatcagttctctggtgttccgagctccagtgggcagaagcttgataaatccaacaccttgaatgaccaggtcaattaaaccataaaatggagggatcacatatcttaccagttcatctggactgtcctccttgacgacgctgcaattcaccaaggcttgtgggggcgcttggattacactggtggccttttttagcgacgagtacatgaaggatggaaggttgacgagactaaactgtttcagcactacaccctttgggggccgaatgtacactaaaccaccaatgcatattactcgcacaccattgaatagttttggcttcgaaggcaacgtttctgtgtatgccttgagggatgtcaatggctttaactgtttaacgttcaaaatgtctcggtagttctcttccttaagatacttgtaaacacctccatttggagcagtgtatccagggagatctacgagttcaagactgttgttgtccattttgaacttcatgggttttcttgtgaatgaaggaaggtgagagacacccgggccattctctgtctgcttctttgagtaatccttaccaacgatggatcgtattagggttgattttccggtgttcgtcattcccagaaagtaattgggacctctgggtaaagtggatagcagctgtttgaggccccaatttctttttcctgagaccaatactacctttctaggatctgcaccgacaagctttaccaagctgtcttcaaaataagcagctcccgtccgttggagacctagcttatcggggaagaacacgtcagactttgtaataacgtacgtaatctgagtgggtttaaatctgtttaccagttccttgctgagaccaagaggaaaatcaacagcagataaaacgtggacgatattggcgtttgaagggatctcatccaggatcttgtgttcgggattttcttcacgaatggaatggtcgatcaaggaatagttttgcgatttgaagcatctctgacaaaccagtcgtttcggggtacggggcttttggtacatttccttgggtataatcagtgattcagagtccacctcatggcccagtctgtcggcaagttcttcccttttcacattcaaaaaaagcttttcttttagttcattttgataatttttaactttcctttcacctttgggcagtagacaatacccatctttgtctggatgttctgtttggagaaccacaccacaggaaggacaatttggagactcaaacagggacgatgaggtcatcgatctcgaaagagatttggaactgttaaattttggtggcctcatcaaacctctacaactgcacccgcataatgaggaggcaaatctacccgcacaaagcctggctaccaccagacattgtctagctaatacctttctggctaacatagtgggcagagcgaagtaggaaggcttacatgaaagtttctggagtacgatctcgcgaaataaatttatcactgagcagtacctgtatgcatacgcatacatgtagcctcttggttgtgagttccaacagtgggagcatgagtaatagggtttccctggaagcttgctagtatctaaggctgtcttgaaacacctggaattgaatactgttaaaggttacccgacagtttgtgtttgttgcctacgtctgtccatttttcacctgcatctacctacaacgtctaatcataatggtcccagttgacgcctaattgatactctctcttctaaaccacgccataaaatagtcagttgataacgcagccatgctctgtgaacgtacttgattgccctccccaactacccctgcttctgcggtatcaattttatcttcctgacatgtctagcttgcattcgctaggggcgttttttcgcaagttccgctcaaatatttgttttcttctaatccccaaacaccatggttctcttcaaaagaaagcaggtggaagttgtccctccacaacagcttcctgatgatctagacacggaaatttggtacattccacagactggcgagtggtttttgaactacgatgagtaccttgataggatggactattatagccaaaagaagtttgcgtgtgaaatcactggaaacagctcgtttgatttctttgaggccctcaagtacgaacaggaggaaatgcaagcggttgaaaataagtttccagaacctgtcagagaaccaattttgagatatgtgcaattcagtctcatacccagactagatcaattagtcgatgacgtgtatttacacttcaagaaagaattttttcctggggatctagtgaatgttaaaagtgctggatctaacagatataaagggatcatcagagaaaaggcacggtttgctcccatcaccttacctgatggtaccgtacgtgaaggatactgctcttatcgcgttggcctctcaaactctgatggagaagtaaccgtgaacgaaaatcaagtttcccgtgataggaatgcgttcactaagtggtacgtgaaaacttttctcaagttgacgttgactagatcgcaaagatctggtgctccttgggtggtcaaagatcagtatgctgctaagtacagaattccaacggagtaccctgaggaattgaaaaagttcgaagaagaggaagaggaggacgaaaaaccttcaaggaagagaaggaaaaaggtatctactcaagactcaaagaagagagtcaagtcagagttccctaatatatttgaaaacctaaaggaaactcctcctgcactttcatctgaagatactgaatccttgcaacgttggaaagatagatggaacgaggttttgtctcgatgtaactactatcttgatttgtcagctgacgactcctctgatgttgaaccacgcaccaaattgaatcagttgttaggttttgctggtgtctcccgtcaattggtttttgatcctaacacaaccaatatcatagttactatgagatcctatcacccaaaaacacaatacgaacctcctgacatgttttcgtacgtagagtcgaggcatatcaaagtatggcactatgaaaaagttttccgtttcttgaagtccttgaatgttaccatgagaaaagttcgccagcaggaaaagtctactaaggcacgaacagagtctccagctactcttatccctagtaacacagcatttatgagcataaaccaatcagctaatgggaccaaggaccaaaatcaatcgacgctgcaaccgtcaaaagggtctgttgaggatcttgcacttccattccagattatcaaggacaaacctgtaacaaaacaactggatggaattgaccatgttgatgaactaatggagacttgggcatttatcaacgtttatcgtgaggctcttattatcgatacgtttacactagacgactacataacatgtctgaaatggtcaaatagatctcgaaagtcgtcacttttagaggagatattttgttcgttattgtcgtgcatcattgacactaactatacaaagcccaagtcaaatgatcctcaccatggtcttttgatcactttacctgaatctttgaccgatcttctcgatgatggggactccactaaagagtttcaagatgatattaagcaagagaatgcaaatggcatcgttaatgggactgaaaacggggatgcagttgaccctagcattaagaatgaaaagtcagatgaagaggatgatcacgaatcaaatgcttcctctacgatcaatcataacgcctatcagttgcttaattatcgcaaacgcccatggcaagaaatattaagggacaggaactttaaagatggtggttggcagattgccttggtgggtgtattgtcattagtggaccacctgcctgaataccaagcggatatcgaacaggtttacgaaattctagctccggaagatttgggagtgtcgcctgcatcggtggaaactagattctatgaaaatttggggattaatctacgaataaaggtcctcagtattgtatgctccctactgattgatagcaccactattagatcacatattgacaattgtttggaagaagctgcaaaacttcgaagggaaaggctggaaaaaatgcgtgagtacaagctggcttccgatgaagcccaggctcttcataaagaatgtatgctaattttgtgcactgccgatacatcattagaaacttctagtgcacctcaacgagaggataagaaacagaagagccgagctaggagtagcgacaaagttccattaaaacccacggataaggagctggctttggctaaagctgatcccaagtttttgaagcttttaactagcagaactgatgctatggtgaaggcccaatctgcaaataaggagaagagacaacttgaaaagagactgaatgaaatagatctgcaacggataaggtgtattggatttgacaggtcctacaacaggtattggtggttcgaaaataatggattgcctactttgaaaaatgtccacacgactagcgacgacgaagaagaggacggcgacgacaaagaggatgcaatcgaagatgatgaagatctcgaagatgtcgctgaggaaacttatcttgttggccgattatggattcaaggacctacagatgaagatagaagaaatctactgctttttagcgatgaacaacttgagagatggaataatttggtggaacaacttgaaaaagacaaagagaaggagaaaataacgaatgacagctttctgaagacggaggagacaaattccaatgtcaaagtggaagactcaactaccgtcgcagatgacagtccggagttggcatcgaaagaagaaaagacttctgttattgatgaggcaatctccaagtttttcgagtttgattttcaagagaatggatcggtacaacgtccttccgggaggacaattattgatgaatatggagcaccttgcatacaagaatttaagtttatcgatagaaagattctccaggagactcccgatcttttactcagcaaagaaaactggagatacattgacaccagcgaggatattgacaagctgttgaaattgttgaaccagtacggtatacgtgagggaaatctacataaacagttgacaatccttgaacatcttatcaaaggcagcatcgaagcaagaagaaaggctttatacctggatgagaactctgaggaacacgttagacttcgagacattattgagaatacagtgatacctgaacagacagctgaggagaacgaggagaaggaagatccagaagtcttagagctggagagctccgataatgcggaaaacgacgatttagtggagttggaggctgattccgattctgactcggcagtgttgccaacaagatctcgacgttccaaggcagttcgaaacactagaggcacaagaggttctcgcaagactcctgtgattcatacagagttagacttcactcgtaaaaaagcccattacgccactcgtcaaacaaccaaaagccaagaacgagaagaaaagatcaagatggtccaagaagccaagcatcaattggaacatctgaaggaggatcgcatgattaccagatgtctggaatgggtcaactccagtgctatagaagaactcggacacacgcatcttaacggccccaaaaagaagtccactaataaaaaaaggagataagacttctgtagaccatagaatccacccaataataagtaccacaagtaggctcacgtaatcttttcctttgctctggttcgcacctggctttatcacatttctctggtattttttttcgcatctatttttccagccaaagcctttatcaacatgagctctttcttgaccagaagaagcccatgctttgtaaactctctcagggcgttgaggagatatcagagtgtaaaagtcgatggaaagttgaatctgaaaactacgcctacggaactggctacttcatcaacgctgcccaacattgaaaaggagcatcttccaaagcgtgatattgaccctaagaggaaactggaagtgaacaagaaggaaactacgggctacgttattcctaaatggcaagaggccttaggtgaagcttttattggagtgtttaaggtggatatggacaagattagatccggaagtattggaggtagtaagtactactatatgtgcaaagaccaaggtttacagtttaaaaatgagcctttgagtgacactgccaagttctattatgaaactcttggtttaaatcgatcgttcagccaatggtttcaaattacagctctccatgtctggttgttgtttgtgagaatgcgagcaatgcctttcaaatatggtaaactttaccaacagaaattggtagatcgtttgttcaaagacatcgagcttaggctctctgaagagatgaacgtcatgtcaggaagcatcagagataactacttgaaggactttgattctcagttgagaggtatcgtcatgtcctatgacgaagctttgataagcgacgacgctacactggcagcagccctgtggaggaattttttcaatggtgacaagaacgtagatctagtgcacgtggaagccatggttcgttatatcagaatgcaactgtacgtgctagataagacctcagaccgtgagtttggattcggggatttccagttcgtcaagcctaacgaggtggtagagccattaactaaggagaacgaagatcttttgaggaaaaaggtgagagaaaagtatgagcctttagagggaaaacagttgcccagtaatcggtcagttttatccttggaggaataactccaggagtatgggtttagtatttatatgtaaataggatttaagtgcaatgatatagactggtgagtcttaccaggattggacaacccgactaagcaaacggagttgatgtagtaggcctattctgaaaggtgagtcttgggagagaaaactggggggaaaaagtattccctcgaactcataatcatctatcaatatctcacttcatccaaggcagagtcaaaatgaagttgaccccagatgttgtccagaacgcttcgatatatacggatccagagaagcagagggtgttgatgttaaggaacaaaaacatattcatgatagagaacttgggagtgctcaacaacaacaatagcaccatcattgaagctatcgactttacaggcaatgacatcaggcacttgggtaacattccttattctcccagattgaaaacaatcctcatagcaaagaacagtgtacgaagcatacagtcgaatcttgctcagaatgttcctaatgttgaaagcattgtactaataaacaacaaaatcaagagcttaacaagcttggaaccgctagttcaagctaaaaggctgaaaaatctttatttaatggaaaacccggtgacgtctcacaagtactacagattgtgggtgatttggagaatatccagcctaaaaatcttggactttaaaaagatcaaagacaaagaaagaacccaaagcagtgagctcttcgggcaacatgactctcctacggaattggcaaatgaaatattgaaagatgccatatcaaacggccctgcaacacaagaggagtccaacgagaccttcacgcttactgaagaggaaagagaggagctgaaaacgcaactggcgaatgcaactacattggctgaaataagcaagattgaacagctgatcaaacaggtgtcctagacttctgacggtaattgaaatacatagactccttatatttacacctaatcattaactatctgtagcctggaaagatctagcctttcagtgaatcttttcaggttgggaatctctcgattctgttgaggtccataatggcaactatggcattcaactttcgagttgttctctgcttgactatcttcatggtaaggataccatattggtgactggataccattacaacgctgacaagagagcttgacgctgttatttttcgattcaggagaaacgctgttcaagatgttctgaaatagtggtgatgggttcaatactatccttttctcggttagatcaggggcaatctctcgttgaatgattttagaatgcagttgcaatgaatccgcagatttgctgaccttcaaaaattgactcaagaccaatacgaaaggtttaccaatttggttcaaaagagttccatgggcccgcaatggcacaaagttcttggggagagtggaaataggatgactattgcaaataagacattgactagggagcccacaaacctcatcactgattttgatggcatctcgattatcagagctgttgtcaatcaaaaatccaaacatacagcctgcaacgtccacagcgcaggttagatgcatttcctttttacatagatgacagtctgccatgcctcctccacggacaccacaaattccacaactcaaattagtattcttatgcaagactgcctctaccccctgaattggctgcattgcagctggattaccgaaagttatgccctttgtaaaaagagcacagataacatgggcccagtcgtcagacgttgttcgcttcaagcaatcaggaatggcatttggctgcccagtaatgcaggcatcatgatcaatctctctagcattacaaagcatgcaagagtagtaagttgatatcaaaggatgtaaatcattgctgcacggatcgcagcaccatttgtagttgtaatatccactctccatctgaaatgagtttccctcaatctttgtatccataccataacacgaagcatgaacattaagaccacaatttatgcaaatcagcatttcattgatatcatcaaaggtgcgacagacgctacatggtctcgattgcaggtcatagagtggtaaactcatattcttggaagtcaagccaggaagttgtgcagacttcaaaagcttccacacttttttgttatcttctattgggttgcctggccttatggatttcattattcgtttgatcgtatccaatgttaagttggaaatttcataatcactggcatagcggttgaacagttttctccaaggaagaaaagaggccaactctgaaactgcgaagggcaattttgcttcctcgatggccttgtcagagactaatggttgtttttgaggtggcagtttcttgggagctatttttagcaatttatttgaatctttaggttctttattagccttaacttttgtagtagtggccaaagatgatttgtcttgctttgtactgtctttcgatcttgatttcttggttaaaggttttgtggagtcaccctttagtttcggatcaggagatttcttctcaaccttctttctctttaccttttgcttttgctcaggattagtcacaaccttcttggattcagtctttttggttgctgccttcttgttatccgccttctttggctccgattttttagattcaagcttaatttgttctgttttgttcttttccttatcttgtttcgacctcttcactgaaccattctgcttcgttgttggagattcgtaatcatcagcctttcttttgcttccaatctttcttgggtgttgtctatacatttctctggctttaatgattgcttcattatctctgaccagctctgattcaatcttctttttccatgcagcacctgccttaggggtaggtttctcgtttggttcttcccaaacgactccataacgtctccaaagacgagcgcatcgcatacaaagagctattcgggatccattttcggaaatttctgcaccgctcaccttgaaccactgcgtcgagtgatttgaatggcagtacttgcactcaaaacgctgcgcttttatcttcttggaatcaaaagcagaatcatcccctgagtcgttaatgtcctcaggtgtgcctttagtcgtctttattgctgctttaattttgttcttgtgtcttccttcgaaattatcccatatccgatgcccattaggagttttcttccaaaggtaataaaacctgacgatgtcagggcatttctgtgttcccactgcttgatagacaggatatagttcactaccatattttttcactgcagcctcaaacttttcaagctcttctggcgttaatgtaggctcctttaccgaatctcgagtaagctttttgacttcctcaaatgcctttatagggtcgtaattgctgtccataaggaatttcaatatagcatccataaaattgggagttttccggtacaatcccagcttatctgaaacctcagaacatttctcaatataagactctaccatatcactctggtcctttggttgcctccacatcaacaccgccgtatcgtcaccgcctctctcaatgtatcctcttggtcttggcagcagccaaggaggatatgtatctggtgtttggcctttgtattcatctggaactttcaacacattggcgtcctcaataacggaaatgggaggagggctgaccttggatttggatttgaaatatcgttgctttttcttgtgtgaatctactacctttccgtcatcgtcaagtttgtcgtaatactttaaagggtgtccaaaccagtcggggatatagttgcattggtgtttagcacccagtctggaagcagctcgtgggtatggtctatcttgtagatccagtgcgtcctctagttttgcatgaacacctagatacctatacggccattcttccagctttcgtcgttcttcaagagaatgcgtggagtcattttcaaggaactgaatggctgcttcctcataatgcggtaaagaacttggcgtagattgtctttcgacttcgttcttttcatcgtcttcaacttcgtcgtccttatcatcatcgactgaatcttccaataattttcctcttctttcacttagttcaacctccatgtctcttgaacactttgcacagtaccatccaaaccctcttttcggcttagataagataggtggatcaagacacaacatatggtagtatttttcacagtttaaacagtgaacactgtccatgttgctacaccattggtagcatttctcacagtttttcggagctgataacagagtctgtgccttaccagtttccacaaacacatattcaaatctcttattcaaagctcggtagtaattctcgggcaagtgatctaaggacttggtaggcaaaacgtcgtacagtttaatcatgtaccgatcaaacagtttttcaaagtaaaagcagttgggagtttgcttgaattcgtccaagttcgcaatctccgatttatgcttgatagtcacagttcctctatagctttgtattggacagttgtctgtatgcattgtggcgtaaagtagtcttgaatcggtcgacctcttcacaagatctcttggtctgtaataccaatttatcttgaacatgaagttctttgcgtcttgaggattatcagtgaaattctcctttttttcaaaccctaagatcctgccaatatagtacggctcacccgcaggttcactgatcatgtatatacattggcctttactaattggctgtctatttttgaggatcagagtgttctctgatattatggccccttcaagatccagcacattgttgaacctatcttgctttttgaccggaggctgccagtttaaaggaacctcttcgtctatgggaacgtatatggaaggattggctgtgtctaaattgggggtctcacttgtattcgcagtggaaggaggtgtgactttcttctgtcttttggaaggagacttcgaaatgctcttgtgaagcatagcatcgtactccttctctgtcgcctctttgtagttaaccttcaggcttgctgaccgttttggtcttgctccagacgacatgttatggacagagagagcaagaatgggaaattattgatccagttgccctttcaggttactctgaaaacggacaagaataaagtggaaggagatctttggaagggatcaggcgggaggggaccgcctgtaagacatttttttcccctgctgggcggaccgctttttccatgacgccaacatggaatgtgtgaaatgcattttcgtgccatttaccttcgcgggttaggcttctgtctaacttccatctgacaacagtctgcaagtataccccatttttccagattatagcaagttgatcatggttgaaatggaagagcgagatgttccaacgattcccggagagcctcttggtcaagaaatgactaggtttttgaagggagtcgtcagcaccatcaccagagttcctcctactaccttccctgggtcgcagcccgtaagctttcaaagagtccatttggaggacaacttgatgaataaggattactacgtgtgtgagaaatctgatggcctgcgctgtctgcttttgacgctattacacccagaaaccggggatgagggaacatttttgatcacccgagctaatgagtattttatggtaccaaattttcattttcctttaagcccaaatgatttttccaaacctcacaatgggacgattgtggatggcgaacttgtcttgagcagaacgcccgaaggcaccaaacaattgaggtacctgattttcgactgtcttgcctacaacggagagtctgtcatgaataaactgactcccaagagactttactacgcaagtgaattgttctacaaaccatatagaaaactaagagaaaaacatcctgttgactgtcagaattttccatttaaattgtacttcaaggatatgactgaaccgttcaagatctccaagatatttcagcagttgcacaacctgtcctatgtttctgatggtcttatattgacatgttcagagaccccgtatgtggtcggaacagattctacattgttgaagtggaaacctgcggaggaaaataccattgatttcaagcttttgctggagttccccaagtatgaagatgaagacgttcctgaaggtccagatcgagtctaccctgattacgactccaagccgactatatatttgtatgagtgggtaggtggacaatctgccgtcaactccactgatcctgagaagtacgaggctgatttttcgaagcaccaagagttcggccagcttactcttacagatgaagaatggcaagaattgaaggagtctggtgaaaggttcaatggtagaatagcagaggtgaatcaggataaaagtaagcattggagactccttcggtttagagacgataaattgaatgccaaccactacactgttgtggggaaagtaatacaatctatcagagatggggtgacgaaagaagaattgattcaagcacaggagcaaatacgtaagaactgggaaattcgtcaaagaagaagaaaagagatggcagcaggtgctgctgctaacggtggacaaacatcccataggtctgcccctgctcctgttaaaccacccacacaacaaagaccgcaaccagtgccccaacagaaacccacaactgaattgaaaaggccattagaagatcaagaatcttccgatgacgcattggatgaatttccaacgtatgacagatcaccaagccctgattattcccgaaaaaaggttaaaggagagtaggactattattgcctctccgtttgtattatatgtattgtatataaaaaaatgtaaagctttcaaagcattaattattacaacgacatcattcctttaaagttgttagttatttacatgaggatactaaatgcttcaggaggactggtctagtagtagtttaaagtacatgatttcagcaattccctggggtttccagaactgtagaaaaacttgttgtctctgaaagattcgaagttaatctcgtctgttttctcgttgtggatgataccctgatccaggtagtattgaagaagagatccgacttcttctttattcagactgggaacctcaaacttttccagattctgcaaggttgcagccaattttcggtcaaaatcaccaaacttagcatagggttcataacttttgtcccccagggcaacggatagtgtgtcattggatttatgttttccggatgaagaaattaagacaccacctttgttgaacttgtcatctccgcggatatatctcaatatcaaagatggaatctcaaacctgtcaaaatatatgcgattattcttggtgtctctgtaggcagttatgggattctgtgtgaacgcagtgaagttgtcaacggttaaaaacactggaacattggaagcagacagctgggagaaggtaaagtgcaagcaatgagacaggtcacctctgtagtgcacagcatgattcaaaacatcaaacagtgtgttctcctttgctttgaaagcgagatcttgttgctttccctttctctcaccgaatgactttacagttgcgaacttgatgtcttcggtcaacggaatattcagctcgtctttattggccttgaaaaactttttgatcagtttccgagtcaccattggttgtctatattcgactgtgtccagagcgcttgggccaaaatcagatgagccatcaacgaaattgtcggcgttgttgatggcaaatacgatagctttgtgtgatttggccatcgattggaattgagccaatgtggtggtctttccaactccactttcaccgataatggcaattcttgtgttggtggagtcggtggttagcgccttttgcaagatcttttccaatctgattgtggcgtccctaaccaaagatacgggacgagaaaaggcctcgttgaattgacctttacggaaagatcctagatgatgtagagcctttaccgaatcgttgggaaagttggtcacaacgttcttggtcaaattctgtggtttcaaatctggaaggtgactctcgctcttcttcaagagagtcgtgctagatacattgatgaaattcttgtgattacctggacctttcgatcttttcacaaaacctttagcctctttcctgaaagacaaggacaccttcttctctgccagcgatgcagcagatgtgtgcaaggcccttatacctctgaacattgtgctatggagaaaaacttttcgatacgaacgatttgtcggtagatattgggtggtgcacgatataatgtaagggaataggaggatctggtcggaggtggtaaaagatggtagggaaaggtaatggcatacataatagttataggcaaagattgaagggggatgtctaaggattggatagagacaggttgcgggagggtgaccaagaggcgatggtttgaagtaaatgcacctgttcacaataactagactgagctctgtgctcataatcgttttgcctctttttgttgagttttggccaaacctcctcctccttgtaattactacctcttcttcacctgattatcgtcttacaatacatggtcaccactcaatcaccagcttgatcacactctctaaagaatctcctgacatgcacagtctaacatctggtgtaagggtgtaatccggattggagagtttaacagacgtattttgggggtgaacattacatgcatgggaagtcttgttttgttaaaaaaaatttatctgttgtgtggtgcatgataacatagcgcaacatttgtaatgttgtcccaaacactttctagtttcggcacccacaaacaagcctcaattcagaaaggaaaaaaaaatctagaaagttcgaagattagagtggatagtagatagactttggatggagatcgccacttacaaactacgttgtcgaatcacccacattattgcgggaatggagggttctataaatagtgccctcattcgtgcaggtgcataataaattcataggcaaaagtgtttcaattaagtaaagccagtaactccgtaagaggcagaaaaaattattggataattaattattaaattgaagtaagaaatacgaaaaaaaacattataacaatatcaagactgggttgagacggattgatcagttagcaaccttcttgatcacgttcttgaacttggtaaagtatttcttgatacccttctcctctaccttgtcagcagactcggtggcagcctcagaagtttcagcgttgctctcagcagcctcggtcttcttggccttggctcccttgactagctcatcagccttctccttggcggtctcaaaggcgtgttcaacttccttcttggagtggtccaaaaactcctcagtcttttccttcaaagacttggcgtgctcagaggtcacctcaccggttgcttcggcctgggtgctggattcagcaacggcttctgtggcaggctctgcggcctcctgagcgttgttaacaatctcttggttggtagcgtcaatttgctccttaatctcttggttctaggaaactgttagcacaatgacatcacaaaaaaatagggattcaaacatcgatttctcggtcgatatttgacccaatttctgctcaaacttacctctgtagacattgattatcaattgaattggtgtaataaataagagggctagaataaacaaagccacaggggatgaacctatttatatacttaggaggaaatgacatgacgctccttaaatgaaaggtcgcgtaggaatccggctattggaggggcaatattgcatgtacaacaatactacggaaacgacccataacgctgaaacagccgtggaactcgatggaactttcttgccgatttgttgcccaatgtgctccaaaacggagggaagtctttccgcggacagtctggcttgaacgggctagagatggcagagatcggtttgacttagcactcttaaattcatgctttagggttatgtcgcgagacattaatattgggcaagccagggcagatttggctatattcaggctggtttaggcgatccaaaaaggattatgtaagggattttgactgggatggataaaatagttctgattggggcttaatggggctcaagtggctgtgttttctgattgatattggaacctgctgtcatttcgacaattaatatttacttattttggtcaaccccaaataggttgatttcatacttggttcattcaaaaataagtagtcttttgagatctttcaatattataataaatatactataacagccgacttgtttcattttcgcgaatgttcccccagcttatctcgaagatccatcctgcttaacgaaacttgaagccaacataacctttcgaacacaaccatcaatccactcccaaaactctccagtttcctcacctagcgtcgcacttctaaccgtgcccttttatacgtcttgcaccccctccttcgatccgcatccaccgtctagtcaacacacgactggatatctcgaaattcattcaaaagttaccctccctcaactcgaatcacaaacagatttaaaacaagtcgcatcctcctttccatacgaactcttcccgcacgtcgatcaagactcaatatggatttaagagttggaggaaagtatagaataggccgaaagatcggcagtggctctttcggtgacatttacatgggtaagaacctcatatctggcgaggaagtagcaatcaaactggagaacgtaaaggcaaaacacccgcagttagccttcgaggctagagtctacaaggctctggcggggggactgggcatacctttcctcagatggtatggccaagagtgtgactacaacgcaatggttattgatctattgggcccatcccttgaggatctcttcaactattgcaatcgtaagtttagtctcaaaaccgtattgctcctcgccgatcaattgctttcccgcttggaattcatccatgccagatctttcattcacagagacatcaaaccggataactttttgatgggtgtgggtcgaactggtcatttggtccacgttatcgattttggtctggccaaaagataccaagatccaagaactaatttccatattgagtacagggagaataagaatctaaccggtactgcccgatatgcctccactttaactcatttgggtatcgagcagtctcggagagatgacctagagtcattaggttatgttctcatctatttctgtcgtggtgctctcccatggcaaggattgaaagctcttactaagcgacaaaagtacgatcgaattttagacaaaaagttaggaacatccgtcgaagcactgacaagaggattacctgtcgaatttgcggattacatgacatatgttaagtctctcagattcaccgataaacctgattacatctatctaaagaaactgttcagagatctttacgttcgccaaagattcaccaaagattatttgtttgattggagtatatacaagttcaagctgaagcatcctggtcttactaaaggggaaaatgatactcaaactgatgaacaacaacagcagcaacagcagcagcaagtgcaacaggcaatctcccaacaaaagcaacaacaactgcagcaacaggatcagcaacagccacagcaacaagcccaaccacaaccgcaacttcaacaacaggctcaacagccacagcagcaacctcaacagcaacagtcacagccacagcaacagttacagcgagactccgtgcagcaaggtctcaattcggatgttcacatgtaccctatgtaccctgatcagaacaatcagatgtcaaagactccttccactcagcaaaagccagtgagaaatatttcgtcgcctggcctcaagatgaacatccattcgtctgcagctaaagatgccgactactcccaattcaacaatccaagcaacgaaactccaaaggtcaacaagtggctttagattcagcatctgaattatacacgatcagcatgaatttactgtcctatcatcttattgacacagacacgcgcatttcataggaaactattccagccacatttacagttttgtacgagaaaaccaatcttacaaagagttccgtttcttaagtatttcttttcctctctcttctttctctccggttctaagaataccctacaagctttaatgaacagctttggaaatttgtttaaatgctatggtaccagcataaggtaaatgacgtccttgaaggtaaatgctgaattacctctatgatctttagattcgatcctttcctttatgtcctcttacaaggatatctggtatctgacagctcagcatcatgatccaaggggacggtttcatttgtccgttaattgacaatttcaatctttaaaatgaaactatccagaaaagaccacgatcaaaggatgagaacttgagcaccctgaactgagcactgatttctttctaagaaacacactgtttatagcaagtcctgtgacgatattgccatacagttattacttagcatctaggctctcttaatcatcgatgtgacgaaacatccgcatctgggcaatacgtgtattgtttacccaacgcaaaaacgtttctccatatgcaaagagagcagtcatgattctcagtgtaagcaaacaccaggatcactttatactttcataccatcgtatattgatttaatcccacaattcctctccgtgggataaatcaacaaaaaataaggtattccatgtagtctttgtatgtgatatctgatttctccccaatcgtttgactagatcatcaacaatacaacgcacaatgatgagacatcaagattcctcatgattaaatctataaccttttcagttgatccagagaggaagggtccagagttttaacaacttcatcaaaccggtcacctaaaacttgtttcaaatgatttagaacctttgaaacttgttccttcaacggcagacaatgtatagggtcaagttccaacagtttgttgactcggagtaattcattcctatcctgaggtaaaaattccaaaccttcatacgaatagctcctatgataaacctgacaatctcctgaaggtgtttcattgatttcttcaaactgtttggtaacctccgccattaatggtgcaaaattactaatcaaaaattcaaaatctgagtccatttcaatggttagatatggcgagagaagagccaaaaggaacgactttctgtttctgggatctcccagataatctattctcttcaacatgagagagtaaagctggtcaaatatttgggtgttttgatgacgcgatatgtggttaatcatttccttcagcaaatgtggacctatgtaaagaaatcttgacagtgggatcaagactttgttggaagtgataacagcttcatcagtgtttaatgcaaaggtgagcaaactttcaagcaatccactttccatgaattgtgtcgtcagtaatgaactctctagttgattatgagtcctttgcaactgtagaaagaaaatatccaagattgacatgaaaatattcagcgcatcatctctcatgttcggcaaatattgccccattattttgaaaatctgtagtccggtatcatgttcaaacaaagtagggtccaaaagtatgtagcttctaatgattgaaaggatcgtaggaagaatctcggtggaattcaacaatgcaggaacaatcaatgaaaaggtatccaccaatctgctggggatcggttcaggaatactccttagaacttccaaccaaagctcatacccatcctcagacaatacagtgtacttttcagaggactcgctgcaacatgtttcgattagaggtagagtgattgagtatgtctccgttacatcggatttgagacatgcgcagacgtttttgagaagtctcaaaaatgcagctttcagtatagtttcactgttaccccatacttttgttaccagtgacagaacatcaaacaaggagtcacgaggaataatggaattgcattgctccaaaagaattgacagcacattcatgacattcaatttcgattctgttaatgtcatttcactgactagccctatcaagtgagctatgacatgttctgcatatggttgaaagtctgtcctatcaaagtcataatcgtcaatggcgtagcggagtgtttgaaccgctgttattctcacaattctatcctgagacgattgcaaaagagaaagtaaaagtttataaactagttgtcgactctgtttagaacaattgatggatatccactcggaaatgatgaggagtatccttctcaccaatataggttggttttgttcaactaagggaatgaagaccgaggtcagcaaattgtcaaagttgacatcattcgcaagcgaagcggacgacagttgaaatgcagaaagtaaggcatccttggtaagaacttcactaagattagaattaggagaaggatcaaactcattgattctaaccaacacaaaatttctggtttcctgaaaatgggtcaccaaatctctgaaaaagttttcggcacagggacgtatttggtattcccaactattggttaattcatcattagcccactgttcagggtcctccgaccacagttctaaatcttctggtcttagtctaagataattcttaatgattaggtcaattaggttggctactagactttcggtaaaaaactttgtggttaaaactcgaatggctttttcaacttcagctttatcgtgctgtttcttcaatgtcaacgcacctttgcgataaacaaaattcactaatttcttaagcattaacagggagttgatagccaactgctcccaaaaactggtctcatcagagtcttctcgagaattgtagatcaagtcagctttattctccagaattgaaagcatcgtgattaaaatatcggaggcgccgtctaacaggatgaacgacgtaggattgttattcaaaacactgagataaatcttggtatagcatttgatgtagcgctccacaatactaatttcctgacgatctctttcgttcaacagcagccgcaaatgtcttaaagataagttaaaaaagtgtttgacgtcatcgtccctatcatgaaattccgatacaacatcaatgattcttctaatacattttaagcttaaatagccaacttctaccgaagccaagttgaaatctcttgaccatgattgaaaaaactgttcatagagcttaattaggtgcggtgtaagaattgggaccttcgcctgcattgtggctctagctcttccaacttttatagaacccactgttttgatgatttggttgagaatgacaagaatgttgtgtaagtagacgtaatttgtactattcaacagaccttccaactgttcaaaaagattgggccactcgtgaggaaagtcatatcgcacaattcggcttattgcttgagcattctggatagtcaattggttgccattcacctctagcagctcaaaaagccgggatttgatagagtctttctcttgttttgaaatggcaaacttgcgtgtaggtctccagtattgatctactccatttttgaaacaaatgatcgccaaccaccttacctggagcggatagttggtgttaaggtaaatagtttgcaggttgtaatgaaaacctggaacttgttcaagctgctttagttgttcttctgcttgtttagaattgattcccctagactcatcagccgacacttgaagaagctggaccaatcctccaagatccatattttttgtgaggtatgtgtttggggagaactttcgataggtgcatttgcagatgtgctactgattcgagaaacacgggtccagggacctattgagcccaagtcttacactaaactatactagctacatcattatgaaaattgcaacgagggacttcatttccatctctttgtctcatcctcttcccaatctttttctatgtagcccaattcctgtttgacccttttcacggtggcaggatcccccatattcttcccgatattgtctgatatctttatagcatgattaccatcagcttccaaaagcttgatcacaatgttcagaggaggagaattcttgaaatcgttggtcatgcatgtgcctattccaaaagttactttcaagccgagagcctctgctgttttcttatatctcagacatttctcgacattaagggcatcactgaagcagattgactttgaatacttgggcaatcccaatttttcgtaaaaatgagttgctatcaacttggcatactgttcagggtctccagaatcttgcctgaccccaatatagtaatccgaataaggagggacgaaatgtcttagaaatgcttctgttccaaatgtgtcagtaagagctaatccagcatggtctgagcccactgttttaatccagtagtccattgcaagcttgtttgcgttgatgtaatcattatggatggcagctattcccatcatccactcgtgtgcaacagttccagtggccgtcagtcctagttgtttagcaaaatacacgttagaagtgcctaggaaaaaatgtttcaagtctggattgtcattggcgcatttcaatagaccctccagcacaatcttttgtgtctcaaaagaccgccttctccgggttccaaattcactgaacgcacatccattgcttattagagtcttgcatttctcgtaagccagttcgaactgaccgtctaagttccaattgacgtccacaaatttgaagtaagcttcggagatcaaactcagcaggggaatctcgtaaggaattgtttgaacccaagttccagcaatttccaggccaaagttttcgggatcatcctcatttatgagggtaatttctttctcagggtccaacttgaaatccttcagaaaggcaaaaaactcagctggtagatagccgtaatttgttttcaaaaactcaatttcatcactagagtagcgaagatcccccagagccagaatttgcggtttcaaccaagcaattgcctctttgttcagtgagagtgccttggttctattggtgtacttatacttgacagggacgctcaaaaagtttttgtgaacagccgcctgcatagtgatcttgtaaagatccgtgtccaaaagagaaacaatagccattggtggttttatgtggtctggaagaatatggggaaggaatagaaataggggtgactcttatcgttgggaagggaccaagtttgaagggctgataacttttcgcggtgactaatttcatgatactatgctatggtccagtaaagtattcagtttgaaagacaaggaaattcctctgcattgctagagactgtgcaaattgccggaattaacagagaatttggaaagttgatgaacaacctacagtgcaattagcatgcaagatgcaggccagcgtaatagtcaatgcaacggttagtaagtattctattatatttaacaatacactacagctagccgactgaaaaccagtagagccaaaacttgtttaccatatctcttctgtcaggttatccatttatactcgtacaaatacatctcctagaaagcagtctctaacgctttactccttcaattaacggctgaagactatccacccataaatattaatgctccttggttagacttccaagatgttccaaaaaagagttagctacactcgacttttaaccagtgtggttaacaccacctctagatgaccttcaaaacacgctcaaacaagttcgtcaccgtcaaaccttctgtgttttctagtatcttatcaaaagagttggcattcagcatcacagattctgtcaacaaatccatgctattttcaacgttattcagaaccttgtggttagactgagcaatacccaccagagtattaatctcggtgacgtagtctgaatcctggttgaacttgggtagatctttgttggaaagggtaaaaatcatcgaactagtgtctactacaacaaatgtgtcattgtaagatgagtatctaatccctgatattcctttggaaagactgacctctcctatcggcaccaaactatctgctttaaataggtaaactttggactggatatctttatcgtgattataatagttaagcacaacggctataatccttttggcttggtcgacagctactaatgattggcccttagctgggaaatctaaactgaggttcagtggagttttgctccaggttaatatgttgaaatttgctagagacctcttggtcagaagaagtaaattcccgtcatctacaaatttgagacccgtaatccggttctgaaccaaagagggaagtggaatggggtccatctgggatgtgttgacctccaatagtaaaacattcgtctcatgactgagtgcaatgatggagccatctggggaccatgaggcatgcacagattcagatgaagactcaaatcctgaaaatgcctttcgcagggtccactctgtatgctgtaaagctttgttgttggcagcggcaactgcgttagggtctaatgctctgggtctccataaacgtacgtttcccttaccatcgactgagacaaacgcatctcctccatataacgaactaggggcagggataatctcagagacaggcttctgagcatgtggatcaataattttggtggttaactcccaactaccgtacatagcatctcctggaacatgtttccaaaacttcagagaatatgtttgctctccagtagacaacaatgcatcagcagagggggttggaacagaatcaaaggtacacatccattttccgttttcactgacggcaaagcatttgacttttggatcttggatggctagttcacttcttaccttaccgatttgacttactggggcaactgtttgtagggcttgctgctcattacggatatagtcgtaaacttgaatttgggatcggagtggaaaaaatagttggtctttcaccacttcaaagtccgtggtaatatcaaaaccgagtttggtaacatctttatctgtcgactttttcttgttaagacctttgaagcggtttttgacgctcgcaacggagattctggatgctaaatcaatggaactgataactaaaaactccacgatggagttgcttatcaacgtgagtgtgtaaagttcggggttggaaagatcgatgtcgacaattactccattcagccttggcaagaactgctgcttacccgtggaaaggttccagaacacaagaaccttctcaacacctccagaaaccaggtacatttcatccacggtaaattccatagccttcacttgatcaatgtgccatttgagcagtctctctgtgtttgattcgaccaaatgaattataccagttgcagttcctaatgcgaccatgtccgatttttctgcaacagccaccgacatgacgtcccttctatacgagaacttgacgtcagaagaggtgtttgtctccaggtctatcactgtgaccttatgatcagtggttaaaaagacaatctttctgtcgtacaatgacttgttatgcagacggacggattccacagtgtatagtacctctccatccttgacaacttgtctgttgtgacctttattacgtttgccaatgatggtgtaaaattcatctttgtagtggaggacatccaggacagttccagggacttgaaatttttcaactttcaattctagatcacccgacatgaactctttccagttcaaccaaagatggtgaccatctgaaaacacaaaatgcaatatatcggagctcacaagcattctgacaagtttcttggtaatatccagctctggaaagtcacctcgcacggtcatctcagagaacttgacatttcgaaccccaatacgattatccacattgaatactcgtagagaatccgaggagacaacaaacatgaaccttccatctgtactcaaggcactacctctttcgatcaatctaccaccaccatgctcggtgaatgtccaggatcccacggtcattctgttagtttgttgtagtgagagggtactttgaatctggtattagtatttttttttgcttaaacattttttttgcgttaccctacctctggaaaattttcgttaatggggccgacttactaaggaaatatcgaacagtcaactctgagtcctttccaagcaataaccaagaagacacacctcaaagatgattatcccagttcgttgtttctcttgtggaaaagttgtaggtgacaaatgggatgcttatcttagactcctggaggagggcaagcaggaaggtgatgctctagacgagctgaagttgaagagatattgttgtcgtagaatggtgttaacccacgttgatttgattgagaagttcttgcgctataacccgttggagaagaaagattttgatagttaaggtttgattggtggatacgttcttagatggtaatccactagtgatctgtaaactctgttcttagcatagtgattgtataatataaaagaaggcatagataaggattttcatacaccatgctggcaaggcttgtagctgagggatatcagatgagctggtgtactttggtttgatttctaggaccctgccgttcttgcgcttatctctgtttttcttcggggtagttgattcttctttctcaccactggtatgaaggccataatatgccctggtcaaggtgtgttcaacgtgaaaaccttgctaaggctctccaagcacatcaagtcatctacgtatcacacggagtttgtccgtcatgttgataattctttgaaactcccgatcaaaaagtaccttcttaccccggacgaactgacccccaatgatttgaacaatctccaaaaaacatcgtatcagcaaccgttactcttactagccagttacctgctgctagaattaaacaactacaaaatcaccccaggcaacacagactttatggttggccattcaatgggtgaattgacacttctaaccctgcagaaaaaaatatccattgaaggtagcatcaaactagcctacactagaggtgttctcatggaaagtgtcgttgaaaagctggaaaaccccacagagttcaaactctatgctttaatgatcaaaccgaaagacttccgtttcatccaggacactttagaactcaaccctcatgtaaatatctccaatatcaacggattcaatcaaatcgtaatctctggaagagagtccaagtgtctacagctttttgaacagttcaagcttgataagatcagctttaaacctatcgacctgaaagtgagtataccgtttcacaatccagtgttggatccagtgataccgaaactatcattatacattactacacatcaactatttgataactcttccctatcgatcccttcaatatccaacctcaatggtcaggtagtcaaggaaactcaaactttcgttgataatttcattcagactactaataaaacagttaactttttaggttgtctggagaccctaatcaaagaatcacaagacgaccagcttgagattcacaacattagcgcagtcagcaccaatctagtaaagagctttgcgaaacaaaaagggctgaaaaacatcaccaacattgacttggaagagcactattgggggacataaaccacccgtgcaaacatcacggcgaaataggaataaaattgcccacaatacaactgggtatgttgtgcttatcccttcggatagtgaaactgaaacaacagttttttcttttcctaccgtccttagttctcagattacaactggtcaatactgccttctgtgatttatcgaacgctatggacccgtatttctcccagaagttcacactgctttcctcggtcattagttcatagattgtaagctttccattcttcaaatcatcaatcgaaacctccaccaaagacgcaaactccttgtttcctcggtaaatctcaccagttcttctccaaagacatgctggaatagccatcgaagtgaaaactctgtcatagtcaagaagcattctctcgaaatgctcttctaccagtattaaatcaatatctttcaaagtctttgctatcgccctaaatccgggtctaaaagtcgataatggtttcaagatccgttgtcttgaagttatgttcatatagttgtccatgtatgcctgcaatcgggcatatcctttagcgtagttgtagggtttcaacagtccagcttccagtttggcattaatgacctgtttcagcctttcttcaggcgaaatctccgtggtaggatcggcggccgttaaaaagaatttatcacgggcagtgtcagatattacaggctggttgtactcgtcattatttttcacagcaggtgcttgttgttgctgttgttgctgttgttggggataggtaaagtttggataaacttggctgttatcgtacgcaacctccaaaggaggcgcagaagtctctgctgaaatttcttggacattgccggtgttgatgtttccattgttagcctcttgattgaaatgattgacaaggttcgtggtactgtcaaagttttgaagaattggatcattattataattgatatggttgatcatatctggatcgtctatcatggatagaaattcgttcaacgagctgaactcacttccagcatgttctgagaagaaaaacggctgcttattcaaagtactcagtttggtatggctcccattgagtgagttggcagattgtggtttattgtaccccgtgacaaccacatttggatctgaagaattcatctgagaatttgtttgctgtggcatggacattgacattggcaacggtatctggcctgacatggaaccgctaacggcaggcggcgacatactcagagaagactgcatcatggggctcatggtttgttgatgtgaatcagactgctcctcttcttggctggattttctttttaatcttttgctattttgttcgtctctgcatagatggccaatgttccgtttgatgcatcgctgacaaggcctactgtcatcacagatcatatgagatcttctacagtagacgcatgcaacttgaactttttgtctgcgaggccttcttggggccccttctttcctactagcttttttggtctccacttcgtctttggaggactctttctctttagccttcgttgtcttttcttccggttgatctgcagccatgactttgtgagaaaactatgaaatttgaaatgaattggagttttctccccaacttggtgttggtgttgtgcgagaaattatactatgctcttgggcatggggaaacggaaattactcattaggaagaatttatataaatgattttctatatatttaattttgattgcacgatgatgatgtggagcttcggtctgctgaaatcagctgagtatatgagtctatgcaaagcagccactttaagttcagatcaagccctttctatgtagtcgtccagtactttgcttgactttacagtggttgactcagtgggttcggtattcaaggtagcgcgatgaaaaatacctaacctgataaaatgctccatcccggatcttccaacatgatctcttccatgatggcaccagcctttcaagccataaggcagccgttgaaaaggggcaatacgggagtgaattctttcagatcgatgcgctgccagtctactcaaccgaagagtcgcatgcccaagatgtccacccaagaattccaacagctctatagagagagacaacaggagaagctcagaatgaagaatagatcgattggattatacgcatcttctctcgggatggtgtttttgactttggcctttggctcagttcccctttatagagctatctgccaaaagaccggttggagtggaactccaatgactgatgtttccaagatgactcctgataaactgatcccagtggacacgtcgaagaagatccgtgttcagttcacggcggagacgtctggtatcttaccttggaaatttgtccctcaacagcgtgaagtgtacgtaactcccggtgaaaccgcattggcattttacaaagctagaaacgagagtgctcatgatatcataggaatggcaacatactcagttacccccgatcatgttgctccgtatttcaacaaaatccaatgcttttgctttgaagaacagaaactggcggctggagaggaagtggatatgcctcttttcttcttcatcgacccagaattcatgaacgaccctactatgagaaatattgacgatatcgtactgcattatactttcttcaaggcaaattatgggcaaaacggacagctaatgaccagtcctttaatccccaggtgaattgaccacaaagaatatcctctgtatataaaataaagacataacattctcgttttttttctatgagggagtagtgaaccgaaatttaggttcgtcatcatcatcatcagattctatcacatcaggctctgcaggtttatttctcgaagttatacttgatcttgtcttggtccgaggtcttgactcaaactgctcagtctccatttcactttcttcgtctgattccgctacaaacattctctttcctttatgtttgccacttatatctggaaattggctatcaagatcctgtattggttgattcagttcgttcaaaaactcgagctctttggtcagaaccttttctttttcattctccttctcgatttgacagtctacaagaggaacatatatctttgtggatatcaggctaccttgtagatctttccttttgaattttttgaaattgactctccccttccattcaggatggaatggtgatttgtcgacatgtgatctaacggaggctttttcttttctaaataaagtctcgtcactgtgaattttaagtttttctcttgtgtcattagtggtctcttccaaaagctcttgaatatcgtcatctatagactccttcaacttaagctccttagcttgcatgatcatcgaactaagcttttgttggttgttggaagatgcatttggattcaaagcgtctatctgagaatcagtgtatttatatgttttaggttttttagctttagagacttgagctgtggtggagactaaagaactgggaggttctggtgtggctttgggttcgtgttgagaaactaaacctgatccatcggctatactgtgctccttcacgggtaattccgtttctacaaccatttgatcctcttgaattggggttgtcaatttcacctctgtcgtctggcctgtagctttacccaaaggtttattcagttcttcgatttgagtctcttcctggtcatcatgctgggtcgatagtatgttcggttgtgagacatcaatcatatcttctaatgcaatctgtttcattcgatttctgcgaaaccttgattcttttttaacggtagctactgatggttcttctcctctttgagctgactcaattggcttcttttcatgctgctgagacaaaacctgctggctcaataactccatcgcatccaatggtttgatttctcttcttttgaacctagatctctttggttgtgtggtattagtttccggtggggaaacttcagagatttgtcgctttttatctaaattcaggggttctttggtcaataacatggatgaatccactttgagaatagattccatgacttgagggtttcctacaagtttgactcctaaatatgaggccaacttcttcatcttatgatgttcatcttctctttcaatttcattactgggcttgaaacaaattatcttttggggatcaagctttttcaatccgaacttctcagagagaatttctgggggatcttcaagatcaagaacaacaagctttccttttgctagggcaacaaaatccagaaaaagagaatcttttctgctaaccaagaaatacagcccttgaaacaactcgtatctccccctattaaaccgaagagtcgcctctggaacataattttcaacatttgggagttcaaatgagtcttctaactttcctttacgctcaaatagtacttttaaatagtcaaacttcacaatcggaattgcttttatgagtgctttggccaatttgctcgtgtgttgacttccctgtagaaacaatgtaacattatcaacgtaattggtcactaaccggatgtccaagctccttgctaaatgaaacaactcgtcaagcctatcctcattatcggatctactgtaccagagcaccgtgttgacccatttgaaccgcacggagatatactctttagtcaagtttcccaactctagagtgaccgattcttgattgtaatccacaggaatgtcaacgggatctttcttcgctttgtagatctttccagaataatgaacttttccctgaccaacattttgaattagtagtcttgaaatgtgttttggatcttggatttcttgtgatgaaggttgatcaaccgaaattgtcaattgtagttttgacacatagggctggggacattgaaagtctataatgctttgttcacttgttcgtgatcctctccccaacttatacacctttcccggtatcaacaagtgctcttgaccatcttgaatcaaaatccacatggtcaatgctcaagtcttgaatagaagattagggaccctcgattacctaataaatatataaatactttattatacagactccaacttctcatagaatcccttgaccacggcagatgccctgatcttagaagggtggaatcctacaatttgcagcctctccttgctgacagctcgagataatgcaacgtatacttgcccgtcggcaaaagttcttctaaggtcaactttgactcgatccagcgtctgcccttgagatttgtgaatggacaatgcccatgataagagtaaaggcagttgaattctggtgatgcgtacattattgttcttgacgtcaataggaaattcttccctctggatgagttcgaatcgtgctcttctggagccaattgcaaactggaccaatggtaaaacctcatcactcctagtccttgcaattgttatcaactcatccatgatttgttttcgatgaggagagactgtatccaattgtctgaataatgattcatctggctgtggattgttcatgaacttgctgacaaggtttagttctttgatgacatcttcttgtagaagatcaacagttgttagttgtgtttgaatgtaatgccacatatcactggtcatgaaacattgtactttccccaaagtaccattgaccagttcttcatctttattcttaagcatcatcacctgacatccctctttcaattgcagacctgaaggagccatgacatcatttagtaacttcatgatatagggtggtgtgtctggcctgtcactcacgtccttagcggtatatgtcactaatggcccttccaatttggccaatctggacttgtttgcagcctcaacttcattacgagttgcatatagctctgtgggttctatcccatcggtgtagacaacttccttgcctaatttggagaactgttggatgatttcgggatagacatgtccttctctcaaagcattaagcatgtcaatcaggtccatgtctgtctgtctgaaaacctgttttagaaggattgttttgttgatgacagagtcccaacactctgattgaaaacagtacgtcattttggtatctttgtccggaactggaggtaattgaaaaaaatctcccgttaaaacaacctggattcctccaaatggtaattggtttttccttacaatttgggccacttcattgagcttactgaaaaggaccccatcaatcatactgacttcatccatgattaataccttgacatttctccacctcgcataagtgtttccgtttttcttgattagacctgctaatgctacaggggtttgttttccaatgccaattcctgcccaacggttgatcgtttgcccgccaatgttgacggcagcaagaccagtggatgcagtgacgccaactttgtccggtccatacaagttattcaaacgttgaaccaactctcttagcaccactgactttccggttccagcactcccggtgtagaatatgttgaggccatcgtctactactaacgacagaactttttcttgctcctttgtgagtgaaattttggatgcaatagttggtatagctttggaggccattctaggattcttaataccgcttgaagcgtcttttttcctactccaagagaactgtggtacctcccagggcaattttctttgatcagaggctgctttcaacggagcaccatattgtttatctagtaccgagttttcttgtttctgaatgcggatcttcttgaagttattagccgttttctgagacaaattaggcagtatatttgagggcacttcatcaaatgcctgcctcttttcttgggaaaggaaggacgatggcctaacttgtggttctgacagatcaatgacatcttcggtagaggcctcctgagaagaatgctgggacgattttgggggccccaaatcggatttgaatcttttcagggcactgaatcgatcgttcttcgacctggaagtaaagaatgcattgatagacggctgatttttgtcctttttcttctttgtcaacattaccttacaaatcctcaaatgaaaacagacgcgtaaaaatgtacttcgagccgttggagcgaatgcaccgttggggcactgcgtccagcaagagaaatccactggggacatacacccctctacagaccatagtaacctaaatttaatattattatatatcatacaatggtgtgccatctgtgccactgctcgcacccccaaattaagagttgaacgaacaccaggttcaagaaataaactcaacataaaagaacggaagaaaacatttggaaacaaaacagttggagaaggaaagtgtagaaggtgtgttggcacgggcaagacatgggatggggacattagtaaactagccagctagaaagagctccaagtccaatccgatggaactatggaacccatcctttccctctggggatcttcatcaggaactgtctgtttgacctgtaatttggagacagatgatccaacattgttattgtactgtttgacgagatattggttccaagatttggcacatccattgcaaaccttcgacttcattccatgaaccaggtcgaattttgccatcaagttcaacgaagctcgttgtgttagacaattggaacagaagatatcaccacaatgtctgcagtgatgtcttctgaacaataatgaaaacttcacttggcaatccatgcacgatgatcttttgttgttttgcaaccagtgagacttgattgggaccatcgtgtaggggaaacgggctgcattggcatgattttcgctggaggaataatggtagagcttgtcgtcgtcgtaagatgagttgtcatcctcctcgtctggcaatggagaagacgaacccagttgaaactgcggtgtgttgcccacaaccaacgaatgggagctggaaggacgaagcacagcagggacgtaattaggagtttttggttcgttaatctggcgtatggggccgctaataccgttgcggctacccctattggagaagctcattgggttgttaccattctgagcgttttgtaggttgtccagccttgagtaggatgcattcgtagagaaccctggcaacgtattagacagatcagaggatatctcatcgatcgagtgacgtcgcaaaggttgattaatatcaaaggttgctggagtaaatgtagagtttgttttgtccgtaacttcttcggccaccttcgtctctgcggaggtgagagagtcgttcgataagttggacgtgttgcggctaaattctttattatcggtctgtgatgtttcgactgagcctggtttggtggcctggtctttgctattctggctgatgtcacagcattgaaaaggttcatgctgagcaatcttgattgggtttgacttgaaaagcgattgcgagctcatcttaggggcacgtatctttgcgtcgtagtccaaatcatctgggttgttgtcagtttgagcgggctgagttttgtcctgtgttgagctcacctcgctgctgtccctgaacgagcccttcagagtcaagtgataactgttgaaatcgggggtcagattagagatggtgctacaagaagcagttcttgtttttatcggctgcttcttgaatgagagaacgggggagtcctgatcgaaatccgccgattgctcgtcgatcactcttatgctactatcgatcttcaggttggaagacattaagcagggagttgggtggaaggggactttttcttttagagagtcggttgttatggagggggtaaggtttatgacactttgttagttcttgattgatgggattgaggatcttattaatttactgtgcgtttctttttgactgttgagttccggtcctgactaaattggccggaaatgctggggcgattgtcgagataataccggctgattcctcgaaattctattgttcttcaggcaagacctagcatacgattagaggaccggagaagatcggggcgctgagctgactaacggcgggaacagagcaaaaagtctgccggcctcctgtatagccgaattttgttctagcaagcaactttgccacccaaaaagcgttctagttattgcttcccagggtactagttacactcgatcacaatccgggcactagagcaagtctgcatggttgtacattacacaacacaattcgtgggtgcttttctttttctggccctaacaatgctgtgatcttctttcagcctgcttgcaagaatcaggccaatcaaattaggcggtaggtaatttcctctgttctcctacgttaactgtgcacgaatcacctaggataccgtaattttgaagggtgaaccggaacttcttccgtccagataccgcataccgatccttcgtactgcttgcagacccgccctgtcttctcaccgagatgtgctctatctatacgataggccccctccgaaattgccagcaattaacttatttgggcaaatttgctattcattttctgcaagtcttatgtagtcacagtttgcatggcaagccagaggtccccttcacacactccttgccaaggccttaccagcagctactcctctaccggttgtgtgtctccggattctctgacgttacattgcaacattagtacttcacactacttttcgcgtcaccgacctgggggagggctcgcaacctccagattgtagatactttttcactcccgcaattttcttgcgacacactccccttggtgctccccgcttatataatcaaatgtagttccttccaacatcagtgcgagcgagggctcctgaaaatttcaatcagtgccagtcaaacttttctctcatacccagagaagattatgttgagggccagttgcaaggtatttaccagacgccaaagtacgtctcttctgccccagttcaaaataaaagatctagagttcctcagggacaagggtatcactgggttgtactcttcaaaaggactcaacaatgtctggtacgacaaagctgactactgtcgagaaaacttgaaccagctccttcaacaatcggtgaacaaaaatgcattattgtcttgtttcttgaacaaatcgcttgacaaaggttcgatacatttgagcgacacatcagacagcatagacaggctcaatcagcttatctcaaccgctgctcaatcatgcgagggcagtgaatctttcactgttgatcacgagatctataatctttccacacagctgtacaaccatcattttgccatgtctagtctaaattcaggtggtaacgagtctaaccgtgtctacaagccagatgcaagtgaactattaaagacgcatcctaacactgatgtttccatttcgttatcccatgacgctcaactgttgaagcagatcaaatcctcctttggatcgttggagcaattgaaaactcttttgatcaactctagtctggccatcaagggaaatggtttcacctggttaattgcactcttcagtaaatccgactcaaagttgtttctggatgacttgtatgtggtcaattcttacaacaacggaactccatccgatcgtttgaagaacggccaattggacgacttcagagcattcatcaaagaagggaactcgaattctgagtttgtcaaggactaccatcaaaacgactccttcgattttgttcccctactagccataaatgcatccccctatgcctacctgtccgactacggcgtctttggtaaaagggtctacttagagaacgtctggaattgcataaactggccaacggtagcctcaagatggcccaaagaggcctgattatctacttcctgtatataatataaatcaaagtcctattgtacaacataaacactatccatcctactttctagaaaccttcagacttctaacacgcttcagtaagccgtttgcaccattcctttcttcgccttctttatggtatatgttgttgtcctcagatgttcttcttgccgtaggcggactggcagccttcattctacgtaataacgatttttttctactcagttcattgctttttgccgcatgatcttgcaattcggcgtctttgcttgcaggggcaccatccaaaaaggtagaacttcctaaccctaacgtcgtttgtccatgcacaggctcagcctttacattggtgtcaaactgaacgacagagggatcgtgtttaataacactgggtaaagaggtcgacgtactgttcccattctgatacataggctgagaaagtcgttggtttgaactcattccccgtgccctggatgcattcttgctacctgcgtatagggggtcctgctcagaaattccaaacacaatgtccatctgttcttcctttgagtgtagtggtcccatccccttgattgtgctgttgggaccatcaactgggaacgccatcactggcggtgctttcttgttcgtgtttctgtggggtgtacatgcgtcgaagggtccatcgtgatggaacccaccgccgccaaaaaatccagttacgtccagtttatcaatagtgtcaagattcttggagggcttgagaggatccttgtcttttttgcttctacccttggtacttctttgcctatcacgctcaatatagcgctgtctttccttttccttttcgcgttctcttctaccactgcggtgttgagaatgttgtttggcgtcatcttctctgcgtgggtgagaatgtgaacggtagttgtgggatctagttgaccttctttcttcctgtgaccctagcggcttctctggtggatattctttcgtcggagaggagcctgcaacctcctcgtaagaaggaggcaactctgggctttctttgggaggctttgaatctctattaattggcggggcctgttggcgaattggcgtattggccgacccgcccgagttgctttgtagcaaatcctcagcaaaaggattattggagtacttgttcattctatatttcgcaacagttagtagcgtgatatggaagaagaatggcaaagcaagaccagacccatcagaatatgtttgtttcacttaaagtaattggaagagacacgacgtttgcaaataaagacgccctcactttgatcaacctgtttagcatgggggcaatcgacaacaaacagtgacaaacatggagtagcgtgatacctgtgttcatgtaaccccgtgagactcaattgagctcaatatccaattgagaaataaaaaccggaaaaacaaatcactcggacgatgacggaggtctgctaaaaataataaactgatacttactggttactggagttggtcgaagtaagctgtggtctttccaagcccatgtcaacaaaaacggtttctgttgcttcatctgagagatcttctagttgggcaacgttatctcgccaagctttaaaagtcggatcattcgattctccaactgacgacgatgactggttgttcccgtttagtctaaaggggttgtaagatgagactcttcgggcagatcccgaagaggctctagaggagttctgatgagtatacaaggaagtcataagcttttcctagctatgtgagtaaagaatggaggaaggggaacgatatatttggagcgagggaggtttttttttctatggtacgcgtctagtgacataatttttgcgtgggggaacgggatgttctagaagcgcccagcagaccaaaaaaacaggcatggctaggaaagaaggcaagaagtgcaagagctcaaactaattcttatatgcttgttgttaagttgcatgccgcgttggaagctgcccatttaacgggatatagatctgttttggatgggtacgtcccccttccttcgccgattaccagaaacggaatgattacgtaatagtcaagcccagcgaatctttcaccgtcaagtcaccattataactcaaaccaggatttgtccctcttgaacgacatggctgacaacaccaagaagagaagactcagtaatgatgtcattggacaactgcaggatgatcttaagcaaagccccttgaacgtcaatacctgggacacgcttattgataaagtcatcgccaaagacaaacatgaacaagtcatccaggtgttcgaagactgtctggtgtatttctcctacttgggatatttttggaacaggtatgctacatatctgctggagaggctggagtttgacaagaccaaagagattttcaacagatgtttgcccaaagtggcaaacgttgagttatggcgaagttacattagatacgttagacgaaccaatagcataataacaggcggtgaagaagctcggagattgatcataaaatcctttgagatcagtcttgagaatatcggaatggattataatagtgacgttctctatgatgattatattgaatttcttaacgaatggcaaccaataaacccaaatgagcgaaaccacaggaacgacttgctaagagggttgtataggagtttaatcaagtcaccagtcaaagacttggagagatattggacagattataccaattttgagaatgaagcaaatccaaacaagcaaatcagtcggaaactggtgaatgaaattagtggtgagtacatgaataccagaataaaattgagtgatcttgtcaataaaattaagggaattcccaaagccgatcgatatctcatgaataacgaatttgatttctctaaggtaggatcactttcgttggtgattgcgtggtcggaatgggaaagaaccaatcctttcaatctagagaagaatgttgtaaagaaaagagtaaacctatcttttcaaaaatctcttcaactatatccattcattcctaaattgtggtacaattacttcacctacctcatggaccagcaacaagatccctcaactgaagctaccaatggtgaatccaaccaagcacaacaggctcaagaattgatagtcaccgttaaacaggcaatttctttgaatccaacaagtttcatccttagtacgttattatcggatcttttgcaatccgacggtaaagatgtggatactattaagaaagtttatttagatctcattgaagcattacaaaaatattacaataccgatcaagtggaagacagtatagtgaatcgatcgatcactgaagcctatatcctgttgatgaacatgcttaaatcatccaaggatggtagatcggaaatccgtaaagttttctcccaagctagaaaatttgaaaatttaacgtatcattgttacgtccaaaatgcttatctagagtactatacttttaatgacgtgaaagttgctaagaaaatctttgacttggccttcaaaaagtttaacgacaacattagtttcctcaactactatctcaactttgtcatcagcatcaaggatttcagccaagcaaaggtcgtatacgagacatttatcaaaagcaatcaagattctctagatagagagaagttatttaaagtctatcagtctttcatgcaatttgaaagtcaattcggggatccgatttcccttcgaaacttagagaagagactatccaaccaatttggtttggactccttatacttagctatgatcaaccgactctccccgttctgtagtcctagcaatctgttggaattagaaccgccttttaacagtgttaaacagatcgacgaaaagcaaggatcactagattctattctttcgacgccagtatccgcatcaacatctatagaggatccaactaatagaccgaagaacggtcccaagaaacaaaaaatcgacgacaatctggtaataaaggatgatatctacaatctgttgaggatacttcccaaaaaaacgttcttcaaggacgttcctatactcaacgagaaacttgtggaagtacttaccagcttgaacctttgaatagtagtaataatagtaaataataatacaaaattatatacattccatcctgtaataatacaattgaaggaaatgaaacaaaaaaaaagacaacaattaagacaacaaacgttataataacgaacagaactgaatgaaaaagaaaacgaatcaataataaaaacagcgactacttagtcgtttgattcgagttgagcttctgttttggtctctgacgaagcattggacctgcctgaatcccagagaccttgaccatcggtgtcgttactatccaatcttccgcctctgcctctccctgaacctcttcctctcgccctcccccttcctcgtcctcttccacggcctctacctcttcctgtttccgatcctttgtagccttcgtgtgaaccacgatgagcaccgcgaggatgtcgtttggctaaaccaggaacgttggtacgtttaggaacaacgttaagttctttctctttgaaaacatattgatggaacagttcaatcgccttcggtactgaagcctcctcttcaaactcaacatatgcatatccctttggatgaccagtatagtggtcgaggagtatggtaactctgttgacaactccagccttagtcataatctgaaccaattcctcaggatcggcagaagagtgaacattgccaacgaacaccgatcgtttatcaatgtctgcttgattggcgggctggaattcccccaatttcagcttgggagttggttctggctttggcgatatttcattctcttcaggcgtcacaacaactggctcctctttctcctctggagctggggcttcgttggccgttccttcttctgatgtggcagagtcctccttcaacgtggccgaactattgtctatattcaactcctgcagagaattctccacagtgttttctaagtcttcagcgacagcaacatcgttggattcgggagttggaggcaatggtggattaacagcttcccctgctttatcctcaatcagcgtttcatttttgtcgaccgactcgggtaaaggttccgctgccgaggcttcctctgtcattgttgcaccgaataaaaacagagaagaaaaacgccagagaggaacatgataccgaagtatgccccagaaaatattggcccaatccacgaccacgatagaagtgcgcgaaacaaacgaagaaaaaaaaaatgagaactttctctcttcagtgaacagttgactagaacatcaaaacaacagcaatggtgtcggtcagaagaagaaagagtaaccacagtggaacctccaaagtgtccgtaagggtgaaagacaagcagaggcggcacatcgccaccaacaaagttttgagagctcattgggacagtaagttgaccctgtcccagaactacgccaagttgggacttcggctgaagttaggtaaacccaccggtggtgtggagaaaccactggccatagataaaggcctggatgggaaaaagcacgataaatctcagagagaggacgaaaacattgacgatttttacaactccgaaggggagattgatccagccaagatcccggagggaagagctcacattgttcgtgacgaaagcggagaggtagtcaagattgtgtacggtaccaaagtcagcggaatgtttgaacagggtccatctgagaaagaggagccagcacaggaatcggtggtaataaacgaactcatggaaaaagcacagtccaggcctgaaaagccacccaaaagactgacagagttggaggaaatctgggtggatggtttgcaaaagaaatacggtaacgactatgaaagaatgaaatgggatcgcaaactgaaccccatgatgctaacgccccgcaagttggagaaactgtttgaaaggaaattgcaggtcgaagattacgacagaagacatacagcatgattaggtcacacggcttgtcgtttttctttcttttttttacccacgtagaaggattatagggactgaactgacatgacatgtgactgtaacagataggtaagtaaggcacataatttaagtgacagtgtcaacaatgccaattttttttttttacaacaatgcccacgttgttaccgatgctcgcacgtagattcctttactggccaagaacttggcgcgaaatgtgatatcgattgaatctgataaaagaaacaaaaaaaaaaaatttatccggtgtagggatgtgactaaacgcctcgtgtgacaacgtgggtggtatctttccttcgccacgtgcgcgtgcaacctattgtatggctaaattaaagggccatgtcaaagacccttaaacccttgataatagcaaagactggggaagcaggccctgaaaagacagaacaatcagaattctctaatttcctccaccagagagccgtccaatggcatagattacctcgttaaacgaaattcgaaagctcaatttccaaatacccactttccttttcgatccttattgctgcaggacctactctccaaagtcttggcaaggccacatgtctcaatttttaattgaaaaccgttagaaagtgaagccgactttaggtataaatagtaggaaccccagcaggcagagctgatcacttgtaaacctttctctgatacacacaagcatctatttgagtactcatcttataatcattcacaatgagtttggttgcacttcatcaattcgactacatctttgcgatcgccatgatgtttgcattcttggatgcattcaacatcggcgcaaatgatgtagcaaactccttttcttcatcagtctcctcgagatgtctgaaatactggcaagcgatgatcttagctgccatcatggaatttttgggtgccgtcttagctggtgcccgtgtcactgacactattagaaagagaattatcaacgttcacgctttcgacgacgacccagccatgctgatgttgaccatggccactgccttggtcggttcttctgtctggttgagtattgccacttatgtcagagctcctgtctccaccactcattccattgttggtggtgtcattggtgctggtatcgctgctaaaggtgctggtgagatccactggggatggagtggatttgccaagattgttgcttcttggttcatcgctccatgtgttgctggtggattcgcttccgtccttttcctcttctgtaagttctcaattttggagagaaagcatgatgccagaaatgcccttctgtttgctccatgtatcgtcttcttgacttttgctgtcctgacaatgttgatcgtctggaagggagctccaaacttgaacttggacgacctttctactggtgctaccgtcggttctatcttcggtgttgctggtgttgctacaatcatttacatcacattctttttcccattcttgaaaagaagaattatcgatgaggactggaccttgaaatggtaccaagttttctatggtgttaagtactggttcatgtctaaagacagcattcctccaaagcctgataactacgactttttcattgactactatgaaggtagacgttacgaaggaggtgaacaagactctgctattgttgccgatgccaaagaagaagccaccatcggtgaactgaaattgtctgacaacagcacatccaactccaacgctgatgagaacagacttgtacacgagtccaagttggagcctaaggaagacacaaagactaaatggagtaagttggttaagagcccaaaacaatggccataccttgcatggttgatcatttctcatggttggactcaagacgttatcgcttctcagaagaatggtggtagattggctggtgacttgcaaggaatgcacggaagagctaagtactactccaacaaggttgagcacattttctctttattccaagctttcactgcttgtactatgtccttcgcccacggttccaacgatatctctaacgctgctggtccattgtctactgtttgggttgtttataccactaacgacgttgttgcagagccaccaatctggattctttgttacactgctgctgccctggtccttggtgtctggattttcggttacagactgatggccaacttgggtaacaaattgactttgcaatccccatctcgtggatttgctatcgaattaggagcagctatcaccacagttttcgccactcaattggagattccaatttccaccacccaatgtgccgttggtgccactgtctttgttggtttatgtaacagggatgtcagagctgtcaactggagaatggttgcttggtgttaccttggatgggttttcaccttgccatgtgctggtttgatctccggtatcatcatgggtattatcatcaacgctccacaatggggaggtcaatacgaattgactccttagttttctacttttgtattttatttaatcaagatattgatcttttgaggcctgtgtaaatgtctaaatctcttctgacaaatatagcaaatcgagaaaggggtttattataaatcgtcttacctaatacatctgagtataaataaaagccgggggtagatctaacttttcagttccttcattgttcccatgtcgcttcaaacaaacaacctttccaatatccagtacttgcccttgtcgagtataaagagaccgataacaccagtactagattatgctaagatagatgccatggagtcaacacttcgaggtgtccctatggcttcgtccacttgccctaatatttcagagataactgccggagagttgcctcctatagacgttctttgtgttagacacgagggaaaaacccactattttgcattcggtgggtgccatcgtttccaagcttacgatagaatgcagcaaaaagaaggagatgagacaaatgaaaaatctcctgtactggttcgatgcaaagtgcttccagccaccgttaaacagttgaaattgtacctaggagcttctgttgaatcagttcttaacgagtaaatcgaccggaaataccactacttagcacgatgttcaactggaggtcggagattccactgagggtccgagtgttatcgtcattacaactgacgaaatgcaaagttggcctcatcaattttgagatttgggaagttttcaatagttgttcaactatctgatcacaatgagttcgcctttgagctggagaaattttgtcaactttattgaacaccaaatcaaaactgattttgctctccaccagttgacttaatatcatttcatcaaactcattaattccaagatgagcattcaatattagatagatttttcttaattgctgtctttcacggatatactgcatcgtaagttcgccttgccactgttttcccttcacgccgtagcctggcgagtcaactaaacgcaccacgtttcctatgttatacgtattaagacatggggtaagaccagcaaatcttttcactcttgccagtggtttatctatcaacgagttgataagcgaagacttgcccacattacaacgtcctaaaaataggacctctggtagatccttgtagtccctgggatcatagatcggagtaatttttttctggggtttacttgcttcttccacgtcttgttcagcgtcaaactcttcagcttgacggttatgcggaaggttcttgaactcataaatactccagtcaagtttgaatctggcattagaaaatagatttgctgtgtagctctgaactcgttggtctggcttgattattttttgggatagactgtgtttcggattgtatttcaagttgaggtcattagttagtgatttgggagaggcaatagattttttggaggcacttttagattgtttggtcgggcctttataaagaggtttggttgtggactgctttgaagagctcttagctggctggcttaaaatacgagagatattgacattgcccacatatttttccttcatgaaggagatgaggtgaaatattctttagtaatctagcagggaattcttggaagggtaatttagacggaagacgtcatcttgcggaagggtgaaacattccaagcagagtgctggttccgagattctccgctcctgtagaaaccttcaaccttccaacattagaaccttcgcgaatagactccctatccaatcacgtttctccgtttcaaggaagtagcctgggtgtccggtacgccaaaaaaaaaaaggcctcaccggaacttgacaatttcattcattttagctcagccttacaacagattcaccagtccatactgctctgccatctgccaattatagtctccgagaaaaaaaaaacatcatgcttttcactgtatttcttccttttatccacacccccaaccgatcaaccctgcttcacgtcctcctcggaagtggtgctgcattgggcccgtttttagtttgttcccccacactgagatgaacaacccgactctcggttctcaattgcgcataaacgtcactttgaatagtctcgctaaagtaccggatatagctcggctacacctcgtattaccccgtaactatctgtcggagccgaccccttgattcacattatatatatcgtcgacaacttccactattctccaaccctcaaccattataatcccttcaatgttgtccacaattgccaagcgtcaattctcctcctctgcctctactgcctacaaggttgccgttcttggtgccgctggtggaattggtcagcctttgtcgttgctgatgaagttgaaccacaaggttactgacttagccctgtatgacatccgtttggctccaggtgtagccgctgatgtatcccacatcccaaccaactccaccgtcaccggttacactcctgaagataatggtttggaaaagacactgacgggagctgatctggtcatcattccagctggtgtcccaagaaagccaggtatgaccagagacgatctgttcaacaccaatgcttctattgtcagagatttggccaaagctgttggtgactacagtcctagtgctgcggttgctattatttctaacccagttaactccactgttccaattgttgctgaggtcttgaagtccaagggtgtctacaacccaaagaagctattcggtgtcaccactttggatgttctgagagcctctcgtttcttgtctcaagtgcaaggtaccaacccagccagtgagccagtcactgttgttggtggtcactcaggtgtcactattgttcctctgctgtctcaatctaagcacaaggacttgccaaaggacacttacgacgctctggtccaccgtatccaatttggtggtgatgaggttgtcaaggccaaagatggtgctggatctgctacgctgtctatggctcaggccggtgctagatttgccagctccgtgttgaacggtttggccggtgagaatgatgtcgttgagccatctttcgtcgactctccattgttcaaggatgagggtattgaattcttctcctccaaggttactttgggtccagagggtgtcaagaccatccatggtttgggagaattgtctgctgctgaagaggagatgatcacaactgccaaggagactttggccaagaacatcgctaagggtcaagagtttgttaagcaaaacccataagtttgattatatgtacttagattatttttcaatgaaatgaatgagatttggagatcctgggtgacgatattgaacgtagtcaaacagctaatttttttcttttttcccttcaaaatgagcacagtaaccatagttccttgcagagcactcacaaaagtgttgagtagttggttaccaagtacatttctggggcaaccggtttagtatctagtgggagattagcccactcgttaacagcactagggtatttttagaccccctatctgggctatgattcgggttagctccagcagcttccccatagagcgcagtctagcaagaagtcttgtcatgtagacccctctgctccgtgctgtaattatgcggtgaaagtgctttatccgatagactcctcagtcctttcaccctcactcatgctcctcctagtaacaacgaatctaaaatcctcatctgaaatttcccaatcaggaaatcttggtctcattttgctctcatcaccaaacttcactcggcaccgccaaaccaattctcttcaattagagctccatatacgattggcgcatttagttcagtgtatgtcccctctactcatatcttactgctaatcatgacatccccaccacataatcctttggccaaaattaaccagtggaaggactcagcttggtctcacatgagcacgaagcttcacgtcaactcctcaagtcccataaatgacgagatcctggactttgacgaccaggtaactcagtcccctcatgacacacacatagatccagacaactcattgtgcttcaaagataccaccaccgagctggatgtgactttggacgatttcgacatgagcgtggatacatctgacatcgtcgctcacgcgttacctatggaatcagatttcgatccagcgggcggtggtgatgatgatggtggtggtggcggtgtagctggagatgaatatactagcaacaatgagccgctccacaaccaggaccacgatcatgtccatccccacgatcatctccatcaccatgaccatgcccatcacgaccaccatagtgacaatcttcactcacacaatgttcatcctttccaaataagtcaatcgaactccagttcaaccatctcatcgtttgactcctcggcaccgacttactcagacactttacccacaaattctctacccagttccatgtcaccttccaacacaagaaccccggctagacgccgctcggtgtcagccacgccgcagacagcctcgcacgggttccaccaacagccgcttgtaatgccgcaatatcagactcccatcaagaagactgattctttgacgccgagacggctgaaaagtcgttcattatcccggctgtccctggatcatctgaggtctcctgcaggaaatcctttttacacaccgccggcctttttatctcccaagctagagagtccttacagttcaagagatacgccgcaacaggaggtagtgatgatttctccgtcacagctctctctatcactgaatcgcaagtcacgttccttcacagctccagctgggataccgaagaagcttcgtacggccccatctttttcttttgcagatttacctccacagcctttaccacaatctcatagtatgtaccatgttcaaggtggttcgcataattctgtaccaaaatcggccccagcggccttcaatagcatgcaaagatccaggtcttctacaaatctatcggcaattgcccttagtaaagagtcttcgctctcccggcggaacgtaactgccttagagacacctttccaggtccgacaaacgagccagcaacttcaaaaagcctccacagtaccaaatatgcattcagaagtgaacatgaccgttccagaacatagagaagtgtttcatgaggagatcgaggacactgacaaggtgaaggagattgaagaagagaaaaagaagaagaaattcagctgtcccgtatgccacgccaggtttcaaagaccagagcatgttaagaggcacatgaggtcgcattcaagtgaaaaaccttttgtctgtccagaggaaggttgtggtacccgatttaacagaaaggataacttgaaggcacatctaaagaaaatccatagtctgcataagaaccaggtgaaccaaaaagtagatggtaaagaatatgagtaaataagattactgtacttagatttaaatttgtttttgaattcttaacacattcgtattcggttttttcctcctttcgttgcagagaggaagcttgctgggagttgtattagccatttctaaagaatgttacgtacaacagcttccgctggcagtgcctcaacatcaaagtcaccaacaacgttggaattacggaactcttgatgtgccaatgcagcatagccataacaagctgctgacagggtgaaaagggaggccacaacgatcaatgaggtggcttgtacgattattgatagccattgaaccagggccataccggcatagaaaccagccctaggccaattctgcttgaatcgatttataaattcgatgaaattagcactcatagggcagatcttcaacaagaatggaacttcaacaaagacaaccactaaaccttgcacaatggagataatagagaataatatcaccaagctgaagtggaagatattcgcaattcccaacgctaaacagaaaaaaatattgataatggcaatccattggccgtaaatactaaagtttctggatttaaagtcctctccaaggcctttaaagttcaagtagtctgtgaaagccatgtcctcgtgtctgtttggtttgaaagagaggcttttgaccagatggccttagaacaatagtgcacatcattcgcgaaccttccccattaaagctgtatgataggtgtcaggattaaagggagtacttctttatcaagttgcccacttttgacaagttacttctattgccataacagatcttttggagagctctcacactttcccattgtttaatttcctctatttgatcaccgtcttctagttaggctttcgacctgctttttcatgtctcgaggaaatgattcagatagtgatgattctctcactaattcactagagaaagttggacgcttcactttgccaacgttgtctttgtccttggataccgctgggtatcagagttatatctcggaaagaagaaacaaagtcaaccaccttatcaatgatttgaccaggggattttcaatgcaaagggctctggagagatttcagcctgtcacagatatcctcaatgagaatatcaaccttgtcctggacgccgaacatgatgaccatgagaatgaagaggaaagcattgttgatccacctggagtcaccaaagcaaaggagcgccaacagcctgttatcgaggatttagttctcccccaggatttcaatcggaatcggtcaacgtcaaccaccctacgtactccagttcgatctcgttctaatacccagcaagacacattcaaaaaactctatgacgagatcaagatcattaatggggcaagtctaaacgatgatgcttttctgaggaaaaaaattaaattgatattgggtcttcctacgatcactgacaaacaaaagtctcttttggtacagaaactaatgtctaaatcgtattttgagcaacagcagaaacgccttaatagagagaatgcaaatatgaacaattccgatacagaggactcatatgacgactcggattcagatgagggtgaagatgaagtcattctaactgttaatgataaaaaaccctcttatcatgacgaatcggctcagatttttggttgcactcactatcagacaaattgtaagctagaatgctctgtgtgcaaccgttggtttccatgtaagttttgccacgacgaagtggtgaaagatcaccaattgatgagaaatgaaacgaaacacgtactctgcatgttctgtggaacgccccaggcgccatctcaatattgcatagaagaaacttgtggcaacatgttagcctgttattactgtgataaatgtaagttattcgacaataatgccgaaaaggatatttatcactgcgatgactgtggaatatgcaggttgggcttagggctgaaccaagactactttcattgtagaggctgtaatgcctgtatctcaatagatttgaagaaccaacacaaatgcatagaaaattccacccattcaaattgctccatatgtggtgagtacatgtttagttccacgaaacctgtcgtgttcatgtcctgtgggcatgcaattcatcaaaattgttatgatgagtacacacggcataattacaaatgtccagtctgtcaaaggtcgattgtaaatatggatgcacaattcagagtattggacactgagatatccgaaagaccccttcctctgccatttggcaactgggagtgcataataaagtgcaacgactgcggtgctaaatcaaagaccaaatatcatattttagggttgaaatgtgacaactgtaaaagttacaacacttcccagttgcggttgattaaacctgaacttaagagccagtacgatgattacgagtccagtaagagccccaaagtggaccttcgatccagtttcgttcataactcacttaacaccaactttcaatatgatcaagttgataccagcgagtatgttgcagatgtagaagatgcagattatgatggcgaccaaactgaaacaatcgggagtcattttgctgccactttaaatcgtttcaccaattcatctctttcggacactgcacagagattcataaacgatagactcaatctattaactagaaaacaatcaaactctagcgcagacgaatccatggatgaagactacgtggacagctttatccgaatacggaacaacttcgacagatatacgtctataggggatgctttcagagattggttggaatctgccaaagaaagctttagcgtcaatggcacggattttgagtacccaaacacctcagcctacgagtctgaacctgacaccatgataggggctaataatagcgatgataattttggggggttttagattataaatacatgatatactataaaattagccttgatctcttctctttttggaaaggttggctattggaatgctcagcactcttgatggcctcaaactttgcgaaaaagagttggttgtagtcggtgataccagcattctctcgtccatctgctctaaagaatgatttttatgtttgtaaagtgtatcaattttcagattgagtttacgtcttgcttcaacctgttcgggtacgttcagttctgtttctggatgagttgcatcttcgtaataattgtccaaagtaaccaaatctttgtctgcaggtacttgggtaaattcttcttcttcttcctcatcggaattgtaaccttcacttattgactcaaatgagtgagttgagatgttgggattgaatagaaaagtcgcctttgcattatcatgctctgatggagaattcattgatggagtgcgtctatgtcgtggttctgtatgtgtcagtttgtggaatgcattggatatggattgtgacctcagctttcttaaacttgaatgggaagtcttcagcgataggttggacaagttggaattggatcttacccgtcgactcttagacgttggagataacttttcgacagatatttgattgtggttattattactttcgttcacggtattctttatgataggcatcaggttcgatatcttttccttgggggtcatcggagattcaactgtacgccttgctctaggtccagcctggatcgtggagcttgaattggaaagtgaatttgcggatcctgtgttgattagcaaatatggcgtagcctgtttcttttcattaattggtttgataattggtagcattttcgactgtgtttctcccaaatcagagtaggatccggaccctaccttgtacaaggaagtaaatgattgcgttcgcttgaagtcatcaccgttatgaaacgatgggacagatatctgtttctccagtcttgaaacgggacgttcacctcttgctgacttagtctcggtgctggtagcagatgaattcaatgtggtctgcgatgatgatgagaactttcttgccgtggtaacagagggaagatgaggaagagttgattttgattggggggattccggcttggttgctgaaggtctctgaatgataaaatttgataatgatggggaggccagagattcttctgaaatcttagaggggaacggcggcaaggttggagcgttttccttcaaatgttccaactgcttctggatttcaaatgaaaagcaaacatcaagcggtgtgtacccatcggcattcttcaaacccatatcggcattataaaatgaaagagattgtatacaagacaaatggccgaaaattgatgctaagtgtaatgggcagttaccgttcttatcctgaacattgatagaggcatgcaaatccagcagaagttgcaagcatgaagtgttgcctttggcagctgcaatatgaaggggtgtttggtcatcaatgtcacggttatcaatacaattgggaagatgttgtaataataaatgcagagtttgttcatggttgttcatagctgccaaatgaagacaggtctcgtttttgaaagtgaccaaaacttcctcactatcatagctgtactcatactcatggtatttttccttgcccttgaggagctttgtagctataaggtaatttccatgatatgaggcatagtgcaaattgctccacccattggcaggatctatgttgtccaacaaatccgggaatttttttaggatgcgagtcaccaaaaactcgtttccctctttgacggcattccgcagcctctctttgggttccatcaacagagtaattgggatgtgaattcgtgtttcccacttaatcagattaagtttaaaggtggtagaacatcagggataaggttggatgttaaatgtcgcgaagaatgatctgcagtacttatgacttatcaattttactctatattaacggctaaacctcaccaacctacaaattttctgacactttggttaaagtcggtaggattgtctaaataaacatgatgaccggctccatcgattatacggaacttggctgacttctctccttgactgttgatctcactaacacattgtcggcctgccttcttggacatccagtcattttccccatataaccatagagttgggatggtaatgtttcctggaagtctgtccaataatggcaacctcgcccaggctcccggagctagcaaaactgtcaaagaatattcacctgatccctttgccacaaacgtgttgtaggagtaacggtgaatgtccatcaactcctgagggtcctcaatggctccgaatctggaaaatgtccacagagaaacaagtttaggcccaaatggtgccgccgctctcactatggagaacactgaacaatggttttcccacattttgacgagaaatttgcgtaattgaggcctcgttcttgcctgttgcattctctcatcgttgttacgggactccgttgatgcaatagaggcgctatccgatacattttgatggtgttgttgcgactgctcttgagattgcaacaattcttcttctatattgggacttgattttctggcaatgtcttgagcttggactgctggaggcctgttaatttcagtcagactcatttcactgcgttcaataccaactggggaaacaagtattaacttttccacagcatctttatatttcaacgaataacaactggatagatatccacccaaagaatgtcctaccaaaacaaatcggtcgatgtttcgttctttcctccaagcttccatcgaatcaacgaaaaagtcctctgctttatggatatcctcctcctttgtaacgtccaaactgggaaattttggtcttgaagataagccgtagcctaacagatccagggcatggatcttgaccccaggtatcaaggataagccattgaagtttcgatagaaaaaacctaacgctgctccaaaaccatgtacaatgaccagatgcctttcttctggagctttctgcttgttttcaatgtacaactcgtgtatcttgttgccttttgcatccacgggaacatccagtgtttttgcttctcttacaccatctgagtctgggaagaatggcaaataggacagaactcttgcttcataatcagcgaggcttttcctttcgaaccactgcttgaaggactctttgtaggataattcagtcaccatagggtatagaggtttaagtcgagatccggctcttacggcttgggacattaactgtgcctctcgcctgcggaattcacagcttattatatactatctagcttatcgcgcattatccatccgtaatctaatcgccactgaaaaacgtttgggtaaagaggttagagttccggacatgtcgctcaatgttacctatcaattacgctcatttcgggtcaagaccactccagggacgattctcaacgaggtcttgactaatgcatgcgatcatttcgatctggatgccagttcatatcaattatatcatggaactaggctcctagatctgtcacttcctgttcgcttgactgggcttgctcagggtgccaaattagaattgaaggtgggcaaagctgtaggcaacgttacattacgattcagtattgtcggaaggacgttgaatgttgatccaaagtctttggtgctcacagtcaagtcatcaaataccattagaagtgtgctcgttttgttgggcaagaacattggattagatttgtcgagtgaaaactttacgattcaaagtttcagtttgagaatatcccccggacctgattttgataagccattgagctcgttgggtttatcaagcggcaattctgtgatgcgtctggtgtttgaggctcagggtccaaccactaagagtgaaaagaaagtatcttctccttcatcctcagctcttccaacctctgcaccagctactgaaacccaccaagacatcaaagacacccctaatcatgatagcaccgttgtgaaagacacagcagctggcgaaaagtcaaccaaagcacacatatttcaagctcaggcgttcaaaccatcttctaatcgtatccacagttcccaggatgatgatgaggtatatgaattatctgttgaccaggctctcaaatatcaggcaatactttccaaacaagcacacgcatcccctatgatgaggagacttgccgaagaaaaaaagaaaaatgccaaaaagattgataattgtcatatccgtatacggtttcctgaccacagcaatttggaactcacaattgatgcttccattacattgaaacagctttgctctatcttgacaactgattttctttcattaaatgaggaagaaaagaatgcgcaaaatgcgtttaacctctatatacctcatccacatcaaattctcaacacgacggctaacatgaataaaaggcttgattctgatctcaaatttggtccaagaattttattattgtatgaatctgccaacaaagtttccaagatctcgtacctgaaaccagaatacttgaaggatgctaaatctattgaagatgctcctgatgttttacgagacagagaaattgaaatgggggttgattctactccagtgagccagagtcccgtttctgcggttgatcagagttcttttgagtctcctactaattcatctctaaaaaagaaagttcccaagtggttgaagttgggcaagaagtgaacggttttcacttccacatgatgacgacgtacattacctaaacatatttatatatcttatctcgcgatgcttaatttttttttttgtttgtagacagattgacactttcatgaacagcgtttgccgaatacgtagctttatcccggctagaagtataaggacacgtgctgtcaggaatcccttgaagaattcaaaagccacggaacgcccacccgttctcaagacaaagcctgagaacctaaaacagctacgttcaaaaagacgaaatgctctgaaaaaggaccctagtattccttcattcgttaaacctgctgagcagataagaagggagctgactgccgagtttgacaggttgggacaagaggtagatgagaattttattaaaggtgtaatcgaacagtcgaaggaagatgaaataaaactcagagagagtaacggtgatctcagcattctagacgagaaagacgatttcctctctttgtttgatagagtaatggaccaatgtgccctggagttatctgagaacgttgacttgcagcaagacgcatatcaattggatccaaacgcaactttggaggatagcgtgttcaagttagcggaggactttgaaactattgtcaaagcctcgcaaagctcacttccattatttgtatccatattgaaaatcctaagcattaatagcaaaagaaatctcatcccaattgaactggcatcgaaagcatttgagctttccacacagatttacgaccccaaacacagaactaatctcatatactactcaggcaatcttatatattcgcatccaagagtaagagctgaccctataaatgaatctctttacatggaagctttgcttgagcataggcagtttctgagatgcgaatatctcttcacctcaagattaaaccaaacagatgtccaaggccaaaggttttggctggagaatggtatgaagatgtacctgagatcattcaaagtatccaaagctgaagaattggctgcaaaagttttacaagagcacatgtatcttcatcctagtgttattgtacagtttattgatgtcttttcccgcttggagcaatatggccaagttctgaaatggacaaacacattgaacacaatcagaaaatcgtttggcaaaggtgcaggagtagtgaagactgtcaatccattggatttgggtttagttgatgatgcgaatattattatgaactactggaatcagcgtgacccaataactcacaatgatttaagaaaagtggcagtttctttgataaatgctggatactatgaacttttattcagagtgatcgaaacatatgcatctagatatcccactactttgaagctgttcaagggtgtagtgggtaaatgcaaatactcagttgcccaagaactaatagagttaactacaaaattatccgaacctttcatcagggattcgttaagtaaagcattagagaagaatttggaattccaaaagagaaatgccaaacaagcaatgattcatgatacgctactgggaaacatcaacattgagggattgagagatggcacatcgaataaccaagaatatttgaccgagaaagactgcaatcgattaatcaagagaatgctgagttccaatcgacccaattatcaactagtagagaactttatagaggaaatgattaactcgtacaagttggagaaggcagggaaaagtcatggctttatacctccaattaatgctcacatatatgccacattgataaaatattttggaaaagtcactaataggaatattgaaaagctggaactagtccttcaggagttagagtccttagaagttccaatgaatgcatattgcgcaaaccagattatactagaatatactggcagacgacggtttgaacgggcttttgcattcattgatcaggtgttgaattctgattttccaaggacaaacaaactttatgagaccatgttacagagtcatagggatttcgtaaccttcagtcacaaatatggcctgaacaaacgtcctaatcataaccagcttagaagaatatttgtcgacttttataattcggataaaggagtctcctttacaaagcaagttgtgtcaattatcaactgtttcatctacacttccgatttcattagctctgtgggtatgctgcaactatttggctcgttgaaaatgaagctaaatgcaaggcaagttgacttgctactcaaaacgttgataaagaatttggagctttgtcctcactcggatgatttggatacctacgttgaaaaattaaagcagtttactacttccaatactaaagacttggagtggaaagatgttgctaccataataatagaggccttccaacttaatccccttttgaccgaaaagtcacaagctgcctatgagaaggagttgggtactttccagcatcttttatccttggagagtctttccattgacgaaataagagttgatggtttctgtatatagtaaatgttatacctaccatccgacatctaaccccgatccagttttttttttttttcacgaatagtttatagtaacatatcaattatttcaatatcacattgcacacaatgtactccatcaagaccgtcaggtccgttattggaacgactggatggttgaaacggccttgttttggatgcaatagtgcctctatccgaacagccgcggatttggcaatgctgaataagcttagatccaagaagaggattaatagaaaccctctgccaactacagtggaccctcagaagggacagcccgaaactggcaataaaggtgttcctccacacacacagtcgaaaatagcaagcgagcataaagtagtaagaaatggagtcaagaaagttgaggataaatttcagaagaaaccacattccaagtctcagggaaactcaaggtctaggaagatatccaaggaagaggaaaaagctctaaaagagatttccaccgagttcgaaactcatagaacagaagcatcaaagtcagcttcgaaaaagaagcggtctccaaataagccaaaaactgcagttgaaagaccaaagatcccgttaacgcttccttcgttcttgactgtctctaatctaagtaccattttgagggttagaaacgaggaccttctgaccaaactgaaggaactaggatttgaaaacatgacctataactacattctagactccgaaactgctgcattaattgccgatgagtatgggtttgaggctactacaaatgacaataccagtgtggacctgtttgaacagccagaatgcactgagcaaaaacttttggttccaagagcacctgttgtaactataatgggacatgtagaccacggcaagaccaccattctggactatttaagaaaatcatctattgtcaacggagagtttggtggaataacccagcacataggagcattttcagttaagactccaaagacaaaaaagatgatcacattcctcgatactccaggtcatgctgcgtttctaaaaatgagacaaagaggagctgatgttactgatattgtggttctggttgtggcagctgacgattctgtgatgcctcagactaaagaagccataaagcatgccaaaaactctggagtacctatcattgttgccataaacaagtgtgataagccagatgcgaacccggataaagtggttgccgacttggccggtcatgatatcgatgtagaagattacggcggtgaaactcaggttgtccgagtgtctggcaagacaggacttggtatggaagacttagaagagtctattattacattatccgaagttcttgacctgaaggctcaagaatcaaagactctttgcgaaggatgggtgatcgagtccgaaatgaaaaagggacttggaaacactgccacattcttagtcagaaggggtgttctggagaggggcaaaattatagtggccggtaatacttggtgcaaagtgaagattatgaaagatgagcacggaaaagttttgaagaaagctggcccttcgaccccagttgaagttattggctggaaagatcttccggaagccggtcagctcggtttggaggctaaggatgaagctcttgctaagaaagtaatcttgaacagaatggcaagagaggaaaagtttaaagaagcccaagatattgaaaagattaacgaaatgagacaaagcgagttgagagaagccaataaaagacaaaaaatagaagagttggccaagaatggcctttcgttagaagacattcgaaaactagacagtgaggaatacaaagatcttttagatgaaactaaacaagaatgtgaaattgttccctttatcattagagctgatgttagcggctcctctgaagccatagctgagagtatcgatggtctaggtaatgatgaagtgaaaagtaaagtcttgtaccaagaggtcggtcctcctactgaaactgatattgaaagagctgagacatccggagctattatttttgcattcaaccttaaaactcctaaagacatcattttgaaagccgaaagaaggggagtgcatataaaaagtcataacgttatttatcatttgattgaagaagtcactcatgagcttcaatccagattgaagcccgatattaaagttgaggtattagcttcagctaaggttcgtgctgtgtttagtatcacaggaaaaaacaagaaagagttcaaaattgcaggttgtaaagtatcccaagggatcattaaaagaaactctcagatccaagtgactagaaatggacagatgatctacaggggccatatagatgctcttaaacatgaaagagatgatgtcgccgaggtaaagaaaggaatggattgcggtgtcagccttggaagatggcagaactttgaggaaggtgatgatattgaagtctatgaagagaaagaagtgccccgatacttgtaaataaatatgtatatagacattaaaggaattgatatagagtaaaagcctcaagtaaatccaaaaataatgcctagtgtgtggtccccttcatgatatatgcacagttttattcatctatccaatacaaaactcctttctacttctacttccgtttatgcttgccttcaaatccagctcgtgttggctttacaataccactaaacttcttgagtcgtgtttgatctttccgtttctttcctttattttcttttctcagtctcagattctcctctctcttatcttgccttgccttctgggtaatttcaattgtctcctttctatccttccattctttttcactctttctctttttaacctccttgcgcttcagagattttttcagtagtttctcatcatcttttattttcttaccttcaataccagccagtgccttattccaacgcgccttctcctgtatctgcgcttgttgctctttatcaagtttggaaaatttctctttctggcgttcaagaagttgaagatgagccttaaagtcaccatgagaggggccctttttcttaacttttcttaaggacgagagatcactggagaccttctcaccatctgtgaacttgatattattgaacatgacatcagcatctatcttctcctcatcatcgtcatcactatcgctatcctcttctttttccttctctttctctttttccttttgctgttgctgtcttttctttttcagttcgtctttccgttttctctcggctaagatttgctctcgtgacattggggccccctttgcattagttcctggggccttacgtttctctctcatgttgttgattttggcggtaagcttgttacgcagttcggagagtcttttctctttcattgccttttgctgagctatttcttcagaagacatctccttgcttttaatttcatttccttcgtcgtcaaaaatggtggcaggttcttgtgtctttaaaggagcggggacttctctgtctttctcaagttcagcatctaagatattgtggttgttatcgttgtccttttcatctgtttcactggtgtcctgagcgtctacttggatctttttgtttcctggtataacagctccctttccagccttctctctgttcctcatcacatccttcacagtagccgtttcgacattttcactatggaaggcagggtccaatttcttcttcttatcttgcctgacttctgatataggctttttcttctgcttgccttgttctcttatttcgttagacttattggagtcttcataatagtatttggcaggaattagggataacaatccatcaaaagatgaagcatggcttttcaagcgctcctagaactgttagaaatcccaatgaatagcgctataaaaccaaaaagaaagacaacatacctccaaactgttactcatagctggttgttccttcctttaatcacagagaaaagaaatagtcccaaaaaaaaaatttcaatagagagaagaggtagtgcccgctgctaaaactcctattataattttcctctctatagtctttacgtgacatccctacaccgagaccgcatctggtagtggcagcaaaaccatctacctcaacacctatagctaacttccacttgtttgtttcagcatggcagaaccattgggcagttatttgctgatctctctgccgaaaacgcaaaacctactccacgatgagacgcaggattggctggagactaacgtgaatggaggaaaagtttcagtcaccaacgttgacgttcctgagttcaagattggcaccctagacaccttgatgcaacagacggaggaaatctccaagttggacaatcagttgaaccaggctgttaacaaggtgttagaaatcatacagactgtctttgacaaaaacccagcgtttgtggaacaggctaaacaagtagagggtcgttctgtcattgactatcttgaaaatttcaaatggaacacatcaaagtatagaaccgaccgttcaattcgccagttaattgacaccatatctttggatggattgaatctagacaatgacgtgaaagctacatttcaaaactataactctgcaaagtccaacttggccgctgcagagcgcaaacgaactggagatttgacggtaaagtcgttgcatgatattgttgatgagactgattttgttctagactctgatcatttgcagacaattctgttagtcattccaaagaatttggtgcagtctttcctcaatacctacgagactgtggtaccatttgtggttcccagaagtgctaaaagaattactgctgattcagagtttgtgctgtatagtgtcatcttattcaagaagtacgtgcccgaattcttggctgcagctagagagaacaagtggattactcgtgagtttaactatgatgaggagtcaattaaactgctgagaaatgagtacaacgatgccagcacacaggagcattcattgaggaacgatctgataagattggttaaggctgcttatgcggatatagtcagttcgtggttacacatcaaaatattgagaactttcatcgagtcagttttgcgttacggaatccctccagatttttcatatttcctgttaaaattaccccacaaagccattgagaaaggtaaatcccagttggtagagaagtttggttatttgggaggggctgccgtcggggttgaccgtcgtggtaaaattgtcaaagattctctacatgaatatgccagtctggtggataccgactatcaaccatttgtgctatatgagctggagattaactagagtgtagaaaatggttggtataacactatctgattatttgaattgtagatgtagttgaaggttcattcttgagtcacttgatgcgtattccccagggaaaagcaggaagttggggggcagaaacacgttcgcgtcatctagttttttcgattgtgattattttgtctgtgtaagcaaaacaccagctcaatgtcaagtaatgtccccaggacacctcctctacaaaggaggatgtccaatcgaagttcctataaaagtcctatggaaagccctttaaaaatgatgaagacaaattccagcaagaggagccccatcaagacatcctcggcagattacaccaaggtagtggttagatttagaccttcaatttttagacacggtgagtcacaagagatagtagacgataatttggctctgggcaaaaagacggacagtcaattaataacaatagagccccatcagtcggtttatattagtggaacctcgttttcaggcaggtttacctttgatagagtgtttggacctgagacttcacagacagaagtatttgattattcaatcaatgagacagtcaatgacttttgcaatggctataacggtacaatttttgcctacggacagacaggatccggtaaaacacacaccatgctaggaaatatggactcccctagtgaatatggagtggtgccaagggtagctgataaactttttgaacagatagcaaatggaagtccctcttcagagtacacggtgagtattggtgtgctagaaatttacatggaacaactgcgggacctgttgaaccccgataacagcaacaatctatgtattagagatagtggagcgctttctgaaggtgtgactgtccaacatttggaaacccggtatgtgagtagtaaggatgagttgttaggtgccgttatcctagccaataaactgcggacaactggagtaaccgacgccaatgctgatagttccaggtcgcatgccatctttcaaatcaaactagcacaacgatcattggacgacggggttgtcaaaatcagtactttattcttggttgacttagctggctccgaaagaatagcacgtactggtgctaccgggcagaccttggaagaggccaagaagatcaacacatctttgtcggctttaggaaatgtgattaatgcgttgaccgatggtcaatccacctacattccttatcgtgattctaagctgacgagaattttacaggaatcattgggagggaatgcacgcacaactttgattgtgaattgttctcccgatcaagttgatgaaggggaatcggtatctgccttacggtttggcgcgcgtgccaaaaggattcaaaataaggcaagagtaaaccaagagattgcatctactgagctgcagaagcgtttggtaactttagagagtgaaaacgctgcgttgatacatcgtgttgctgaactagaagaacaatcaaagttgaaggaaatccagcaggaagctaccaacaccgtcaccgttgacgcaaccaagataaagcgacttgaatcatctgtttctcagcttgcgatacggttgaaacaaaacgaagctatcacagaggagcttactcaggaacttgatcgagcccgtgccatcaatgaaagacgaaagataaaaattgaacaacttgaaaaggctatgcaagctcagcatgaagacatgatcatggaaactgacaagtttgcaaacaaattgtcgtatttaaaggcgagaataacaagtgttaagaggatgaatcagacccaagtaccgtacaatgaagatggtttacagccagctgtaaacatatacgaatcaccgactacactggaggaaaatgaagaaggattagaatctctgtcgatcaatgtttgcaggtcgccggtgcaattctcaaacaaagctggtctacatcttaacattgttaaacctatgaggggagggtccgcaaagccagcatgaaaagtaaaattaggtttttatatgtatttcatttctattcattcatttaaagccttttctccgtccttaagacaaagaatagaccgcacatcactagtaaatcttaaactgtttagcagtggaagaagattcatgagctcagtgtcgttggggtcattgatccatccctccaccattattccattgaaattatgtttgcaataactgataggcgaattgtcaatgatcacataattggccaacgaatccttcgctggaatggatttccttctggattttccttgtcggggggttgaaggcggagataaaagaggttcttgcggagatagtaaaatgctcaagtccttgatgtatccctttcccttttcccaaacacagttattcctgtaatatcttgcttcgaatagtttcttggaggagctctgattcttctccgtaaaagatacatcttgttctagcaaatcgattacgggatctgcatattcttgaatactggcggtgaaacatacgaggctgaaccattgcttaaccaactttaggaactccacaacatacggccgcttatagatataatataacgcgatcatatcgttagacatttttatttctaccatttgtccttttgccttgcccaacactgatgaattgtggctggaaagagaatggatcagtgtttcatccagatccagcactagcaccttctttggtagttcgggaggcttattcaaattgaaactattattgatgagaaggatgggaaaaacaaacttcgtctttttccggggtgcctttttgacgctttgtatcgtattagcatctgtatgtcgagtagttggtgctcttagtgggctcggagtagcctcatctgaagtcatgggtgatttcattgtatctatttcttgctgtgggaactcaacttctatgtcatcggactcagcaattgtatctagcaacgagtaacttgaatctgcgatgttctctgagctctggctaataatggagtcatcttccggaaactcctcttctataggagcgccgcctgttgcatctttgctgagcaatctaaagggaaatagtacaattgagatgatgaacttcaaaggggaaaaaaccagcaagttcggaaagaaccagattattgacactagcgtttgccacagcgttacgcttgtcttgactaccggtatttcaggatagtcaacccttgtaactatgtctgagtcctcagtctgatctacgtccagatccaaagtagtctccttctgaggttgcttctcttgcaatgaacctccatgaactctgctggagagaaactgaatcgcattcatagtacatcaggacttctctatcctcttactagcaagcgttgtgtatactggtagctgaactgttgtgcaggagcagcggttgggcccccaaataaaatgtggtgtatgggcgtatgttggggttggatatggtagagatggctctagaattgccagcgatgaaggaagttcgggacagatggttgttagtttacatagacagatgttaaggattctgggaggcttgaaacagtcactgttcggtatgttaggtgttggattgccgttgggtcactatacgacggctgtgatctaactgttgatttttcatgtgcggcgttgcttggtaagcctgcagaagcaagactcttgcggctagtacagcatgaacaggatgttggatgtccatccctccagttctcaatgaagttccagttactccagtaatagcttgaactctgtgtaagctcctactacgctgtggcttacaaacgaaatggcaccttctgtaacgctgtctaaaagctactccccctcacttttttgccctgagtttgcagtagtccgaggaggttcaaactcgcaatctttttcatgtgataatctgaaggagtgtggagaaatccaaaaaaaaaagataagactttaaataccccttcattctcctttccttcaagttgataatggtgaacttagacgtgaatggtaaatctgtggtgatcactggaggcagtagagggcttggcttgcattgtgctgaagtttatgtcttaaatggggccaagagagtggttatcacatcaaggaaagaagatcaatgcatgaaagcagtgcaatatttgaaggatctgtccaccactgccaatcctgaggtggaaattgacttcattgctgccgatctgtctacggacgaaggtgccaagagactgaagtcagaataccagcaaagatatggagatcgtctgaacattttggttgctaacgctggagcaacttggggtgctaactttgaagatcattcaagaaaagctatagataaagtattaggcttgaatgttgcgggtgtgttccaaacgatccaactttttggagagtttttggagaaggctggaactccaaaagatccatccagagtactcatcatgtcctcggtcgcagggttgacgacttctttccctgccgggggaacctatggatatttagcatccaaagcagcagtttctcatttaggtaaaaccttagctgtggaacttgggcctagaaatatcacagttaatgttctagcaccaggattcttcccaacaaaaatgtccaacggtttactagacgtagttggtgatcagatggtgaaaaacaatccaagacgaagactgggcgagaaagaagatatccagtatctggtactgtacttgagttcatctttaagtaattacgtaaatggggcagtgattcctttagatggcgggtcacatcttgttggtctgcccaagttataaaaataatgtcttttcttctctctaacaagattagattgcgagaaaaagagttcagtttgtccgtttactaaggctttcctcttcctctgcctcttcctctaggcttgcctctaccacggaaagaacctacgggacgtttatcagcctcgtcatctctgacagtgttgaaatcgtccctcagcctgtaattgaaattgaagccttcacatttgctttccatttgaatgcgtccctcttcgtcgaggtttaagatcatttgccctaagctcagatcacacaagttgaaatgccatgaattttggaaagaaacgtagtaaagatcgttgagctgtctaatgatagagttgagctctttagtcttaagcatctcatcttcggtggaggaagaagagtcgtcggcgtcgttggtgctgtgttcgttgtctctgttgagttgaagaggatatatgacctctgaagacttggtagtaatgggaatcttgtcgaaaacttcaagtgcaagaccaagtgaacggatcatcagtggatcgttaagattaaagagcatagactcgtactttgtgtgtatgtttttccaaattgttgccaacttattacgggaatcgttgaacttgatcttgaaactctcaaaattggggttgattgaaagctcattataggacgatgagtatttgaagtgcaaagagttcgaaattgtgtagtccattttgaagaaaatcgacaaatgctctaaaataggctctctagtaggagactggtgggtaataaagaacttgatagctttgttgtaatcagttgggttctttgtagagtactctataatagtgttaataagtttaccaagttgcatgaaagtaatccagatatttcctgggtcgcctgaaattggcagcaattggtttggatttgtgtctataatggaggccaagttagggtcggaggtgatatcattgctatcaaatgaggtaccttggtggaacaatttatgatatgacagagatcctccaatacctgtcaacaggatggagtggcccagtcttggtacattaaccttgtagagggtatcgtggtcaattacatgaagattaggaacagcgtagataccgtgcttaaacttattcagaacaactaagtcctcacacatcccatatatcgtgtaaactggaatcttcaactggtaatctccacggataaaatcctgcagttcggacaatttttcatctttcaacaaaattttcaggttgaagtcttgattcgacaaatgctctacattatcaccagtaactttactgagtttggatattctcaaaatagtttcctctctcaaaagaggagaaaactcaacaatatgacgaaggtatgactcatggattctgtcgacactttcctgttccagaaaaccaaagttgccagtatgaataattaggtcggcgttatgaatatcagcaagctcgtttagaagggtaagttttcctctaagatcagctatcaggacgattttcacgccctctttttcaaataccttcgtgcttactatagctggtggtggcggcatacttgagggcagtaggtggtagttggaggaggagaggagaagatgtcgagagaagaaaaaagattcatattacgtaagcagggtatacggacggatagaggttagcgggaatgtcatgattggttcacacatatcggaaagggacaagtgggaggaggaccagctgttcaagaaaggattctgtaacatatgaatgaaaaagagaaaaaaggtgtaaatagtttagtccgaagatctcaagactaactaccaaaacatcaatgatctgcgcattgacttggttcaagcttacaacgatctcaaaaaccatctatcctcaatgcattaaagtacaaataaataaaatagcaaattcatctctaatgttcccatgggtgttttaaaccaaaccacactggataatcttgctttgccctgtagaagatccaaaaccacataagaccacccaggaactttgatgtaatgacatatcctggatgcactttgggcttgggtacaatagctccccttacgtatttgaaagcatggtgtgctgacatgttggttgtaaattagtgtagtttggatatctgaagatgtgattagctcgaaaactgattggataaagtgtattagctggtgcactatatagtctatgtgggagaattttcaaaacacgacatccaacatcattcacctgctctcactagccatcggatcaagatgtagtattggggtttccgtgtcaggttcctcagttgcctgtcttgaggtgagtgatcagctattttgtagccctgtttcttgtaccaagaaagagctctagtattatctgagaataccgttaaggaggtggctactaaggaaattgaactcttccaatccctgacaatcctttcaccaactgtatgaaataaagtcagaagctgagagccaagttgcaagttacgaaattgctcagccacatgtatctcgtacaagtacaatacaggtagactattgtctagatcatgcatgaaagagacaaatcccctcaattcacctaaagcctcatcctccacagctaggtagatcaaccctgactctgtggcctcttccactttatgctccagccaatgcggtccattgacttttatataaagctcgcctagtccacggtcaatcagcctaattgccttcgcaatagaaggggcattttccctccggggagtgaaaatcttgaaccttgacgcattgataatagaagtcgagggagcaccagcagccttagccatattatcgattaaatccggtagaatctcatttgcaattaggtcccgtttagctatgatgtccggttgcggttctacatcacgactttcaagtgaacttgtaatccacttctcaaggtcgtcctgcatgggttaagaataaaagattagcaacgaaaaaacgtaactggatactctgaccagaaacaatttttcgtttgcacgatagctcatatataagtgaaaagggcattatttgattgggtgtgaactcccgctatctaacattacacagaacggagaaggataacaatgggaattttcagtactcttgaagaattaacgaataagacttggggtcgccttggaagttattgctccttctcgtcagaaccttgcttgtttactttcttatgtaatcggtagtggcgtaccatattgcttctgacagagaagcgacggtcacaattaggccaacggcattggaacggtttttcaccagtatgtgtgtagatgtgggtctgtaaggatgaaggcctcctaaacttttttttgcaatgcggacattggttaccgattctttcttcaattcgtaagctgggtgtttgactgtgcgttcttgtggaagaagggaccgttttttgtccttctaaccccaaatcatcaaacgccactggatttggtaggtttttcattacctcatcgaaaggaggagggttgacgaggttgacgattgacgagggaaactgttgagtcggaagaccctctggataatacccaaacagttgaggattatacggctgatcttgaccaaacccctgaggtctagagtcaggccccgacacaggaggggccattcgaacctcctgaacgggtaccatcggtatgccttctgaactgttgaagacatttcttgagtttgctatttgaaatctgtgttgctggtctattgctgtgcaatttgagctgctttgtccgcttgagctcgtgggctctgcatcttcttgtgacgacgatacaaactgacgactcactggaggatgcaaatagaggaggctggcaggtgagtagggtctatttgagggttgcaagtccatatactctgaactttgtggcacatgcgacacttggttggggtcattttggtttcctgtatacaaatatgaatttgcctgagaatcgagtgactgtgcgaacgaatctagaagctggggctggttgatgcaaggtagttgtggttgttgagatgtttgtatatgagattgcgattgcctttgaacttttctggaagcttgtcttggtcgttggtctacattgccatcctcgtgtgatggctgttcttgcgcaggtgtcttagacatatcaaagttctgataccaaccctgagacataaaggcgatccaatatcacgttttacgtcaaagttgttaatgtaacgttgctttgacaatgcactttttattttgaatagcagatacaaagtttagatttattatggtttacatgaaaaaactaggttatccgacaggcgtctattggtaacaatccaaagccatgccttacccaggggaattgttgtagatcgctgcagatgctgtgcattgaataagaaagatcggcaagtcagagtacacgccctactaagttcagtaaaagagcgactaacaagactgctcataaattaaaaaaaaacgtccttacttgaggtagacattgatatgtgaatcaattaggttgctctggaaaaaaatgctcaaaaaaaaaccttctgtcccatacctcataattgtctagcttttcgacttcatgcggccgtccgcactggatgtcgcgcaacacaatacgagaacactactgcgtggagaaacaacagctgtatatgtgcaatttttttaacataacgtgcttgttcagtttgagtagagtgcatggtgaaggaacaagtcaaacgactgctaacaaactactgttgacagctgtgcgtgttgttccctgtaaaacatcactttttactcggagccaaccgcattcctccagagatcttcgatttgtcagcagagagctgaagagccggtctgcgtcaattcatgcgttatcgcgccggggtttccctttttcttttcaactctactgttgcaacattccttatgtcggcttcacgtgcaccgacttataccagacagctacgacaggccttcgcgcacttcctcatgaaatggcttctttttttttccacattgcggccccaacaccatcactagtatacctttatcgactattgtttcctgtttgttctttgcctccattttgaaatgaacggcgatcagttacgcagcttcacttttgataatggctcgtccaaacccgcaagcatcaacgaaggtgacccgttagcagccccaggctcccccgtcaactcggttgattcagacaaagatctgatctttgaacgaatggttcaagatcccctgactgagagtccagtattgcagtgccctcgttgtggtaatcacacttcaaagtgtcatcataattcaattttgaagttaccacaacattttaatacagaaaactttatccctgctgctttggattctaccacttctttgatcaactcccaggaggatatggacctagatctgagcactccgccaaggagaccttcagtggttagtctatcgcaggcctttccaaattcatatgacggcacaggccctgcctcaagtgtcaacctcaatgcaggggggcctgttatgcgaacatcaccctcttcgccagccctctcccgcaaccaatccttctgctcttacgctgacatgattaagcgtgaagatcaagaggggaacgtacaccgaagaccttccatccaacaaacgttgagcggtcgaaagcttcctgctttgctgcgtcgatcaacgacggcatcagtggggtctgatgaacaactcagtcttgatgggacactttctttacgtcgcaaggtcatccggtcatgagcctttgttacatgtttctacatatttaacagttagttacttttattttcacgaactttaattaggactatcaagacgagattcttcttgggtctgcattaacccacttacctcgctaaggacattgaaccaggtcctcatctcatcataggtagaggtcttgaggatcagtgttgacttgattacactgaatgcctgagttgcatctttccctgagatttcaatcttgaacttgctattatctggtccattaagggacttcagagtacattcaggtaaataaagtaccgtattaggttgcgtagaattcttaggagcgttggactcaaactcatacaagtatctggttttagtgatgacgtagtattcggagacgtacttcttgttgaccttaccttccttcctctgcagtatgccttccaaaatgggttcagtggcagggtgatgatcattgggaaatgacaggtcggacaaaccccgcttcttgttatcagcactgatattagcaccacttatatcatcattaccttccacggtaaccagtctctgtttattgacctcagaaaattgtttccattcgtactcaagatcaatactggacaatgtcttactcagggagtcgaaactacgagagaaaacggaatctgccgcagtgatacggttggaaacatcagcaaagatcaattgaataaattctagagttcttttttccagggtcatcaaggatagttcttcacgtttcaaaaaatccatatgattgtgctctttggcgatcaattcagtgccatggagggatacggctctcttcaacatgtatggatcgttcttgtagtccatctttccagttcccgaggcagactcgaacacctgagttgagtgctgaagttttgaaattgaactagacaaatgcaagcccagtttcttcaattctttccgctgcttactggcatctgccgtcagatccttcttcttagcggataaatcagccgagtatttcttgaactcaggaataatttgctctctaatcgaagtctctaatccagctatttttccctgatcttcactggacctaaacttgagtaattctatgaacgagttgacaccagtgacattcttgttcggatctgcctcagagttgacagatccgtaaacagctcctgcaatattggagctggggctcacttcaaattgaggtaaagtgtcagtggaaaaatgcttcacaagcttgccgtaatccttagcagtactactgagaatgctgtcgtaacgggcaaagaagttctcaaaaaaggccaatgccaaaatccacttgtcatatctggcaataagcagatctgatgagtccagataaacgttgtctaacaggctactactggtttcgtttgcattgtcagacattggaggttgttttgaggaactaaattgctaaggcgaatcagaatgaggcaacaaaaatactgtcttgctgtcaaacgagtgcgcgagatggttgccaatcaaatgttctctctgaaattttggaattcagatatgcagaactacctaaataactaagatagcttgagctcctggattgcatcatccaattgcaagacgccgtcaatgcttacaccgggagtgtctcctatcccatagagaactcctggagtaaccatggaaggactgctgtttaatggtgtttctctttctctggtatgtgcacctgctgggtgagttggtggagtgagatcttcgcccgtcataggcccttcaggcttacgcgcttggtcgtaggtgggaggtgaaagcgcagagacgttttcgtacgttggcggcacttcgtcgtcccaagaaacgcccaatccggatctttcagtgagtagtaccttgaattgcattcttagcacacgagctactccagtagctatgcccaccactgaatcattatcttgctcagacgtaacttcagagactggtagctccgaattgttagataattgaaaacgtaattcatctgtatcatcggctggctcgctagaatgagtctgctcaaaagcatttcctccaccattgacacctccaaatctcacagaagggctctttgcttgagaatttgaacctctatgagtatgtgtaactccctttcgttgaattagttcttcagcgacaacaatttccaccaccagcaaatggctaacaaaaactcctagctccttctctgagagatcacaggaacagttggccatagaactcacgaaaagatcgtcgtggttgaacatcggctgattacaattttgactcgtaactgagctcagatttgacaatgacgagtctaaagctatgctgctcaggttcattatgtttatgtcagcaaccaactcaaccactccttttcctgagaaatcggatttccatccactttttatctctccctgagatatcgtacggatctcttccaaaaataaaactggcttgtttgaacctctttcgtcattgaaatgatctataggaatgttactgttctctgtgtttgaagaatttgtattattgttgtgattctcggagtttgaattggcagcactaccaccgtatcgagattcgtactctcttgcttgttcctgagccaaggcttcctgggttagtgcaacatgatctattccaccagcggcgggagttattgcaacttcttcttccgtggtaacggtccgaacgggattgattgggccattagtgtttatatcatgtcctgaggccgttccaacagaaagatgcgtgaaagtctgccccccagtgttgtgaggccgcttaaatctatgatgttgtttgtttgcataatcttgtagtacttttagttttgtttcatgcttttcacaggaaactgctcgcactttgatgtgttcttccatacgccataccaacttccgcatcctccaacgacgatactttgtgcatacgttatccaatcgaagctcaataggaaaagtagacttgggatacaccacattgggaagcacagccgttgcagtgacatccgttggggggaacactcgaagagaattcctatcaggacctcgcaagatggagcgttttattatgattggcagtttaatcctcaagtactcgggctttttgcgggcattcaaatattctgcatcagctaccagctcatacttaataactgtgttagtgtttccaagaagcgttgtagctggaagagcaccagggagcagatgagaaaaggggtacgcgtgtacggcacctttagcaaacgatgtgggctgagctaaaatgtcccatcttgccaattctagtttcttttgcttacaatctggacaattctgtaacgtgtttgaaggcggggccaaaggtttcccgtaggtaatcgtctgcacgaatgacaaagtgacgttgacgatctcaatagagtcaagtttagagtagtcctgagacattgtcaacgaagttgttggagttaagacgttcagagaactggtggatcttacaggagtcaaaattcccggactattagagcctgacatggtgggggatgcgatctgggtgtatgataacacatccaaacttaggagacccgacagtatggagccagtgctctcatgaggctggccatacaagacaacaggaggtgattccaacgatatgctcagtttaactggagaagagtgcaagtttgtattgcttggtgagggccctcctaaccctgaagcattcttgtcgtcctttcgaaccaatcttgaaccaaatattgccatgtttgggagtaaaactgggatcaaagaaggtaaagaatttaatgggggaaattctaatggtactttgtactagctgcaaatatcgattgatgagttgttctgagtttccctggataaaatcgaagatgtcgaatatttatatgtatgctggtatgtgttagagtacggctatcccgcaattcgtggtttttttttttcttttgatagctgccctggctcggcggcccgaatggttcttaggatctaggatgctggttgttctctccccgccaaggcgagcgattcggtgttccatggctttcaaatgataaggcgaacaatcggagaaagccacgctattgctagtgcacaagaggagaccgactgataattctctacccacttgaatggcatgggtggtggattaatgtgaggtgattatttgaatgagttatattttttactatatagttgctttttatagatgtgccacatatacttatgaaagtcgagagtttgatccgcattttccaaagcttaacattttgagaacacgattgattggcagtttggttctaatttcaagataataatatgcccgggtcgaaattaaatatctaattacaaacaggccctttaaacatcacccgtattttggttttgtaaaagaatgtcaggtgcaaaataaagagctataacttatttagaagtacaaaagtacctaaccttgcaaaccctggtctatatactaactactatatactaactagtcccactttaacctttcaatcgttcaaatattatccatccccagtatcatcctgaatgaaatttcacccgtggcatgcatggcacaaaaacgtcgtgctccacccaatactcatctcatgttcccccgtcaaatttccctttaacgtgttctttcttcaaacacggattcaagtcctttcgattcttattttttatcttcgatgacaggccgtgtcgaccagaaatctgatcagaaggtgaaggaattgatcgaaaagatcgactccgaatccacttccagagtttttcaggaagaaccagtcacttcgatcttgacacgttacgaaccctatgtcgccccaattatattcacgttgttgtcctttttcactcgtatgtacaaaattgggatcaacaaccacgtcgtttgggatgaagctcacttcggaaagtttggctcctactatctcagacacgagttctaccacgatgtccaccctccgttgggtaagatgttggtcggtctatctggctacattgccggttacaatggctcctgggatttcccctccggtcaagagtaccctgactatattgattacgttaaaatgaggttattcaatgccaccttcagtgccttatgtgtgccattcgcctatttcaccatgaaggagattggatttgatatcaagacaacttggctattcacactgatggtcttgtgtgaaacaagttattgtacgttaggaaaattcatcttgctggattcaatgctgctgctattcactgtgactacggttttcacctttgttaggttccataacgaaaacagtaaaccaggaaactcgttttctcgcaaatggtggaaatggcttctgcttactggtatttccattggtctcacttgttccgtcaaaatggtgggtttatttgtcacagtattagttggaatttacacagttgttgacttatggaataaatttggtgatcaatccatttctcgtaagaaatatgctgctcattggctagctcgtttcatcggcttgattgccatcccaattggcgtttttctattgtcattccgtatccattttgaaatattatccaattctggtaccggtgatgcaaacatgtcttcattgttccaagctaaccttcgtggatcatccgtcggaggaggccccagagatgtgaccactctcaactctaaagtgaccataaagagccaaggtttaggatctggtctgttacattcccacgttcaaacttatcctcaaggttccagccaacaacagattacaacctattctcacaaagatgccaacaatgattgggtgtttcaacttacgagagaagactctcgaaacgctttcaaggaagcccactatgtcgttgatggtatgtctgttcgtctcgttcattcaaacactggtagaaacttacacactcaccaagttgctgctcccgtctcctcatccgaatgggaagtcagttgttatggtaatgaaaccattggagacccgaaagataattggattgttgaaattgtcgaccagtatggtgatgaagataagctgagattgcacccattgacctccagtttccgtttgaaatcggcaactctgggatgctatttgggtacttcgggtgcttcactgcctcaatggggtttcagacaaggtgaagttgtttgttacaaaaatccgttccgtagagataagcgcacctggtggaacatcgaggaccataacaatcctgatctacctaatcctccagaaaattttgttcttcccaggactcattttttgaaagactttgttcaattaaatttagcaatgatggcaacaaacaacgctttggtcccagacccagataaggaagataatctagcttcttctgcctgggaatggcccacgctacacgttggtatccgtctgtgcggttggggcgatgacaacgtcaagtatttcttgattggttctcccgcaaccacctggacttcttcagttggtattgtagtattcctgttcctgctgttaatttacttgatcaaatggcaacgtcaatatgtcattttcccatccgtccagactccactagagtcagccgacaccaaaacagttgcattgtttgacaagtctgatagcttcaacgtcttccttatgggaggattatacccgcttctgggatggggtttacattttgctccgtttgtgatcatgtcgcgtgttacctacgttcaccattatcttcctgcattgtactttgccatgattgttttctgctacttggtttctctgttggataagaaactaggccacccagcattaggattactgatctatgtggctctgtattccttggtcattggaacatttatttggctcagccccgttgtgtttggtatggacggtccgaacagaaattacagttacctaaaccttctacctagttggagagtatcagacccataggtgtatatatcgtcagtacctaaatttatgatagggtaaaaccgacatcttctatctacaattaatgcgcgactcacgctttctcttatctgcttggtcttgtttgacttcatcgttagcgttcgcttctctcttcaggtaaaaccttaccctccatgtcgacctatagagaactggagcgcgaggagggcgacttctctgataagaagcttctcacaggctggttctccttaaccgtgggacaactacaatatgctgcattcatggccgtaggaatcgcgttgctttggccttggaattgctttctatcagcttcagacttctttggagagcggttgcaagaacacaagtggctctctgctaactattcatcgtccatgatgaccatttcaacgttgacctcaacgttatgcaacgtgtttttgtcccaaaagcaaagtggggtagattattcaaagagactcgtcatgggccaaacaatcaccatagtcgtatttgcctttatgggtctgctgtgcgtatggaatacggggctagatccaataatattttttgtgttggtcatgattaatgttgcactgagttcagtagctgtgtcgttatcacaggtcggtgctatggcgatcgtgaatgtgttgggaccaatatatgctaatgctgtggttgtggggaatgctgttgctggtgtgctaccgtccatcgctctgattattagcactgccctgtcgggaactcatgtggctggaaagttgcaacctaaaagagattatgcagttatggcatactttttgactgcctgtgtcgttagtggtattgcattagttctttttgggttggcagagtcacatggcccaatcgacgttgttgctgcacctgttcatacttcttctactgctgatgaggctattgaagaactaggtatccctttagaagaggaggagtatgttcccttttcaactctgtgggccaaacttcgttttgttgcactcacaatatttacagtctttggggtttctttggtcttcccagtctttgcatcgagtattgtttccgccaacggaatcaacagtcgcatatttgtccccttggcattcctactctggaaccttggtgatttagcaggtcgattactatgtgcttatcccagatttgtcacgcgatctcccataaaattatttattttctccttagcaagatttctttacatcccgctatttgcaatttgcaatatccgagacaagggaggcctcatacagtcagatgttctatacctcctattccagctttcctttggaatatccaatggattgatttactcctcagcattcatgattgtaggagacatagcttctggagaaaatgaacagaaagctgcttcaggttttactgctgtatttttgagtcttggtctggcatgtgggtcattaggaagctacctggttgtagcatttattctttagacatatatttatacctttatctaaatgaggatgtaaaatggttaccatctttatttcgcggggaacacttccttgtgactatatgcttactaaagcccagggataattggttttactcttacacacccaatgagactagccttaataccgttgctctccgccaagagtactttccatattggaactagggctttattgacacattcttttaatcaaagctggccaaagcagtttttgacgaggccctactctgaagcaagcacctcttcaacctcgtttaagaaggagacgttctctcaacaaccagacgattttgccaaaacaagactaacaaatccccagtacagtgacaacaatggattgcttttagtagtagcaataacaccagcagcaagagacaagctgctaagcatagccaaagaagagaacaaccccaatgtcgccctcagagtcagcgtatcatctgggggatgccatgggtttcagtataacttagagttgaatgatattaaaaattatgacaagtcagtggattccttattcgaaagagatggcgccaaagtacttatagataagacaagtttggagattttgagagatagtaaaatcgattacacacatgaactgattggaagtcagttcaaggtagttgacagtccatacacggcaactagttgcggatgtggagcaagctttgattttgatttcgataagctcaaacagggataggtatagctgtgagtcgttctgcatatgtatataattgatcaatcatagtccaaacagccactgtatccttatccgaggaatccaggctagttccttggttaaatcttattctcccggtatttgtaatcatgaatatgtttgaacggattgttgtcagttctaattgtgacaaatctatacccagctgctttcgtagtcttgaatatatatcttgcacataagattttgagtcacacttttcaagcacatctcctggaatgtctataatgatatttttcaaagagttgcctagcgtttcgacagtaaaatttaaatgcagactgcccacaatgttgaaaatgtttgaagaaggtatttcctgcatgctcttgtcaaacaattctgtcatgaaaaccgaagtgatatccatgggtctgactatctgacccatctttgatgtaaggtgtgaccatatcaatcccagatacctagtatcacatcgacttagtgctataactccacgtttttgtgggttcattaccagaatgactacctgacgtttaatcactccacgacatacgatggataaatacagaacattgtacccaccaatctcctgtctgtttaaacttacttgcactgtcttcggagatatttctacttcctgatcaagttgttcactcaatggcagcctgctggatcgggatgttaagcttagttcgtattttttcaactcgtcaactatcagggttttcagcaaagtcaaattctcaggctctcgaagctcttccagagtcgttccgtctatggagagaatgtagttcaatctgaaagttgtatttactaacgctctctccattaaaaacgcttataaataaatgtcaaagatcagaaacgtaaatattgtgatggacccttgcgcgaaatactattctggatatttcaactccacaggaaactcacagcctctccagtatagagcaaaccaatgtctttcgtaaataaagagaatgcacagaagtcagctggggcagcggcctccttcattggcaaaggtgccaaagctggctatagcgcgatcaagaatcataaaagtggctcctcaaataaggattctgagcacgaggagcattactcttcagtaaggcctttggagtcgttgactgatcccagaacatttcaaccaccaccaaaacggagtgttggatcttattcgggatcaatcccaccatcattttctgctcattctttagctgcaacctcatctgcaatacctcctcctcaggcaacagttcagaatccggcacagtatcaacttcagattcagccttcaatgtcagctccccagcaacaaccaggaaaccaggtctatgctgctggtaactatcaggatccatcacaggcgagtcagacctaccccggcccgcctcaattaccaggcaggcaaccatctcaaaatcaaatagggggcaaccctcaagttccagctcagtcacaagcagagtcttatatctctgacagtgtaacaaggaccggacaaagtgctgggtctcaatatgttcaatcgcaattacaaaattctggttacgctgaagctcaaaacccacagattcagaaagctggtgctgcttttggtagtttcattggtggacaacttgcgcaacagggtcagcaacaagctaaacagcagttgcagcaacagctacagaattttcagaaccctcagtcaactatacagactccccaaagtcaagacgtttcacaacagcaatctcagttcccgcaagttcaacaacctgagcaaacccctcaggctccatccatttcacagattcaggggccagaccaatttcaacagcctggcatagcgcagcaggcgactcaacagccaaatcagtttcaacagcttggaatagctcagcaaccgaatcagtttcaacaacctgctccagctcagcaaccgattcagcaatcagctcaatttcagcagcatcttccagctcaacagccaaaccagttccagccgcctggcccagctcagcagtcatcttcgcagccaaatcagtttcaacagcctggtatagcacagcaaccgaatcagtttcaacaacctgctccagctcaacagcctggtatagctcagcaaccgaaacagtttcaacaacctgctccagctcaacagccaatccagcaagcaactcagtttcaactaccttccccagctcagcagccaagtcaatttcctgaagcttctccgcagcaacaggttccacaattacagcaaggttcacaagttccagttagccctcagctccaacaagcgtcgccggttcaccagttctcacaaaacaagcaggtccattctcaggatgtaagagagattcagtatcagcaaagaccacaacctcaacctccatcaaaccatcaatctcaagatgtcttgaatactcagtatcagcccacaaatcaaccttcgcaaatgtatccgacagcatcaattcagccacctccaacttctggtatggctccactgcccccccaacgagtagttactcaatattctcaatttcaatcatctccagctgtaccgcgtgaacctgaaccgttgccacaacaaagtgcttcagtaattgcatcaccacctcagagctttgcacctcctcccgtacatgttgcaagaggttcttcaccatcaaaccatgcccaaactgagttgtcgcctactataagcactgcagcccctgtgcaaggagtacattctggcagcacagctccgcctccccctccccgtaatacattttctctgcctgatatttcaactgttggccctcctcctccaaaaccgttcagaagtgcccaagagaaagaaaagttagaacaagaaaggagacaccaagaggagttcaacaaaatgagaaatgctcatcgcacagcttccagtaccagtacaccttcatatgtaccgaagccaaattctccactaaagaccgaagacactggggaacctgcgcctctgccacctgaaaagaacgcttccaaagacactacggccttttctcctccaccatcaacatttagatcgtcatcatccacaaaaaatcacagcgtccctgttgcagctcctaaaccaacggtcaagaccgatattgatgatatagcttctccgtctcctccgccgcccgcaccaaggaaaaagttttcttctaaggaatctgagagtcttgtacttgagtcacataagaaaccaccaccaaagccttcgaagcccaaatctttggccaatatcaattccaagcagggagagctggaaaacaacaagcagtttgcaaactcagagccaataccagattcgaaaacatcaagggcagtgccggcagaacaagatcttgtaagtgagatggaaagggtaatgctcaacagacggaagaaactacaggatcaagaaacagcgacaccggatgtttctaataagccttccaggccggctaaacctgtaaaatttgaaaagatatcctctcctactcaacgtcagcatcataatatttttgaaactcccaatcaaagtaccaagaacacgtcgggcatacatgatgctgctccagtaaagccaacgagacccccgaagccgacattttcgaagccacctaagcctttaccagcagtttccaagcccaaaccttacgtaaggacaaaagtaccaatacctgactccaatcaacaactgaaccttcaattagagactggatggtacaagcgccttgatcaaatcccccctgatgcagctggattaatttacagaacttctatgggtcaaattggaggcgactacactagatatataagtttcaggatgaaagatctaggtacagttcaagctgagatcaagtggtccgatagcactgcaccaattgtcactcaaaaatatacagctccccctactgcaacccaagagcaattgtttgaaggcagaaacctgttcaatgagcatgttgctacgtgggctgaatcccatgagggcaaatgtgtaggagatggagaatgttggactttggctaagttagctcttgaaaaaggatgcggaaagcacgcatttgttagtgaatactatcatcacggtgccttgctgtttaccaaggatgcatctggagtaatcaagtctaaccccacggattcaatagctcgtggagacattttacagttttacgaatgtacgactaaaaacaactactcaactacgaaattgggggctcctcaccatacagccattgttgtgagttgcaactcagatggcagcctagaaatcatacatcaaaacgttaacggcgtcaagaaagtcatgaaacagaacctggtgcttaatgtcgttgaaggtacaatgaaagtgtatcgaccggtgacgaaaacttggatagaagaactctagttcaagtgaaccatcttggacgtttggcgtttcctcttttagcaatccacttatgtaagcatagtaagttcatctgaataggaatattacagctactgtcacctattttctgtcatgcgcagtacctaaaaatgtgaacccttatcctgtaatcagcgatccgacatccagatcacgctcgccctttcgtcattttctttttttttccctgtgcgtgcgtgcagtagtagttcaattcctggttctctgccccaatactgatcttgttcccacatctcgtcacacgcccaggcacaaaccccttacaatcgcttagtgatttcagttcagtctctttaactacaaaagacaaatacccaccaactctgcctgtcgacgacgtataacccgtgggcttgcattctatttataaagttgttgaactgaaccttccgaagaatcgaaaaaaaaaacaatgtcaacacatccctacagacagaagattccgcagttacctgggtcgactgggtcttttgacagaccagacgtcacaagcacgcagtcaggtgttgaaaccgcttcaactgagccaaattctcgagcaactttagccaatcttggctctgtttcggcattgcctcaattggacgtccaacaaccagtgttgccgttcacatcccaagtttcacacaacaggtcaagcagtaagccaggaagtgttacgagcagatcgaatgctaattctcctgccggatctgtatcttcccattctccccgctcgtccctgtcatcgcctctcattcatccattaaatcccgaagcccaaagagcaactggctctaaagttgtttcgcccaatggcagtattggtaacctgaatgagtttggtcataagtatcgcaattcaggctcccgcctatccataaacacatcaagttcaggccactctagccctatgtataacatcaagcctgatcatagaacttcatcccgctctgttgatttaggatcattttaccaactagaccgcagcgtttctccagctatcaccattggcaccaacatggacttttctcagtctctactagctaatcagcagaccgcagagcatccaagtgctctggttccccgcatgaaaactattgaaatgtatcgaaagaatgcacgtaagtctcatgatcctgctgtacttttccagtatgctcaatatatgcttcagacggctttgctgctggacacagagtctgaagaggaagggaaattgcgcaaagattttcttcaagaggctcaacattacctgaaaaagttagcggacaagggttacctagatgcccaatatctattgggagacgcatactctgtcgcagcgtttggaaagaccgatgacaaggagtcattttctctttttcaatctgcagctaaacatggccacgtcgaatgtgcttaccgtacagcgctctgttacgaagaaggcttaggtacgggtaggaactctcgtaaggcggttgagtttttgaaatttgctgcgagtcggaaccacgctgcagccatgtataaaatggggctgtattcgttttatgcgaagatggggttgccaaacaatatcaccactaagaaagctggtatccaatggctgtctagagcaaccatgagagctactgaacttactgctgctgctccttatgagctagccaaaatccattaccatgggtttgaagacattgtcattcctgatcgaaaatatgctttagaattatatgtgaaggcagcatctcttggtcatgtcaaatctgctgccatcttgggtcatcattatgaagttggagatgtcattcctcaagatccggatctatcgattcattactacaatatagctgcaatgggaggtgactgtgaatcaatgttggccatgtgtgcttggtacctagtaggttctgaaaagctagagaaagatgaaaatgaagcctttgaatgggcaattcgtgctgcccacggaggtctcgcaaaagctcaatttgcagtgagtcatttcttagaacagggtattggatgtgaaatagattttgcccaatctaaagtctggcttgagaagtccgcccaaggaggcaactctagagctataacaaagctaaagaatttaaattcttcttctgagaattccacgaaggatagtaagaaagacaaagattgcattatcatgtagaagcttatttatattcaggctcttctacttatatacttgtttaaaaaggggtttagattagataataatattagttcctttacagttattcattagtttattcgtagcaagagcgagaggaattatcttttaagatgatccttgatgctgaacactgtcatgatccaggccattagtaaggcaacaacaccaacactgacattcagggtaaacattccagttaaaccacggtaggccattgccaagacaataggatcagtgctttctgcaaaaaccaagcctccacaaagaagacagaagctggtaaccaattctgttaaaggtctagaaggttgaaataaatctcccttgtaggttttattaaacatgaggtacaacatagtagcgattctgaataaggatccataagtcagaagactaccccattgcacatgtatactagtggataattccgaagcctgagcgtgctgagacattaataaccctgtccaaaagatggtgaatgcagggaaaggattcggggaaaaaccacaagtaacgttggtgaaacattcagcatcaataggttcattttcattgttgatctcctctactgtggactgaaacttaattaacctccaattgtttagcttaagctcagtaatcactccacagagaccacagccaatatacataaaagcaatggatacatgttgcaagtcctttgcggcccattcaccgccaggattagacagatgctccataaatacgttggtacaaccataaaaaagaattaagctgctctctagcatttccattgtgatcatgacatttcttggttgaaatctaaaccagattgagtctttcttctcataacggttgataaaagagtaattccaagcccaaccaagtttttggaaaccaccacaataacgggcaagagatagcagtccgagactgaaaaaaacacctcctttgatgaaatgtgctaataggttgaacacagtgtttgccatacctaagcaattgagtacagctacacccgtgggaaaataaattaaaaagaagaagaatatgccaaagttgaggaggttaaagacaactgaagcaacagaaccaagggatacagcaatcctagcgatccaaggcacctcaaacaacctttgaagagctccatcgactttgtaagagtaagaatcgtgatcttggctgggaatactcggaacatcgtggattgttccatttgaactattatcgatggagaaattggcttctctatcgtctaactggaagctgctgttcagcgagtctcgatattgggaacgaaactgtttggaatgactgtcacgagtttcgtaatcaaataaggtggatgacgtagaattaacctcatgctttttgttatgctccttgtttgataaatcttccaatggcaaaaattgggcgtgagaattgtcattaggggttgacggaagaactgcaaaaaatttcgatccctggtaaatgacggcggacacgaagtgcacaaccgtgaagacaaagagaaccacccccatttttgtgtaagcattattagggtacaagtctgggactgaatcaatgaagatagagtagcttattaaggacagaacggtaactatcgcgtgaacggatagagccggcaagtaccacttgtttttgacgttattgagaaccaagcatactggatacaagaacacaaaagtcacaaccattgagatgacatgggcgtacaagaaaaaccttgagttggactccacggtgaagtaggtcgtagtattatagttttcccagtagagtctctcagctggggataaatctgtgtcaagaataggcagcccatggtgatggtgtccttcgaaggggacaggctcaatggaaggaattgcggtctcagagtcagcagatccgttcaattgatgagtagctgtttctgtggtctcagcagtaaccgagttcctactcatatccatatccatgtccatcccgccgtgagaaccgtcatgggcgtaagcagacaaagcaatagcgccacgagataggcagaagcaaatcggcactattaaccgagatagtttcattttttcctggaagttgaatggtagaatgaagaagaagagaaagagattttcccaaggggcaagtgtaatccttcagaaactgaaatcagcctattcagtttgttttttatactagccttcttatttaggcaagtgagctaaaggagatgcataaattatttttttctctcacattcgaaactaattccgacatccgagactgccggcagtcttagtttctacttgactcggtaaacttagggcctggcttaaccgagaaggggaggatatttgctcgttatagcaaggggtagcttggtataacctgggatgtatgcacttgcgctggagacagtgcgatagggagctctatggttcgagctaaccaagttgtggcactacaacagggcaatttcagactagtctgctgatttataatagaccctatgaaacagttataacgccgccaagaattactagattcccagtcctaaacattacgtcatagtcaaacgtatccaattgcgtacattgaatataaccgaacttgagcaaaaactgatgaataacacctcaagaagtcaccccctccgcgaacgattactaaacttacgatatatggtgtgtttgtcatatgcaattgtcacgtgaattgtgaaatagggcccaatattcaagcagcttgaaccacgacgttctagagttccagcccttcttgaaattgaagacagcgaccgaaaattgatctacctaggaaggatacaccaggtgagtagcctctgagacgtacatatttttgtgcgtctgagtctttgcgttttaaacccgcatagtatgtgcagttacctactgaggtaagacatcacacgtgaaaccccctatatgcagtgcgcgcacatctctattgtatcgctttgacaaaggctcgtgtactgctcattgatttgctatctggggtttttgtggcaggtcctcttccaagaagaggaaaagatcaacctgtgatcccgttgcacttccttaaacaattgaagcattgcaaaatgaaccactcttcggacagcagatcaatggattcaagttcgattaccactacccgttccaatgtatcgtttccgtactaacacttaggtccagtaattggaatctcagaacgaagtgcaccgatgttcagtgccctaaaaactccctttatcactacaggaagatgggctgatatcaagagagtggggaatctatacggttatgatcctaattccgccttggatgatgagagctccctattaaatcagaaactggccgaaggaggcatctttgatacgtttgacaacaactacgatccttatccgacatgggcttctgacgatgaggttcccatttcaaagctgaaaattcagataatctttaaccaattgcaggagatatttcacttccagccttccaacataaggaacatgtttgattatcttatgaagctactagactccagagcctccagaatgggacctcatctggctcttcagtctcttcatgcagattatatcggtggaatcaatgcaaactttagaaagtggtattttgcctctcaactagatttagatgactctattggctttgaaaacatttcttacaatggcactgctaaaaggcactcaccttacaccgtgcccatgctttcagtggcccaaaagagatggacagagaacatgaatgcactttctccagacgatgcaacggtacacctggcattgtatcttctttgctggggagaagcaaataacattagaatgattcctgaatgcttgtgtttcatctttaagtgctgcaacgattattattattcactcgatctttcaaaatctataccttctcctgaaagaccctttttggatcacatcatcactcctctttatcaatttcacttcaaccagatgtatgctatcaattcgaaaggggagacaatcccaagaaatatcgaccatgataagattttaggatatgacgatatgaaccaactattttggtatagaaaagggttggaacgaatcgttctacaatcctcaaagcgtaccattctctcatttcccccggcagagaggtatattcatttgcataacattgaatggtctcgtgcctttttcaaaacatattacgaatctaggacaagtttacattctgttctgaatttcaatagagtgtggtcaatccatgtttgtgtcttttggctgtacacaagtttcaactcaccaacactctatacaagtgattatgactatcgaagagacaaccaaccaactgcatcggcaagattggccgttttatctatagcgggttccatctgtttatttttgaactggattgcggtgattgcagaaattaagttcgtgcctagaaaatggcctggtgccgaatcaatgatacccaaactactacttctgttgattctaacattagtccaagttgcccccattgtctatatcttgtttttcaacagcttggactaccaagacatgttcttattgataatctctatctttgagtttattttatccattgccatcattttctatttctccatagtaccatttggtgcattgttcggctcttacatgtctaaaggtgagagaacctacctaccttcgaaatactttacaggttccgttccaaagctaaagggaaaagcggaactggcttcaatcgggctatgggtttgtgtgttcctttccaaatttattgaaacttatttctttttgacactgtccattcgtgattctgttagagagctcagcaccctggaaattaatacctgtattggcgaaacatattttggcgatttactttgtaaaagacagccattgatcctccttgttttgttattctctactgacttaattctcttcttattggacacctacctctggttcatcatttggaacacactcttttctgtttgcatatcgttttctatcggaatttcaatacttacaccttggaggaacatcttttctaggctacccaagagaatttactctaagattatcaatgacaatgggagtacaagcatgaagtcgaaacaactggtttcacagctttggaattcaattattatttcaatgtaccgggaacatttactatcgatagaccatgtaaacaaactgatttatcaacaaataatagttccaggtcaacaagatacatcggagcaaatactgaaggagcccacattttttgtttcccaggaagaccatgccctgaagacttcattatttaaaggccataaggaagctgaaagaagaatcacgttttttgcacagacattatcaacaccaataccagagtctattggcatagaaaagatgccgtcattttcggtcttgattccccattatgcagaaaagattagcctctccttgagagaaatcattaaagaagaagatgagaattcgcaattgacccttcttgaatatttgaaacaacttcaccctgctgaatgggtaaactttgttgaagatacaaaaattcttgcagaagaaattaactcatctgaagacagtttttccaagagttccatcaaggatagactgattgaccttccttattatactgtaggattcaaaacggctaccccagagtatatcttgagaacaagaatctgggcatcgttgaggacccagacgctttatcgtactgtttcaggattcatgaactattccagggcaataaagcttcttcatgacattgagaataaagatatagctgacagtagtgattcgaataagagattagaagaggcatcaattatggcactacgaaaattcagaatggtggtctcaatgcagagattccacaaaagttctcccgagcaaagagaaagcaaggaaaccttattgagagcttaccctgaattgcagatcgcatacttggaagagagatactgcgaagatagaggctgcttagagtattatgcttgtttgattgatggaagttgtgaaattcttgaagatggtgaaagaaagcccaaatatagaataaggttatcaggaaacccaataataggagatggaaagagtgataatcaaaaccatgctttgatattttgtcgtggagagtacattcaactgattgacgccaatcaagacaactacctcgaagaatgcctcaaagttagaaatatattctcggagtttgaagagttaaactctaccgacgatccatactgtctggatgaggacacaaacaacccgaatcccgttgcaatcattggggcaagagagtatatattctcggaaaatgtcggagtattgggagatgttgcagcaggtaaggagcaaacatttggaaccttgtctgccagaactttggctctaataggtggaaagcttcattatggccatcctgacttcttaaactctgtattcatgactactagaggaggtgtctccaaaggacaaaaaagccttcatttgaatgaggacatttatgcaggaatgaacgctcttcttaggggaggtagaataaaacatagtgagtatttgcagtgtggaaaaggccgggatttgggatttggatcgatcttgaacttcacttcgaaaattggttccggaatgggtgagcagatgctctccagagagtacttctacttgggaactcagttgccattagacaggcttttgtcattttattatgctcatgctggattccatttgaataacatgttcatattcctaaccatcaatttattcatcctcttctctgcaaatttggcagctttggtcaagaattctttggtttgtagctaccacaaaaatattccaataaccgacccaaagtctcctgagggttgcttcaatttagttgtggtgatcctctggcttcaaagatgtgtagtgtctatcattttggtgtttttcatttcatttatccctttgtttgtgcaagaggtcactgaaaggggaataggaaaggcggtcacaagactcagtaagcaacttgcctccttttccattttttttgaggtttttgtttgcaaaatttatgctaactcactattgaataacttatccactggtagcgccaaatatattgccacgggaagaggatttgctacaactcggatgcctttttctgttttgtattccaagttttcaacggtcagtttacatgaagcaagtattctattctttttattacttttcacatccatttctatgtggagaacagtgttgatatacttctggttcacgatcactgctctggtaataagcccgtttctttttaaccctaatcaatttgcaccgcaaagctttttcttagattacagaaaaaccttgcagtggttatttaagggtaattctaaatggcagcaggaatcttggataggttatgtccggaataatagagcactatacactggatccaagcggaaagaagttaaacttggggagaatatagatctaggctacttgaacaagccatcaattattaatcttcttttgactcaagtgggaacacatctgctgaagacattaattgttttcaacgcgtatcttttttcaaattcacaattgaatactggcgctttgagagtgaatactattatgaggttggcagtgtgttctttgggtcctatagctgtgaatattgttttgttattactattgcaaccactttctttgataatcgcaccattggtcagttctacctgctggaaatcgtttccgtccgtccttgcagcaattacgagaatattaggactattgaatcacattttgttcttcaacttgctatggatgtttcaaaattgggaattagcaaccacggttcttgggttctgttgttcatgtctgatagaatcgttgctctttcgattggttaccagtttgtttcttaccagtgagttcagacatggacgaacaaacagggcctggtggtctggaaagtggattacttctggtttagggtttaatgtgttgagtcaacctgtgagagaatacttttgtaaggtgattgagcaaagtctttttgcagcagactttatctatgtgcatattcttttatttctgcaaattccaattgttctgacaccatttattgatagcatccactcactgatgctgttttggctacctccaagtaaacaactaaagccgcaactatttcctatgagaaatagtaaaagaaaaaggacccatgcccagttactgtctgtgttgtttttactcatattatctctacaggtggcactcataatcggaccttacatcatttcaattgtatatggaaatgaagtgttcagggagaacatgccagaaatatttcagcagcttttccagccaattgcgtataagaacccaaacctagggttaaaaagccattccataatcactgatatttccaatatggacacagttaatgcaaggaaagataacagataacaagttagggcaaaccccagatatttcttgtagttgtgaataactgtttgtcgctgagattggataatttttcaaacatgagcgtaatgttattagcttccgtaaatgacaaatagattgaaaatcgtttgcaagtagagaatattttaaggcactgtaggacattatctgggttttttatttggttattaatgaccgcctcaatgaagaaatccaaaaagtttgaatctaagccaccttctttaaagagactagagtatgtttctggagagaaagaaagaacgtagtggtaagcaggtggtttctgagatgcaggtaaaaatttcagcctacttagaaagtaaaccgatgggaatgcaggtgggttgaaggatgacccttcaaaaagctctgatgaggacgctggcttttcttgataagtatcagcctcctggatgtgattgcttgtgaattctgaaggtagaacatcataattttcaatagttagtgataggagtgaaccattttccgactgtaagtgttttcttcttttgttcaatactaggcgctcaagttcagacttgacagtagcattgttgggatccagctctaaggctttattgaaagattctaaagcttctgagacgtttcccagctttgacaatgccaggccttttctccatagaagtttgacttgggtctttgtatcgtttacgcgcaattccaaaccagcggttgtatcagctaatacttggtgccagttattaagtttcacatagcacattgctctgtttgaatacagaaccggattttgggggtcaagctgtaaggcttcttggtagatatttgcagcttcttgaaagctaccatcggcaaaagcttgatttcccttttgtttgaggctgaacgacatgtaggtgggactaattgatttttatgcacttttagataatgcaatatactatggtccttggacaaaaaacttgggtgacaatgaggtttgggaggaactgtgagtagatcatccaatgttggacatatcagattctcttagcgaaatctttaactgaaatactctacttcaatgagaaacaggctcttcgtcagttatcatggaatctgaagagttgatagacgaaattggagcaattgatgtaatatttcctaactgtgtgtcaaagataaaaccttctctttaccatgttaaggttccacaaaatgaggatatcgcattcgacttaaactttcctcccaactacccagaaaccaaacctaaaatagagacgataaaaagtgctgtcccgggtttgcaggatataagatactttagatcaaggctagaaagcctgttggatcaggtttttgtagagcaaaatgtttgcctttttgaatttatcagtgaagttaacaatacagtggaagaacttgaagcagaatgggaccagagaaaccagcacttgaaagaaaacagtgaaccaccagaagatgatgcggatgtacgcatttcagcaatttcttctcaacttcagaacagtacaatcaacagttctggctctaacgggaagatggtaaagcaagataatgaccatgaccatctgaagggttggttcatatcggaacctgttgtggatagaaagtctacgtttattggatattccagagcagtgcattcggaaaaagaagttcttgattgtatcaatgaactgaaaatggatagaaaaatagcaaaatcgaaccatgtaatgacagcctataggattcaggcggaaaatggaatacgatataaagattgtgatgacgacggtgaaacggctgccggctccagattattgcatctcctagacataatagatgcttggaatgttgtcgtggttgttgtaagatggtttggaggtttgcatattggacccgataggttcaaacacatcaactccaccgctagagaagcattagtgaaggggaacctggtggaagacaataaaaagaaaactaaaaagaagaaatgctaaatatttactatacatatatattctatattacaaagttgggtatgcgtttattcagttcgaagcttcttgcttgtatcttgatgggagtcttctaggaaatcttcctgggactctttccgagacaactttctttttgcttgggtcttcttccacaaatcgtctagaaatccttcactttccttcagccctttctttttctttttagttttaactgagtctttactatatgtttcttcatctgatttttctacttcttcctctccaaatttttcatctgtctcaccaaacactcttcgccgtgaactaaatcctgcggcatcagaatatcctacactctctacatgaaccctccttaacttctttttcattttggaggcattaggcaacgaccattcacttgagtccgtcacccttgctgtcttgaactcttctgctttctcatcagagctcttcatgaactataaagttagtaaaactggtttaataatgtgaactcattctttctgcccttactaaagttcaaaaagcctttacttaaaacttaccttcatgttcagaactcgacttgagagccctttattactcattgatggatgatgatgatgggccaactagcagtattttcattctatcccagatggttctttcttagatatatatcacgtgacagaccttctcgaattgaaatatatttcttctgaaattttttttagtactttcttagtacctaaggaaccagtgcaataaatgaagtctgatttccagttttctaacttgttaggaactgtctaccgacaaggaaatttggtattcatcaatgatggtaacaccctcatttctcccgtgggtaatcgtgtttcggtctttgatttgatcaataacaagtcctttacctttccatatgaacatagaagggacgttgcagcaattacggtgaataagcaaggtacgcttttaatgtctgtagacgagcacggaagggctatattggtaaactttaaagctagaattgttttgcatcatttcaactttaagtctcccgtaaaggccattgaattttcacccgatggacactatttcgcagtaggatgtggcaaaatcttacaaatatggagaactccaaacgttctggaagacaagcagtttgctccatttgttcgtcatgcgtattacacaggccattatgatgacattacttccgtctcgtggtctggagattcgcagtttgtcctcacgacgtctaaggatatgacaacgcggctctatggagtagatagggatcgcatggatgaggtcagaatgaccttgggtggtcatagagactatgtggtcaatgcattttttgatgaggctcaggaggttatctacacagtcagtaaagatggagctctcttcaggtgggaatacacatctgatccaaagagtaaagaagatgaatacgaggaagaagacgaggaagataggagtacggatgaagacggaatattacaaaaaccaaaaaaaccagagtcatggaggattgtggccagacattacttctttagtcattccaaattgaagtgtgctgcattccatcccaaatccaatattctcgtggtaggttttggcaacggagagttcagactctacgaattgccaacgttcacactaatccagcaactttccatgggtcagaattctgtcaacacagttagtatcaatgcttctggtgaatggttagcctttggctctagtaccttaggacaattgttagtatatgagtggcagtcagaatcttatatcctcaagcagcaaggccattttgacgctataaacgctttgacatattctcctgacggctctagagtagtaacggcagcagatgatggtaaaatcaaaatttgggatgttctgtcgggtttctgtctggcaacatttgaagaacattcaagcgctgtcacttcagtcagatttgctaagcgaggtcaagtactgttttcatcctccttggatggtacggtcagggcttgggatctgatcagatttcggaactttagaaccttcaccgctccagaaagagttcagtttggatgtcttgcggtagatccaagtggtgaagttgtttgcgccggttctttggacgattttcagattcatgtttggtcagttcaaacaggagctcttctagattccctagctggacatgaaggtccagtttcttgtctttcttttggacaggagggtgaagctgctacaacattggcaagtgcttcttgggataaaacgattagggtttggaatatatttggaagatcccaacaagtcgagccgtttgaagtatactcagaagtactagccatcgacatgagacctgacgggaaagaagttgctgtgtctactttgaacgggcagattttgttctggaacgtggaaagcgggaaccaaacgaacttcatcgatgccaaacgagacattcaagttggtagatacagtgacgatagatttgaagccaaaaatagtaagagaggtaagtgtttcagtacaatcagttatagttttgacggattgtctttgattgctgcaggtgataataatagtatctgtctatacgacgtcaaaaatagtgtattgctgaggaaattcactgtctcgttgaatatgaatttggaaggtactttgaaaaagctcaactctaagaatctaattgaaggcgggccaatagacttgcttgacagggatggtgaaaactctgactatgaggatcgagttgacctgaagctaccaggatcacatcgtggagacccctcagtgcgtaatatcaaagctgctgtgagggtaacaagtattgcattttcacctggtgccagttcatttgcagctgcctctacggaaggattattaatatattcagtggatgacagtgtcaactttgatcctttcgatttggatatagatatcaccccagccagctgtctagaaatgttagaggaaaaggaatttttgatcgctgtggtgatgagtttccgtctgaacgaacgttacttaattcatcgcatatacgaatccattccattgaatgagattgatctgatcgttgcagacttacctaaagtctatgtggagaggttcctacgctttattggtgaactatctcttgaatcgcagcatattgaattcaacctaatttggatcaagagtattttggcggctcatggcaaatatattagtgctcataagtttgagtttagtgttgctacaagaatgatccaaagattccttgccagaatagccaaggatgtcgtaaagacgtccgttaggaacggatatcttgcagagtttttgttggatacccgaactcaacaggacagcatccgaattgaggaggagaaactcacattgtagaatagaacgtaatgttataattataatactagatagacctatcggtggaatattcaacccactatgttacgcgaatgtattcctcattgatttccatcaaagtctctagggagctatggaaccaatagaatgcttgacggtcttatcaagaattctggttactttgggaagcaacggtgataaggtcttgaaagattatagacacaatttggatcttttgtctgcctgtctttctcatgcaaactccaatgctggatttagaagagaagtctttcaatcccaatctgtttgggtaatgctgaaccaaattttcagtttctacttggaaaacagtgatactcgtgttgttcaggacgagatatggcaatacagaaccaggaccgttagaggcattagtttgctagcaagaagcatgataaccgcatgtactgcccaggattcgtctgctcaaccgtatgtggaaaatactcatagaaatatctccaacgtcaccagggtttcgatagctaaattatgtgacagctccttatcagatagtacaagagatttgtatgtgaagctgatttcttccaattttcaattcctaactaacctgatgaatacaaaactgggggacgagtatcatggaactatcgactacaagctagctcaggatctctttagaagaattgctcacgttaaggaaccgggtgatgcacccttggaccttgagtttgcagaacacgggttgtatttagtcaatagtctggtggacaataaagagttctctttcacactaatggatgatcaagagacatttaatttattcttgagtgctctgttgaacagttttgaagaattctctactaatgctgcaatcgagatagaagctgccaaggaccaagatctgaatgcaatagaactcttgattgtttcaatctgctccaaaatcatcacaaaacccaggttcgttacttggatcgatacgatggatccatttgatggcaacatgcccaactacctaaaactatttcaaacaataattgttaatagagactcatggagctcagaccagctgattgtgcttataacatggttgactacattgtttgaccgtctgaatgttgacgacaacagtgtactaactgcgtcacttaacaaagtattagtctctacattagactctattgccagcatatgtcaatacgaagaagtcagacagtatatcagtgaataccactattttgtcaagtttttggatcttttgaagatgttgtcaatcaaggttccaagaaaagcactgaaagactctgcatcaaaaattcagttccccaacaccaaatcaatcatcgtagaaatactcacctttctggtccacaaaaatttcaaggttcaagaagcaatgcgtgactttcagggaatagaagtcatcttgaacaattgcaacattgatgaaaatgagcctttcatcaaagaacgatccatactgtgcatcaagtacttactagagaataatcaggctaatcaagactttgttgccaagttggaagctaaaaaagtaacagatgataaagttctcagtgaagctggatatgaagtcgatattgtggacggtaaagtcaagctaaagcctcccaaacccagatccaaccccagtgaatgaaattccccctgtacactttgatagaagcccacatgctgattatgtaattaatcctccctacaccactcgcgtgcattcctttttttccaaatcttcctctcttgactcaccttccccaatcataatgtctgtctacagatcaactcgttcaagtgccgaacagcaagtctcatttgaagacgccgtcatcactggtttggccaaagatggtggtttattcatcccatccgagattccatctgtcccaactgatttcctgtcagcttggaaagatttgagttttcaagatttagccttcaagatcatgagattgtatattaaggaggctgaaatcccagataatgatttgaaagatcttgttgagagatcctattcaactttcaggtcggaagaggtcactccgaccgttaaattagattcacatgacaacttgttcttgttggaactgttccatgggcccacttatgcctttaaggatgttgccttgcaatttgtaggtaacttgttcgaatacttcttgcaaaggaaaaataagggcaaagctgaagatgatccaaccagagataccattacagtagtcggtgctacttctggtgatactggatctgctgctatctatggactgagaaataaaaaggacgtatccgtattcatcctttaccccacaggaagaattagtcctattcaagaattgcagatgaccaccgttgttgatgacaatatccacactttgtccgtgaatggtacatttgatgattgtcaggcgttggtcaaggaagtgtttaacgattccgagttcaatgataaatggcacatcggagcgatcaactccatcaactgggctcgtatcttggctcaaataacttactacttctactcgtaccttcaagtctcccaagcagttggccatggtagagtcaagtttatcgttcctagtggaaattttggagacatcttggcaggattttacgcctctcaaatgggcctgccagttgagaaattggtagttgccacgaacgagaacgatatcttgaacagattccttactactggtaaatatgacaagggagatgttaaaccaacgcattctccagccatggacattgttgtttcatctaactttgagagattcttatggtatatgatcaaggaaacaattggtaagaacgatgagaaggccactggtgaaattctaaacaactacatgaaagagttatctaccaaaggtgtgtttactgtgcctcaagcagttcttgataaggccaccagtattctggacagtgacagaatcaccaacgaggaaactgtttccaccatcaaaaagatctatgaagccacttccaataactacattatcgatccccacacttctgttggtattgccactaccttgaaccaaattaagaaagacaatgatccttctattacatacgtctcgttgtcaactgctcatcctgccaagttcagcgaagtagttgatgcagctttgaccagttatcctgactacagctttgaaaaagatgttttgccagaagagttgaagaatctctcaaccttgccaaagaagataaaactaattgaaactgccactttggagtcaatcaaggacactatcgttaaaactttgagctagtttataaatagagaaagctatatatcccgtaccagatgtagggggagggaaggcccctctagtgacctttcgattcttcaaggatttcaatatgagatgttcaagagaatgattaagtaaacaccctataacactacaatctttgggaagttaacttgactttcctaatagatatgcttttttgctggtagtgatcgaaggtgcttttacagtggttaaatttgaaccgtaaagccacatctctataatactacgaacttaccatacctgatgatagagctactacacactcattcttaaagcacgcaaactagatgatgtccttgggttaatcaatacgactccttctgtgatccttcttcagaaggaaggatcttatcgaccaataagaaatctgagccatcattcagtgtctggtacttgcaaaggagccttgagtagttgaagaaaacgaaaataacactcccaacaagaattggcaccgcatcaagcccgtagattaatttttcgtttgaggcaatggcaccatcataaccgccaaagaattcaacaactctaaagacggatcgaaccaagatcaaaagtgacgttacgaataaaacgacaaaagaaagcatccaatgactgtacttggaaatgtgtcttttggcatgcttgtgcacttggatcgtgtagagaatggagaggacgaaaaatccaccaaaaaagatgatctgaataaacagtccaacaatgacaataatttttccccactttctagcgctatccattgcaatcaatccaccccctgcggcttgaaccagaagtgagacaatatcagctgcaactaagattttagtgaagtacttcatagaaatgcaaatgtgcttttcagtgtcggtagttttaaccagttctccaaataccatgtacagagtagcggccatcaaaactggggcaatcaaaatgaaggtcgattgcatacagtatacaataactgagtctttgttttgagttgcaattgccctggccacgtaacctacggattccataactaaaccgatgatgaaagggatcatgatgcaacagagacgcttttttctcccactgttgaaggtcaagttttgtttaaaaccaacgtgaaataccatgaaggaatgaatcagtgtaagaaggccaaacacaactgcaaatgctattgcagcaggtagacttgggttgtagttgaatagtttaaaagccatttggattgatgatgctgttgttccctagagatgtaattggggccttttatacatatctgccactgattagatccacccctgcgcctctacttattcaacaacttgatgactttcatgcaatgctttttatgaaaaacaagaggacataatgaagaccatgaaacgattatttaaagacagtcaaaataactggagtgagatattagggtttagtcaaatgtaataccatgatacaaccatatcctttgtacttgcttcattggaagttagaacctggaaagaaggtcaaaaaatatcactatgatattcaggcccctagtagtaatagccgcacctcttgatgcaagatgcaacaaaacgcaaattcagcattaagtgctgtctgcaacaaagcctcgatattacaattaagctctgcgagtttaccagtacatagcgccatacagccaaggataattgaaactttccaagccttgtttttggcctaatctggcgtcatcgcttagtcaaaaggcttgtatacaatgcatatccgtttgtggcttatcccagtgcatgttaataatttgaaggcttagattgtagcacgtccatcgaggctcagttaatccgattgtacggctgttatatgcagtcatataattcgtcaaatagagaaccagtgccaaagttggaaaaagtggcattggatttaaggaaacgtggtttctaaagtggattctcttgtctgctctccaaattgccgttagctatgagttctcgttcatcaacagtcgaatctattttcgacaacactgaacattgctggccattcgatttttggtatatcaacttaaatttgtaatgcttcgatctggttggcaggtcaaactcgaaccaaggatggcactgaaaggagttttttttacctatagtttaattgataaaattatgaatgaattttttacctctgggctcaggtcaggattagctgagaactctactgcattttaaattactgtggaaattgagacgctctgttcatttgtgcaacaagcctaaccaccaaagtaatcagttttggcttacttcaatagtagcaattatctctccaagttcggagtagtaagctgcgattgaacttcagtttaagacaatcgtctgtgaaaaggttgagtagccttggtttttcacgatttttctttcataatgagtttcagcccaggaatgaagcatgccagttcaatgattaatatttacataccaagtgatggtgacgtacacttaatttacacttacatcagcaatgatccctttgaccgtcacactgacttgtaatgtttcccccagtgaacaagaaaacaatcaactctatcattagatactcacagcaaaagatctggagggaagagctaggagtaaagagtgaaggtttggcaggccgatagatgcatgagaggaattgaaaagaaaaaaaaaaattcaaatgttaaagacatattgttttctgccaaacattcaatacaacatagcaagcatctattcagatgttcttactagctaactgttaccattttaccttttactagtcttcgtttgcaagcaggactagctaagaccttcgctggtccaccaaagtagtcgcgacaaaagtttaaattagtgttggaaattatcaacatttaacctcccaaacacgattattaaatagaccaatagatgaacagaggaaaacccgtgacccgtgagcctcagatcaatccccagtcggtgtctttcaagccaaccgacttgatcattccggaatcacttcaagagatgtttcctgaacaggtggatttgttcaagaatctacaagacaaagaaaaacaactagacctcttggtcaacagaaaattactggatttgcaggattatcaaaacaacaatatcaatggagtcatggaagacagtgataagaatgagatcttaaggatattcatatataatataagtgagaaccagccatggcagttagctaagcagtcagaggaccagtcagaggaggccaaagcgatcgccgcaggttcagcccaagcagatccaagctggactttacgtattgaaggccggttcctcaatgatgaagcagctgacaacgctagtcgcaagaagtttagctctttcttatcaagtatttctgtagagcttttcaagggagcaacgaaagagaaattggatgccaacaacattatcgaatggcatgatgaattgcaacagatcaaatcagaaatcgaaagagaggaacaacagtttgatggcttagatatcaagcgtgtgggaagtagtattcctggaaatccaacggaagaagtgagctgtcagatccttattcagccaaaaatgtaccctatcaagttgtcgatattgagtaaagatttggtcgaattgttggggactaatgaaattactcagcatgattgctttgttaaacttttcaactatatacaagtgaatgatctgttccaatttgatcaggacaagaacctgcagcagcaacaaaactcaattcttatcaagtcagacgatgccttgttgaagattttccaattggaaaagttcaacgtgcctcaaatgctggatataatttctaccagattgttgaagcctgtagagccaataaagttgaattataccgtcaacacactaacaaactccactttaggagacatgatcattgatctgaaaattaattctgatttgttgaataaatcttccgctggaggggccaacaagagtgtaagtgacttaattaatgagttgatgaataatcaagccaactcgatcgaggtcaacaaactcaatgaaaacataagtttgactttacaattattgaattataacaagatcaagtatgacttctataagaagtttagtgaagatcctgtaaagtttcttcagaaaatcaatgataagaaccatgagtttctcaagattatttgcagtgattctgttggctacaatactaatgagtacattgatgaggagattttcaggaagagtgagtattacaaggataatatcatctcagaacaggtgaatttgttattgagtagtggaaggctgtagacacttagaataaatagtctcgaatggaattttactctatcgtacaccacctcagatgattgaagatttgatccaaatctccagagagtacccagaatacttcaagaagctgacattggaaggtgattgggagcctgagggtgattataggaaagcaggtctattctgtcaaacgtttgaaggaaaagactacaacataacaatctcacctcaaggctggaccgtagatgatgagacgtattatcccacctttgaagctctagcccatcggatatccaaaagctttagcgtaaaatggaatgaagagctaatgaagaagctggagtcggtcatagagtccgattgacgtcttactgggtgctaataagttgcactgacagaacatcagtcgtagatttcctcgcttacctcagctgtccagtctgcgcgcccagttacaaatatttgagaagccttcttccaacgacacgaacaatatgagtgaatctttgtcacttgaggaaactccacaagaaaatgaggaattgaccatagaggaagagtacaagttgtggaggaaaaattgtcattatatgtacgattttatatccgaaactgctctcacttggccctcattatctatacaatggctaccacaatcgtttcaggctccttctaatgcagaaattacgcagagtcttctgctaactacgttgacctctggtaaagacacagattacttgaaaatagcaggtactcagctaccagattcgttgacaggcaagaaatcggaggagaaagtaaagtcaagactgaaggtattcaaaaaatacccacaaagcacagaaataaacagggccaggtatatgccccagaatccaaacataattggcacaattaatgcctctggccaggttttcacatatgatgttaaatctctggctgagcctgtgataaatgagtatatccaccacaaggaaagtggatacggaatttcatggaacaggaagaaagagggggtatttgccacctcttccgatgacaagacggtggcaatttggaatattaaccactctaagccattacgaacttacgaacacaaagatattgtaaatgacgtagctttccacaactttgacgtcaatatcattgggtccgtttcagacgataaatctctgaaaattcatgatacaagaacacaaaaaactgtgaactctgaacaagtcagtgaaaagggagtcaattcattaacgttctccaccttttccgagaacctggtagccgttggtggtgaagattttaatgtatcccttttcgacttgagaaatctaaccaggccacttcattctatggtcggacatacgtcaaccataacgtcgttatcttgggatcctcatcatgagaacattgttgcatctggctccgcagatcgtcgtgtaatactctgggatatcagtaagattggagaagaacagttacaggatgaaatggaagacggtgtctcagagttatttatgatgcacggaggtcatactggatccatatatgatttgagtttcaatcctgatattccatggacattggccagctgttcaaacgataatattgtacatctctggactgttagtagaaaggtactaggatcagggaatgaagaggtcgatttgaagtctttagagtgagtttttgtccactttttggctctcatcagcaataaatatcaatctaacaaaagcagtagaataactagttttcataccatactttcaaattagtagaatcagatcatcacttcttcccccgctaccttcatcctcatactactattctgccgcgaaagagaaaaaagtgaaaaatcatgggccaagcttcttcaccaccacacaatgaacagattgcttaaaaggccccttttgacacttgaaaagcccagttgtgtgcgttttactgccatctctaagagaaaccgtatcaaggtgcaactactaaaggactttccaggtgtgggggttcgtggagaagtagtaaatgttagacctagtttgatgatcaatactttacaccacaataatggagcctgctatttacttccaggacaggggccacgtattcctgtagttgagaaaaaacatgaagctaagcagaaagagccattgtcctctcaatcggagacacgaacaaccaaagctgattcgaagcctacgatgactcctgatttactagccaaattaacaggactatctttcaaagagtcaacgtctccttcgaaggcagaaaacagtggttcagcaaatgaattagaattagccactgccattcaagacatgccaaaggtaatcttcatgagatacgctacagatgacaatggaacattgaaaaatgagatcagaaaagatcgcctttgcgaacacctgttcaaacttacagggtttactattcctacagagtttatcaccatccaatacatgtctcccaatggacctatagacttggattatatggactttgtaggggactataccttgaccttcaagttgtcctccacgttcgaaccaattgttaagaacgcgaaaattatctccagtaatatcgatttggccctgcaaaaagatctcatccgtccttagagtcagagacggaaagagatctcgggtcaagagattccctgtatatacttataatccaatcattatatctttatggactttgaaactgagaccgccacgtctagaacgttggactgtttgtcatgttccagccaggtagtccatggacatgtggggaacagtgccatccaattccccttgcaattgaatggttggaatgttgacactataaataccactcaattttctaaccatcccggttatgggcgattcaaaggtcagaagacatctgcaagtgaggtggaggcgattttcttaggactgatgaacattggttgtcactacgataccctcttgttgggctatgttgctgatgctggtacattacgcactataggaaacctatttgcggaatattcgactaaccatggggccagatttgtcttggatccagttttgggtgataacggtaaactctacgttagcgaggacctgattcccgtctataaagagatcattagatctgggaaagtggatatggtgactccgaaccagttcgagttagagctgttactagggtccaaaattaattcattgaaagaattacgcaacgcaatgtttcagtttcaggaggaatttcgggtcaagaacgttgtcgtcacctcagtttcctttccgacgggtccaaatcatgatgactctaatatatacctcgctggcctttgcgaagatcaatggttttatgaaaaagttcccgagattgatgccatattttctggttctggagatctttttctctcattgttgaatcacctgtactaccacttccccttgcaagaagcattaatcaaaacagcttccagcgttagcaaagttttacaattgtcgtatgaaatggaattggataatccttgcaaaattttcaaattggataaattatacgttccgcatctacgaatggttgaagcaagggatatattagtattgtccgttcccaataaataatgcatagttcatttagaaaaatgggtttttttggccgcctgtattaactctctaaattcattcccatgagttttcacccaagctgatctattaaacttttctgtatgatttgacttattgttgtctatctcagataaggcctcccattgctccaacttgtccctcaaaaccacactatccttagggttggcagaatcaaggttactattgtaaaggttgctgtactcaacatatctggcctctagctgagctcttgtaccggatgttggcaatcgaagttgcgctagtttctctttgactttattggtcgataatgaggcaaaatccaactttgctagtcgtttcatatcaactgctttctgcacctgaaaatcttggtctttgggtatcgtgactactatatctttttctggcaccttttgcgccgactcatgatgttcacgatcttctttactgtcctcctctttctcgtctttgttgtctttgccaaccagacatatgtcaatgtgatctccttgaagctcttctgcagacataaattctccacaaatggggcactcgaccatctcttctctggagggaactgacttaccaaaccctgctgttttcggcttcttcctagattcatacacgggtttttgcggcttgggccgttttttttcttcttgcaagattataacggagtcatcatcagcgttaagctttgctaaaagttggcttctattactaatgaaccattttccgatgctatccagaagcaaaactttgactaaattgctctcatactgaacctcgtggcaaagcgggcattcctggttcactttcagataccttctaatacatagagagcaaaaacagtgaccacactgagtcataacaggtgcctttaacgtctctttgcaaatatggcaacttaacattgattcaagatcaaaaagctttggaactttagtgcccagccagtctgatgggtcagagatagaacctatattacccacagtagcgtccattgttatttccgtaagccaagcttctatctagcctaactctatcctaagacacgttcctgtaggcctctttgatctaaagtattcctggtgcatccgtgagagcaattcgcgaagggcatatcttgctggtgaaattcgtttatctaacctcaactccaccaagttgagtatgacagactattcgaaggttccgatcaattccttggagtctctccgtttgagactcactcaggctatgcattcactgaataaattgaatgattccatacatcagtcacaaactctacctcaatggtcatccatccaaaaccaactcacagtcattctatcccaactaacctctctttcgacgacgttggaaacacaacgagaaatcctacagtacataaacgtttaccctctgccggaatttccatcaacgacgcatgaagggctattgactacactattgcggaagaagaacattcctgaggtatctgaatggataacacaatctttagaggagtccaaagataagaacccttctgcgtccgaccaatttgctacctggtgtgctgaaacaagtgctcaagaaagtgaaaattggattttcactggatttcgaacaaaatatgaaatagacaacgatataccgcaggccccagagtattctcttagggagtccacaagcacaaacgtatcacaagatgaagtctctacagatgacttgaacaaattaatctacatgggaatagatcccagaaaacagtagtttatttttgtaactataaaaaatagtttaagaaaaataatatcaaatcatttggaactctccatgtcaaccaactcatcccagagtttaaccaggcgtgttttctcctctctttcactagtcaacttttgcttaagcttttgaacttcctgcttcagtgtgttcttctcctcggtgaccttatttagcttagaggaccattttgtctcgtatcccttcttgagaacggacaccttttgttcatgcttggcagagtattgaacatacagatcttgagctaattgttgtaatttctgttcggcctgctcgtcgtgtgtactcaattccctttgtaaatcatctatcttttgttgtaattcggacacaagacctttttgagctccggtagaaaagaatgtttgtttctctactagttgcttctccaattctttgattctctcctccttttgggccatagatatcttgtaagattcctccagctccgtcaacttatcctgctgacttgtttccagttcattaattttggatgactgagattcaagtttactattatatctcgtttccaaagattccaaagattcttttaattccttattatttgtctcgtaagaatccagctctatcgatttcacttgtagttccttttttaaggactcaacattctgctccagagactcgaattgagattgttgttgggccttctcgttaacgaggtcggccaattgtgatcgcagagaatcagcattattcaaactttcatttaaagagccctccagcttttcctgagtggcctttaacttctttatttcagcttctgcatcctgaagtagctggtctctgtgttgtaattgagtgtcaagctgttcagtaatttctttgactttttctttccacgattggatttccttcgaagagtcatcaagatggtcgttatgaatctctttaagctgttcaatttcacgagattgagcttgtattttttccagattttgatcaatcagggatttcttagcattcaactcagccaagaccgattcattgtgagcggagtcggtctcaaacttcttctggtaaaagcaaacaatatcaaatgcatcttgatacttcagcttggtatcttttagttgcagaatcaaagaactaataacacctttgtatttgtcttgcttcgcaaggctcaaattgagagcttcaatttccaatcttaatgctgtgatttgcgactcattattgatcttgtcagattctaaatttgctaactggcttttcaaagcaatcaattgttggttagcagagtttaattccaaggctaaagtttcgttttcctcaactcggtcatttaatcgggattcaagagctataacgttcccttcatgaaccgatttgatattactgatgatttcgcctaagctctcaaaatcttcttcttccagatgtgtatattcatcactttcttcattatcatctagctcgttcaagatgctatcttgctgttcttccccctccctctccggttcctctacctctccttcgttgatctcatcttctgcatgtactgagactaaggtttcacgtctatcctcatccagctcatctaacatggcagatttattaaaaacacctggagaattatcgcttgcctcctcctcaaaagattgaatcttactatgatttaataagggcgatgatgggttgtcgataattgggtaatcttctccgtctcccaacgcgtcaattatacggctctgttgttccgtagcagggctggctgggtttggtttggttggtcgcattggagtctcttcgtcaggtttatcgagttttgggatcttggtgagcctctgaacggaatccaaagattttcttttggcgggagaagattccaaaaagggattgtcctccttcacagtagttttcggacttttcaattgaattttagcctttgcgcccaaatgaatccccgaaggtaggttcactatgtcattacgcggtactgtcagcggcattctttgagaaggagagctcagctgaagatttctctgaaaaggagacttagatttggacagctcagaaaaggactctcttctcaacgtgtggtttttggactgaaagttggcattgatatgagaatgcgaatgagagtgaatatgtgtatgtctggcttcaatcttagaagtaagaccatggtcgatgcgcttaggatcttttcgaaaggtgatattgctattgggcttgggaggagaaaaggattctgcctgtgcaagcgaagggcttgagaagggatccatggctgtttgttctgtttatttttcgggttaggaaagagagacggatttgtttatattcaccaaggcgagcgagtcgtgttcaaaaacgcggtttattctctgtaggagagcgaaggggacaaaaaccaaagggtccatccatcatccgttcttccagtgagcatagtcaatcactccttggaaagagtctcgaacttgacggtcccgtccagcactaccttccaataactccatcggggacatgggcagcgcgcgccacctggttctcagtttattctcgaattgaattgtctctctcaacatcacaatttgctcagtaatcatcatcaaccatgtccaactcagaagcagtaagtactattatcggaaggctgtcgtgatattaaaagttctttttactgacattcaaatttaggccaggttatatgaatcgatcattgaagaggtcaccgctgaaagcagacaagatttcgaagatagtggtattgatgagtccacacttcaagacttaaggaagatttggagaaataagcttagtgagagcggtgtagcagaattttcatggactcaaaacactaaggaagagttttcgcagcaacaacaacaacagcaacaacaattacgaagtggcgacctacaatctaactttcgtcaccagattgaccctctggcaggaatccaagatatccagataccaaacgacatacagttacctacaatcaccccaaagaatgaggattcaggtctggagttccccggaatgggtcagacggatggggctggaaagtcatataattttgaattacatatagatgcaactccagaacaagtggagcatatgagaaggcgactaggaaagcgtcaagtcgatggacctggatccgataatgacaacgttaatgactcagatgatatcaattccgacttggatgacacggatgatgacgaaatcaatagcgatgatgataatgatgagcaagaagacaatatcatgttgtgtttgtacgacagagtgcaaagagtccgtaacaagtggaagtgcaatttaagagatggaattgtaaatatggatggacgtgattataccttccaaaaggcgactggggagagtgaatggtgatctactttcgtctgctccgcagagcagtgattcaattctaagtctatcattttataattgtataatactattaactttttgacaattctaccgaactgttttgttcctcggggtttcttgtaaggcccaactcagcgacctcttcgggtttgtagctgtccctgtaatgagacattctcttagaccaccatttcttgtgagctccatctgaaaagtcttccattttgattgggtcatcctcatttgcagattcaagcaagtctctagtacctccatgcagctttatgttgagcttgttatttttatcttcctgtacagtgtaatgacctccaagcaacaaatctttagctaccagttctctcgttcttcccaatgactcgatttcagacactctttcaattgtctcattcaaaagttcatcaaacccaggttgagaagcaatttcatgaaaagccctcatcattggtacgctgtcagcatgtactctggaattgcaatctattgtgaaaatgttaagattatcaaatagttggatgtagtctggtctggtcatcacctgtcttgctctccataagggtagagatggtagtacgtgatcaatcttatcatcattctgtaaaggtaaagaaaacttttccctatccatttgaaccaactctctcatcaataacattgcacttgtagatagttttccactctccatgacgtcgtcatccatatctcctcccaaaagtccacactggttcaaaaaccaggtcttctcacggtcaattatctgatgcgaagttaaaaggggatccttattggcagaaactagagccagatgctgcggccttcctccaataagatcatatatcttattggcggtttcaaggggtaaatacacgttgtaatgcttcattctagcagcttttaatacttttattgtatcctctcttccaaggtcgttgaaattaatgacttccaaacgtgtactcaactgtttcattctctcatagacccagtagtcatcggaattgaatatcattgtagccaatcctgatccactcaatgattccgctttttgctgcaataactctatcagcttgtttccttcttcatcatccttgatcagatgggtgttgtttatgacaacgatcaatggtttcacttgaacaccctcttctgctgatttcacacgttttaatgctaccatttctaattttttgaaagctctttcgatatctaagagagctgtagtatcacgaggccctctaatagagaaaagggatccaatataatcctcatgatatccaaaattcagagcttgtcctaatcgaattctgaatatttcagggtcagaatggccatccacaactgtacagttcaaaccctttacagagcgtatagattgtaaaatggcagaaaactttccagttcctttttcgccaaccagtagaaagtatctgcctttaatttttccgttgacaatgtcatccagaagcaattgttgtggtcgtgccacccaatacttgttattgtctgttctcttatacatggacaattgcagagtcggatcaccttcatcgaaagcagagtttatcttggaaagaacttgactattgtaaatcttgtgatacatataaccacttaaagctagaacagccaaagaactgaaggtgatacctgcagtctcaaaacatctgaacagaaagctgccgaacctttcccaattctcctgccgattttctttcttttgtctttctctattacgttcttcctcttgaggagtctggtattcgtttataggtccatctttcttgttcttgatcttttcatccaaatcttgcagtctcttgagctttctcttctcccttatcgtattctcgtcatcgttggtaacctcgtctagaatatcaacaggtaggaacgggttgatacagcgaatttggctcctcaatacggggcgtagagggcgtatcttcgtagcaagccaaatgcgtctgctgtacatagactagaggtatatggggagaagatgaagacgtgttgggaaaccgggccatctcaaggtctatggttgatgtaagggtgtgattggtggtagacgaaccaaaggcaaagactggcccaacgtgacaagctgtatcgtggtcttagtttctgttcccggatatcaactacaagagtattctatccaagcaattcccgtagacctctggaactttcaagttggtaggtactctctctcataccagtcattaataccagttattcaaaatcctaactaacaagtctcgaattctcaaacccaagtcatcttctctcttgaaccccagatgccccaaccatctagagctaagcagcaaacgctgcaaataaagttctggttatttggtttggaagtatcatattttgttgtggtaagttgatttaaccaaaacctgtcccaaatctatatttgtggcctttttgtctggaattagtcacactttgtttcaagcatgtgctaacacattactagaattatgtccctgcacccatttggaaactaatggtcttaatcttcgatgtgtttatgttctggttccgtaaagtatatgatgttctgagcggacgatcagcaacttcaagatacaaacaagacctccaaaatgcacagagtttggaagaatggtcctacgttgcgtctcgtctagattccatctccggtggggaattgtggagacaaaactttatcagcaacaaatacgattacaaattgattagtgaaaggctccactcccttcggaacgcaagagaaagtaaagacttcccccatctgttgacgctgctgaggtccagtcttctaaggaattttggtggtattgcagagaaagaactttacactagggcctactcgggcaccaaaacgcttattgaaacctatgttgccgaaatactaaaatgccttatattcatcaatgattttgaatacaaagacgactttacaaacactgtcaacagcttcaatcagttgaaacttgactttttccatgatgtgaggcaaacgtatggttccacggcattgattctgcaaggtggaagtctgtttgggttgtgccatataggcgtgataaaagccatgtatttcaaaggtctattgccaagaattatctcagggtctggagtcggggctgtagtggcagcatttgtatgctgcctgattgacgaccatctgctgtcgcatttggtgacattgagtaaacaaatggcgaacctgcccgatgaggtattggacaagcggtcagggaaagtggtggaaaatgttgttgtacgtggtttcagtgaagacactttaaacttcatgaagtataccaaatccacgatcaagcatctcaccttcgaggaagcatatcttagtacagggaaagtactcaacattatggtgcatcctactaattcttcagctccatttttattgaactacatcaccactcctaacgtgatgatcataagtgcgttgtattgttcaatgggaagcggagtactagtggaaaatgcacatctatatgtcaaagacatcaacggggagataaaacctatggactacccagaaccatgcatatttatgacaccccatgaggccaacacgtacatgggcgttacgtacacccggcttacagagctgttcaatgtcaaccacttcatcgtttcactcgcgagaccatatctggcggctttggtaggaaatgggttgcgtcattcgtcgacatggtatcccaagcgtgtgctgagaacagttatgggtctcgaattacagcatcgtattgacatgttaaatcgttctggtctgctttttggattcatcaagagactagccgtcgacgataagactcccactaccagcacaagtgagataactattgttccgcatcttaggacgctagtgaaggatttcaccagaatatttgacgttagcaggtccaacgagaatattccatactggattctggtgggagaacgcagtgtctggccactattcccaatactttggactaggacagccattgagtttacccttgatgatctgtacaacaaccaaaggaagatgaggtagcatcgttgtcctggaaacacgggtggcgaaagcatgagcattgactacagccacttattccacctgtgtcagctggaatgtaaacattggtagtccagagttctcaatcccgatcgaattccgagaggcaacggaattcgatcgggttcaagttcggtttgcgcgccatagttcaagcctagctgctttgtttgtgtttatttgtaattccatgcatgccaattgtcccgaaataaactgaatttcgaactgcgagttaatcccgacatgcgttagtaagcatccatcgtccgagttcgtacataaaccttagtgctgctagttgttttcacccacctttagcaacactcgtagctgacctttgataaacagtaaactaatggaaagagatacccacgaggctgatcctgcccagcctgtcctctcgcataataacagctctggcgatgaggtgctgagctaccgtgcagaagatgagcaagctcagttggaaggtgttaatctcgataggctacaatcgttgaccaagcaaatgtctcatgtcacagcgtcagaaatggctaccatggtcgacctcaacgactttgacctgactagaattttggctgtatttgcagaaaaggctgaacagagaggccttccaatcaagtctacagctgtcgaattgaaagatgtcagtgttttaggagtaaatgattccgcttcactattgcccactgtgtcagacctgttgtatcttccaagtacgatagccagaaaaataaggaatagaaagcccgcgttgaggcatattctcaaaggtgttgattttcacactgttccaggggaaatgtgtctggttttgggtcgtccaggtgccggatgttcgtccttattaaagactattgctggagaaactagtcacttcgtcagagtagagggtgacattgcctataacaatattcctcaagcagagatggtgaaacgattcaagaacgagttgatctacaaccctgagctggacttgcattttcctcatttaacagttgaagaaaccctttcatttgcacttgcgtgcaaaactccaagaattcgaattgacgatatatccaggaaaaagcatgttgacaactggcttaagatcctattgacggtttatggtctcggccacacccgtaataccattgtcggtaacgactttgtaagaggagtttcaggaggtgaaaggaaaagagtctccattgctgaagctatggctgctaacggaacagtttattgttgggataatgcaactagaggactagatgcttctactgctctggagtttacggaatcggtaagagcaactaccaacttggagcagaccacttcgtttgtgaccctttatcaacccagtgaacgaatttatgaactttttgataaggttttggtgttatacgaaggtcgccaaatttattttggccctgctgatgccgcaaagcagttttttgttgacatgggatacgactgtcctccacgtcaaacaactggtgagttcttaaccgccgtgacggaccctttgcaaagatacccacgccctggttttgagaatagggttccaattaatgctgatgaattccaggaatactggagggcatcctctacttactcggatttgcagaatcagttccaagagaccctgaaagcaggtctttccgagaccactaaagagacatttttgaaagccgctgctaatgaaaaaatgaaaggtgtcagcgataattctaagtatactgttaactactttgaacagttgaggctttgtattgttagaggtttccaacgaatcaaaggtgatatcaattatacaatagttatggtggtctcagcactcattcagggtttagttgttggttccttgtattggaatactcctgagaactcgtctggtgtctttggtagagccggtgtgatcttctttgctattcttttctttgttttgatgtcattagctgagattgcaaatattttcaaagatcgccctgtgctggctaaacagataggctactctctttaccatccatcaactgaggttattgccaatgccctaattcagatcccagtgaagttcattgcctctctatttttcagtattgttgtctatttccttgcaaacatgaaaagacaacctgggccgttttttgccttccttctatttgttaatttgggttctcaaactatggctgctttgttcaacctagttgctgccgtgtcccccactttagcagttgctaatgcgtttgacggtttgcttgtgttatcctctgttctttacacatcctatatgattcaacgaccttctatggttccttggtttgagtggttctcgtacatgaacccaatgctgtatgcttttgaatcaatgttaacaaatgagtttcatggttctattattgattgctcagacgttgatttgattcccaacggtcctggttatgaagattaccctgatcaataccggtcttgtgccattaccggtgcaaacggaagaacttacgttgatggagatacttatctcgacctatcctttgagtactcctactctcatatctggagaaatatgggaatccttttcttgttttatgtcgcctttttggttattcactcagtcatgtcagagataatgaacatgtccaccagtaccgccgatcgtttaattttcctcaaggccaatgatctacccgttgaggttgctgcagcactgaatggttccgctagtagtaacgatgaggagactggtcaagatacttctctgaacgaaaaatatgaactggagcgtgacaaatctgaagtaaaagtcagcgataaattgttgggttctgatgaagtattcacttggaaagatgtaaactatgtcatcccgtaccaaggctctgaaagaactttgttagaccacgttcaggggtatgttaaacctggtacgttaactgcgctgatgggtgaatctggtgctggtaagaccactttgctgaacgtgttgtctcaaagaatagatgtgggtgtagttactggtgatatgcttgtcaatggtaatccagtttctgcgtctttcaagagaagaactggttacgtccagcaacaagatctgcacatctcagagttgactgtaagagaatcattaatctttgctgctaaacttagaagaccactgtcagtacctgttgcagagaaaattcaatatgttgaccaagtgattgaaatcctgcagatgaccaagtataaagatgctgtcgccggtgaactaggtgccggtctgaacgttgagcagaggaaaaaattatcaattgccacagaattagtatctaaacccgatttgttgttgtttttggatgagcctacttctggattggattctcagtcttcctgggctattgtcaagttgttgagacagcttgctgatgctggtcaggctattctttgtactattcaccagccatctgcaactctctttgagcaattcgaccgattactccttttgagaaaaggaggacaaaccgtttacttcggagatattggtgagaattcatccgtaataaccggctacttcgaaagaaatggtgcaagaaagtgttctcctgctgaaaatccggccgagtacatattagaggtgatcggtgcgggagccactgcttctatcactgaaaattggtttgatgtttggattaagagtccagaatcccaagaagtatctcaggaaatctcaaccttagtaacaagagctgggaacagcacatcatcagtcgatgatgctgcgcacttgggaacatttgcaacaccatggcactatcaatatcagttagttctacagagaacagctcaacaatttttcagggatatggaatactttatggccaagttcatgttattgctttctggaggtttattgattggattctctttttgggacgttaaacatactattgttggaatgcaaaatgcgatgtttgctgtcttctctgctatgattctttccgctcccctgtctaatcaaattcaatcgaaagccattgcatccagagagttatacgaagctcgtgaatcaaaatctaatactttccattggtcagctttgcttttgtcacagttcttggtggagattccatactctgttgtgttctctaccatattttacatttgttggtatttccctgttcaattggataacgctcctgaaagagccggagtatggtggttgcattactgtatcttcttccagttgtattatatttcatttgccctggccacagtctattttgctccagaccttccgacagcaaatgttattctatctttcctgtttaactttatttttgcgttctgtggtgttgttcaaccagttgacatgatgccaggcttttggacattcatgaacaaggtttctccctacacttactttgttcaatccttcttaggtaacgttttacatggaagagaagtccattgtgctgctaacgaaatgacatacattcaaccccccagtgagcagtcatgtggggaataccttacaccattcatcgaggaacacacaggttatgtggcaaacccaggtgcatttgaagattgtggtttctgtaaatttgcagtcggtgaccaatatttgagcacggttggaattaagtacagctatggttggagaaatgttggattctactgggtatacattgttttcaacctgagtgcaatgcttttcttgtattacatgtttaaagtcagaaagcagtcaatttttgctcctattattggactttttgggagaaagcaaaaggattaatttgttgcaagtatctatctgtttataatcaatatggttttaatttatctaaaaaatactttgacaaatccttctttgttgacgaggtataagtactgttgctcgtttgtttctaagtttttcgcctcatcttcgaacgatattgatcccttcgaaactgttattgtgcctgttacgtcgtctgctcgtcccgtctccaagggtcgtatcgatattatcccctggcttctatgatacaatttggtgagaaactcagtttgtctatgtgtaatggttgaagagtctgtttcattcaggtctatcagatttgcatcagcaaaagtcgaaacaagtacgttcgccaatgagttgatataagatatttggctcatgaattcgttgatagaacattgatttgtcaaaaagtatagttctggatgatccagaattaatgtgcagggtaaggctgagctcttcaaagcagcaattacaggcttgaataacttgtccacaggagcctctgccgttgaaagatcgaaaaaactaaggttttcgtcaccttgaaatgaagattccaccccaagatattttacccacgtcttgttgtagaagcttatcccatgcaagaagctgacaatgacaactctgcttctgggatttttgagtgaaaagttggaagttttgaaggaatttgcatccttattgatattacatgtgccaaaaattagattctccacaaagcaagtggtcagccatgatgacgacgttccttgagtgtccgtgtaggtaaaacatgatctaaaagcttgtgagtcgatgagagcttgcggtatgacctcccctgacctgaaaagagagaaatcttgagcttggtgggacatgatggatttggcccttgattaggttggattctcgttattgtcctaaatttgatatttcctcgaactgtggcacgtgattagttggaaaaaaaaatcatcaataatccagaaaatctttcccttcactagaatacctatagttaacatgtccttgactttgcctgcattgccatctagcgtttcaactgctgccagtttaggtaaatacactgccgctgttagaaaaccaattgagccagttggccgtcacttcttggcactttatttgtggggacacacatggtcagaattcgaaaagattcaggctgaaactgatgtcaagaaagctgaagacgtcaacgaagatgccgaatttgacattgagcaaagcgaagagcttattgagcacgacccaagagactggaagtctgctgatttgtacgccgttttgggtctgaacaactaccgttacaaagccacagaagaccagattagaagagcctacagagtccaggttttgaaacatcatcctgataagatgggtgaaaagggaggcctggataaggatggatttttcaagatcatccagaaagctcacgaaactttgatggaccctgttaagaggcaacaatttgattctgttgatgaagaggccaacattgaaccacctgcaccaaagagcaagtacgactttttcgaagcttggggtccacttttcgcttctgagggacgtttttctaagaagcagcccgttcctgaactaggaaatgctgatactccaaaggaagaggttgatgctttttacaagtttttctccaacttagactcatggagaaccttcgaatttttggatgaggacgttccagatgatacttccaatagataccacaagagaatgattgagaagaagaataaagctgctagacagaagaggaagacagaggataacaagcgtctttctgaattggttagaagagctgctaatgaggatccccgtcttaaggccttcagagataaagagaaggaagagaagaacaagaaaaagcaggagagggaggctgaagctgctaaggccgctgaagaagttaaagccaagagggaggctgttgaaagggctagagctgaagccgccaaggctagagccaagtccaaggccaaaccttcctatcaaccaatccaaactcaaagcaaaggtaaaggtaagggtaaaggtaaaggtaaaggaaagaagagtactgtcagcaaagaacagcgaactgaatccaaaatcaacattagaaactctgttaaagatgctaactactttggtactgagctgcaatctgagattgaccatgatattaatgtcttccttgataactttgaggatgaaaagtctgtggaagtttctaatgccatcgctggtgccactgctgatgctgtaaaggagatcttcgatgctgctgccaaagagtacattgagcaaggtttcattacagctgacgacttgaagttctttgcaaaataaatagataggcaacattatttttcttcaccagaatcgataccatgattttttgctgtctttgcgttgtaaatccaaatgctcgtctataagttgttgtatatccctttcgagtttcgaaaccagtatttcattttcttggataattttgtctctttccaagtcccaccacaagtactgtaggccgaagtagactagtgatgccaataggaaagtattcaacagaggccttgaaaaatgtgatattctgactttggaatcttccttctgttgctccttttttttctccaaggatttcagttcctgttgtttgatctggtcgtttatctggtcgattcttgattgaataatgtgtcgttgggaaggatattgtagcggatcttgagggacatattgagtagtagattttggtaagtgtgtgctctgttttcgtatctgtctccagaccagacttgatttacaaatttgcggcctcatggtgaaatttgcttgtagggaagctgaccactttcagagactaacgattgaaagaccttggatggactccacgtagatattccatgtgatttaggtttcgcggttattatatattggtgatacgtcaacaaccaagcctaagtatatatatacagtgtacactattatcaatcaccactgttcttttgctcctcatttgacgttcaaaacctcctgtagattgaacctcttgcatttgtcatatatctttccgtccaacactgacatgctgatattatttttgaaacactcaaccaatatcagtacatcgtaatcttttaggtcaaccttgtggcctccctcgttaccaacgcaactggccacggttttgatgacatccagcttctctagcacgctgaagtttctcctattgacttgaatggcaaatttgagtggtttctgaacctctttgtcttgatgaaaatggggttttaacaatcgttgtgccaacttggttaactctggtaaagtgcctgagcatgaaccatcgacgggagacagccttaaagtgaatttggttgcctttcgcctgttatcaaatagttcttggacgagtttggtagcaaactgtgacggaataaggggctttttcatcttgacgaagacaaaacattccgttccaagttcaactccatttatcaggatggtgttgcccttcttagtttcacccatttcttgaagctcttgcctaatagactcttcaatagacactgcagactcatcttttccttcctgctcattcgtttctccctctttattttcatcttcatccttctgttgcttatagaagtcctcgccgtagtactcatcaaccttgtcgaggaccaattctgttagctcacttaaacatgctctttctttcccacggacgcatgtcgcaaatatgccatactgtcctggctcgacaatgccattagcaccgggcttgtatctcttctttcggtcttttccttgtccattttgttttctcttcatttgataagagaactgaaaaaaaataacccacgattcaatttactaagaattatattttatgttctatacaagtcaaaggcttaaaattcgatatctttggttgttgatctctcctcttcttcctcgtctatggggatgctccattcctctatttcgaattttttctttccgttcttgaaacagtattcgatctcctttattaccatcaatccagattcactcaagacaggaagcttcaaaacatttagaaatccctgctttatcttagcaggctggttcttgtatattcgctccatcatttgaaccagttctgggggaaaaggtttcaactcgataaccccatcaaatagcatttcgatcatggtgactaatgcgttatgacgaggatacaggtccaaattgacagacgataccagagagatattaggagaattgtgtaataggtgtcttagtgatttgataaagttcaaactttggttgtgctggataagttgtggtgggtacatggcagggttgagaaaactctgcagtactattcgaattagcttcccttgatgctgtgatatgattctttgaatatgcaacataactttagaatagtctggaacatttaggggaacaaatgacatctcgttggccgctggagcaggcaaaaggctgctggtaatgtcaaaggcatgctggtagttgggatacgtttgggaggggtcactaagttcctcagaaggtgagtctttttttaggccgtatctccatgcaatcttcagattgctatcattgatatttccaacggttacttttgactcattggttgcaaccttgttcttcttttgttctttggaggaaccacggtacagtcctggaagctgtctcccccaatgttgatctgaacctatcacaatgacatgcgtgttcaattttcctgcagttctgttgtggactattccttgggctgcatatacttttaaaagcactgaggaaaaatctgttgtaccattctcttcgatgagtaaggaattacccaaaggtagtccctggtgggccaatagacgatccaagtctgccgaacctgtcgataaagtcggttgggatgtgatggtagagggtctgattcccggatgttgagtcagcatgtcattattggaggctctattatgcaatcctggacttggtccagtggggttaacatgaggagtattcctgagcggtgctctagaagggggtgatagggggcctcttgaaggagcccctagaacaggatttcttgaactgttcactcctggtgatggtgcggaaggagcacctcctataacctcttgacgtctccgaaatgacattcagtcgttggtatagggatgcctcactgcaagaggaaaaattatatttgagaagcaagggaaccggaaaaaatgtttagacctcataagctcaaaatccattcgcacctctccctctttactaactccaagtactatggtagacaaaaccacaccagaggacaacaaaactgtcgtcaatcttgatctggacgataaagatagcaagaatgaacatcattccaacgggaatgcacccactcagctgatattcaatggaagagatctggaaggatcaactttagttgacgggcaacatcatcataagattcctccaacgatggaaggaaactcacttacacaggatattgactctcatgtgcaacagctcaaatataatgataatagagtagcgctagatagggcgattaatgctcttgttgatatattgaggcagatggtagaggaaaacaagagtcgaccagttttgtacccaaccacggacaatgatcttaacgtactcaaattgaacattaaaatggaacacagcaccgttgaagattactcacgtttaaacaaagattctttggcacatttgctgagtgagaaggttactaacgtgattcgccatctcttctcgttgaaggatcgtatcgatgatactgcctccaaagttttcgttacaggggatctaaactccggaaaatctacattttgtaatgcattgttacgtcgcaaaattttaccggaagatcaacaaccctgtaccaatgtattctgtgaagttatcgacccaagggataacaacgggttggaggaagtacacgcagtcccaataggagtgacatacaatattagagatgagtcgacttatcaaatcttcccaatatcggagttggaatctttggtgtataaatcatctctctattccattctcaagatctatgttcatgaccaaagaccaatagaacagagtctgctgaagaatggggttgttgatatatcattgattgatgctcctggcttgaacttggactcttaccaaacaactcaagttttttctcgtcaagaggaaattgatttggtagtgtttgtcgtcaatgctgccgatttattcacactttctggtagagagtttattactgccgcagcaaatgaaaagaacctcattttcattgtaatcaacaaattcgattgtattagagataaacaaagatgcaaagagagaattttgaaccaaatttcagaactgtctcctcaaactcacaaagacgcctcagaatttgttcattttgtctcaagtgaagaggttgtaaatgggctaccaggtccaagtgacgatggagatgaaaacaacggtcctgacaatagcggccgtcctgatccagattttgatcacctagaagcctctttgagaaagtttgtgcttgagaaaagagcggtttcgaaattgcttccagcaaagacgtaccttatcaacttattagatgatttggatactgtgttcaagttgaatgagcgattatacaaagaaaacaggaatttacttctaagtcaactcgatgaaattactccgcaatatgaaaaggccatgagtagctcatccaagatcagtggccatattgaccgtctaattgaaacaactgctacggaatgctacaactttacccgtgacgctatcaagaacactattgataacattgaagataccccgttgattgcatttccaggtttgaatgacatgtatcgcttcaccaaggaaacaagaatggcacttgtagagaaagttttggggtctgtggatgcttctgagcgcttcgcccgtcaaaaaacgttagagacgtttgaaatcattagagatgttggtcgtaaagcattggatgatgacaatctgctagcagataagtcccttcgtgatgactacatgtttactagcaagaaacaccatcaactaagaagagtcatcgacgaggagatttccatcaaagatttctttgatccaagctatgagcgatttatgcaggcaattgggctatcaggaactttttcctcggtttctaatacttcgtcaccaagctggtgggtcctatcaggtaagcaagggcaaatctggaaaaactcattatctgcggttgctgtttactcttctacaaagatattccataatggtcttttcatggtgaaaaatttcgtatccataagagatgtatttaactggaggttccttcaaaatgtggtaacacctctatctattggaatggcaatagtatcggtgtcatacttggtttacgacattccaactgcattccaaaggaagtcaattcaaagaatcaaacgtcacttgggatctaccgattacattcacaacaactcaagtagagtatcaaaagaatgtaccaaagttctcaattacgcctccagggaagtaatgaactctttccgtacttcaattgacaccaccgctgctaagaaggataaaataatttcacaattgaaggacagcgaacaaagtgtgcaattttatcatcgtcttttccgatccatccgtactcaaggtgaaattgtcaggggaatcaagattgacaacttttacagcagcgtggactaaattgccagtttatagttctaacatgtaaatagggatgacagagatatatcgaagaagactatggaatgattatgtaatcacgatcttattttcccccccccctgcattctgccacatcagcgacaaaccaaagtaacgaaactctaacctacaacttgatccgcagaaatatccatgtcttatcgccctcagtttcaacagaaccaaggcgggcctccttatcagcatttgggtgcaccttatcagagttattccacgcagcagccttcccctaactcgttgaatgggtttttcaatcaatttgaaaccatatcaaacaagatagaggaaatagtggacaagtacaccaaacccttgaaaccatttatgcctgcaattgcccggttcttcatagttgcaacattttatgaggactctcttcgtcttgttgggcaatggacggagcaggtgtactacttacatgtctacagaagatactggggttggtttgtcaagttgttcctgacaaccaatatcatcgtcatgttggtagggtctactcttctgattgctcgtaaacggtcagagattgcctcatcttttctggtggccgtcgtttttttccaaggaattgtttatggattgttttttgatttaggatatttcctccgtaacgttagtgtgattggaggacttttgttggcattttcagactccatagtgagggacaagagaaatctttccatgccaggattgcctcttatggagcacaaggataacaagaagtactttctgcttgctggcagaatcatgctaatcctgctttttgcaacatttgcgttcaattccaattggtctctgggaagaatattagttgttttggtaggctttattacaagtatatctattgtggtgggttacaagacaaagtttgcagcaattgtactcaccctgatgctaatgacttacaatgttatagttaaccactactggagttttggctacaaagatagcagaagagattttctgaaatatgaattctttcagaccttgagtattgttggaggattactgatcattgtgagtacaggagctggagagttgagttttgatgaaaagaaaaagatctattgagcattgttagtcagtagataggtatatagtaggtagagaatatcttctcgaattgacacctctggctaaaaccatctgatctcatctcttctgttcgcttacacattagcaacttatccttccacatgactaacaagcccagagggatcttacggaacgctccacaggataccaattatgacgagaatgctaaggttgatgaagaatttgacaggaagaaagtcctggagaacaccaatataaacgcaaaactgtttaaagacgcagcagatgcagctcaaacgaagggtgacaagatcagacaaaagctgaaggaaaagaaacaacaactagaagaagaacatttgaagtggaatgaagctaacctttatatgaacgagcaagagaaatgtgccaccatgaaaattgatgagccgaaaactccctatgaaggtggtgtggatcccaccggagagtattaccaggacgatgaagaggaattggataacttcgcacttggagaaccagagtttactgtacctaaggaggaacaagagccttttgaaccatcggaaccatcggaaccatcgtcagaggatagtgaaacagagcatgcacctaaagaaacagctcaacagaaacacaagaggttcgaagagatgaggaaacaacactatcatctgaagggctcagttctaggaaaaccgttatcagtcagtgatgaagaggaagatgaaaccgaagagtcgaaataatgcaccaagaaaataaaaaaagagtatgcacctagtaaataatgtgtgatcaatatcaaacaattccctcctatccatttatcgtaattaccttatatgctcttctctaaagggaaggtatcatgtccgtattataaaagtatacggcaccgtttgatgctcatatacgccctctttctcatgatttcccctccaccgaagaaactctctgtaagattcaaaaaattcaccattgttaacaaaagtgtcatcgacgcaggaccagttaccagacttatcccacgtcaacctaccattgagactttggcatttgacacattcgttacgagtgggaacgccttttcccgtcagcttgactccactattcataggaaatagtagcgtcaaaacccaatcaggcaaccatcgccctatgtaataatggttcagatggacgtactcgtaatgatgctctgtatctagattggatggcttcctagggaactgtgaatagaatgtgtttgaacgttcgggcacatccccattgattctccagacgtcgtagaaagtttcactatctttagaggcgtaaatcttaaaaagatttttggaagaaatcttgatgtcatcaaacactttcttcacatcattgaattggtataacaaaggactcgttctcagagtttccttgtcatcagattgtattgaatcttgataaaacatgactagggagaaatgtcatctccaactccgatgtcggggatttttggtcgtgtggtgtgtggatctaagggaccacccctgacgttgcctatttgggcaccagtacaacgttggttcatgtcgtgaattggtgtgatctccgatatgctgattaaggaccagattgaggtagggcattgtgtctgaaaatgtgctattggttgatgaaaaagtgtctgaatactggcattgccctctgtatgcgaacagtgtcatgaagtctaccagtcaatgcataaattataaacgtgggaacttttgaccaatgatatcaattccgactagctttagacatcaaaaacgtcatcctctctggcatcaaagaattctgtaaatgtgaaaaccgttccgtatatgagaattccgccggatagcgttagtatcatggcgggaaattgaagaatatgtgaatgaaataaaagaatcgggagagctactccagaaacgaataaaaaagcactcaggaatttgccaaaatctaaagcgtacgccgtagattcgttcagaaaatcatcaaaattgacattcaactggttgctgattgcaattggaagatgggcaaaagcaaagactagtgcaattgccactggagaccagttcccatatatcgctcctgctagaacaattaaaaggaatccagcagccaagactgtggccaaactaatgattttagtcaacggattaatcttcatttcttgtatgagtggaattaggacttgttgtcaaaacttgaatctcaagagctaacggaaagaaattaactgccagctgtaggctggtgacttcgcggaatcctgcggatgcctttagctctccttctagatacctcccgtctacctcacctcccgccccgcgacttgtgaattaattcaaaagaatcgccactcaacatctctctcatcatagaaccacacacttaatggtaagtaggatagccaattaagcaatgagacaccctactgactttgaattagtttcgaaataattacgacaacgattctgtgacgtactccccaacgggaagactttttcaggtggagtacgctctggaggccatcaagcagggatctgctactgtaggtctagtttcgaagactcatgtagttttagttgcattgaagaggaatgccgaagaattgggttcctaccagaagaaaattattgaaatcgatgatcacatgggtatagcattagccggtttagctcctgatgccagagtgttgtccaattatctgagacagcaggctatgaattccaagatggttttcaacaggccgttatctattacaaaagctgcattttccatagcggacaaagctcaagagaacacacaacagtacggtggaaggccatacggagtaggtcttttggttggaggtgttgatgagacaggacctcatctgtttgagttccaaccttcaggatctgttcttgagtatcacggagctgctcttggagctagatcacaagcgggtagaacgctgttggaaagatctttggaggagatcaaaactgcttcacgtcaagaattaatcaagttgggcttgcttgccctgagagacacgttagctcaagataaggagcttactgctgctaacacaagtgtcagcgtcgttggaatagatgaaaaatttactctttacgatgatgaagatgtccaacagtggctagaccttctagattccactgccaattccagaaatagagatactcacgacgctccagaagatgacaatgacaacacgactgctccagatgcaggcgtcgatacggaaggagatgttcctgtacaggatgctgattagaaaattgaacatgtctattaattactacttctctactgcctcatatcaaaacttgcaaaccttcatactccacttcctcgcaattttcttgtggttgatcattctcatgtaccagcacagcaaaatcaacagtctcattgagcacaatcattggagcgtgccacaccccagctccatatgtaacagcctggtttcccttgcaaatgaatgctgttaacgtcgacaaatcgggcagtttttgatcagtagtttcatcattcaacgcacaaatcaccatataagtgtctttttccttgctaatacccataggaaggaaagtttgagtagtatacgggtgtctttccaaaacttttccagtgtaaacccgatttccttgatcggatttcgtaagtgtattggggacggtacatctgaagatattccaatttatggtcgctggatttccacttggacaggaggagtaattgttgacaatctgagagacctggaagagcttaatagcagttccttggttggcagcacttttatgtgggtgatctaattgctgatcagtacaaataatggacccaaaaggtttaaacgaagctggagtcaatggctgtgtcggtatggttgtcttggctgatgacttatgtatgtataccatgatttgattgcagtaatcttgaatttggttgcaggtgcagagactggtggattttatgttaggtttttttcctccaatctcgatgtagtgattggcctacgacttttcaaagatgtctaatgataaggcttactatgtctcgaaagatcctccgctgatgtactcacaaataaacgaagacttgtgggtaacgttgacaagctccgagaggaagaaactactccagagtttcttatcaatcgtctagagcattccagtccggtgcttctgaaatgatgctgaaaagacgatagcctcaccgaatcgcagaacaataggagttttctcgattttctcatttcgcttccagtatcgcaatcttctctgattgcgctgaaagaaactaagcttctagcatataatccttaacaatgccttctggaacatcacactgggaacaagttgaattttctttcaagaagcatcagaagggatgtcatctggtgacttctgaagtgctttcaaagattcctcaattgaaagattacacaattggtacgctgacagtatttatcaaacacacttcagcagctttaacccttaacgaaaactgtgacccctcagtgagagtagatatgcacaatacgttggcacgtattgctcccgaagatgagaggttgtatacgcacaatgatgaaggaccagatgacatgccaggacatgtgaaatcctctctccttggtgcctctgtaacgattccaatcaccaatggacgactaaacacaggaacctggcaaggcatctggctatgtgaattcagagatgaagtttatagaggaagaacagcagtggccacaattaacgggctgaaggctaaatagaaaagggagattatttattcgaaaagcttaaatattattaatttctattaacgataatcagcttagatcttataaatatttgtaatatagagtttaacaactgatatgctgttgcaaataggcaacgtggccgagtggttaaggcgaaagattagaaatcttttgggctctgcccgcgcaggttcgagtcctgccgttgtcgttatctttttttgtttccttttcgactaaattttactatttccccagaaaacagcctggacgacaaacaattacattaccagcattttctaccctcgggtacttaaacctcaattattcatcgtacccttaacaaattagtgtttgtgccattactagtagcactcacatcttcacggtttagcgatcatcttctgtttacctttttgccggtcctaatcacagccacatagggcctcccccaatgaatcttcccatagaaatatggtcattaatcagtgaccatctagacggaaatgatttaatcaaaacgagaatgacaaatcattgcatgtggcaaaagctacaggataatgaactgtggagacctaaattggaagacttttactctttaaataaagactgtgagtatcaacagtaccaagataaagggcagttgtttcaactgtatgctaagaaaagatcgatcaagagtcaattaaaaggctggcttttgaatctctgtaatggaaccggccagttaaaggactttcagtattggaggaatgatttggtccccatttttcttcaattacagaatgaatttcaagacattgaacgtttgactgaacgatttttcatatctaattgtcttcaagttcatagatactccattttctaccaactgctgttgagcgtgtgtcagaaaaaaaaagacttattgttggaagacgttttcatcgcattccatgcccttcatgatagtttttatgacaatttcaagaggcgaaatcaagtttacaaaagattgacaaagagccaaatagttgaaaaaaacttcttgtcgaatactcaagttgttcttaccattttacaagctcttcgacgttccaatcttacacttcttcatccattggaactgtcagcaatggcgcagaaagcatgtttgcaattaggaatcaagacaaccatacacaaaatgttcttagaggtctctgatccaacctataaatctggttccagctttctgtatatatcaaaagaccaagtgttatcttacagtcgggagaatatgttcagacttctggcgagaagaagcataaactttacggatctagaggtgtcaattcctcagttcattgagcgactatgctatcatcttaatttgagtccgtttgttgtgtcattgtaccggattttctgtcagaatgactgttcttacttcgagttccagactcacaagacaatagtcggtgactttttaagaaaacagttccagcttcatttgcctgtgctccagaatttatttcccaattttcaagattttggcgttgttgaattggacatatcgtcgttacaaaaagactacgtgacttgcctctactcgtacctctatcttaccaaccagcatagctctacgcagtttcctattggcagcgttatcaaaacaagaaacaatgagtctgcggcaatcataggaaacaaggttcaaagagattttgtaggtacgaacaaagtggttatctactatcactgcctgacaaacaagaatgcgccagtgatatgccaagaaggatccatcatcaggcagaaagttgaggatgtcaacgagttattccccaatttagacgagctaggatgttttttcaaacgctatgacaaatcgagtggaatgtttgtccccaatatctacttggagcggtatttgcatatatctgtgaagtagaaagcattgtgcttgatccaagtttggggtaccctcgaatactcaagttctggatgttacaaactttccatgcacagaagactgctctacagagtaatgtccacgctagaatcacaactgaaatccacagatggatccgtgctggtgaaaacaagtacaggaaagattaaagtacgcaaaggtcagacggaagaagctttcctagaacaaaagcaacagtttttggaaacgggacctcaaattaacgactataactggcttatagaagattatgacaagagactagaaaagttcactcagttggccccagaggaaagaaaaggcaagcacttttttgatcccttgaacaaggttgatacagaaaaaattatacgatgtttgaaccttctgtactatgagaagagatacgatgagtgtctccaaagatgtcatttcctaataggtatcgaagatgccgatattgagaagaacaagaaatttcagcttttcaaaagcgatgtcgcttctatcaaatcggcctgtgaattgaaatcgtcttgaacaatcgtacccattctttatacatagacgtatcattatgatacattaataactgctaattcataatttttcataaaataatccggacttcaacgctgctaacggtacgttttgaaagtattgagtcatcgtcctctttttcaaattcatcaagtactttcacgctaccagtgaacacctcaaccctgtagtttttcaactggaagtaaactcctatgcttaaaactttcggtatgctcttacccatacccttcactataaataccttgttcttggcctgtgtcgcattcaacttttcaacttttttactgatttgcttgatggcactcacatataatgtgctggacttgacaaaaaatgtatttttttcttctgttaccttgtacttcctcatgggaggatgctttataagtgtcccatctattctttctcttttcataatgggtctgagggaatactatagactccacaagtttgaatcctcaatagaaacttctgtgcacacttacgagccgattggaagtcccgcgaaggccttccaagcatttcgtcctcctaactatcgacctgtctgtgatactcttaccttctccaacacgcctcatgtttccccctacccttttagaattaaaggctaataagccgaccacgatgatgctagcctcgcctccatccctcatccctcaacagggtatcgaaaaagcaaaacctaaatccgttaacttacaactcaacaagctgaaatacaagaaagcttgggaattggcatacagtcctgccaaaaacatcccaatgaatctgataatgatgtacttctctcccaactcccttcaaattatttccattatgatgaccatcaatctgttcactacacccctcaaagatatattcaattgcaacgaaatattcgaaaaatcggtagacgtatccgtgattgacacttacgacttgatcatgatgaaattgttctttattgtttgccatttcggaacattgctggttggtatgtggaagctgaacaatatgggaatcattcctacaaaggcagatttcattggatctataaacaatactctagaaacgatataaaattacatctaaccagcggtgctcttcttgaacttgtatccaaaacgagcaaacctgccacttccactgatactggctattgccgaattttgttgcaactcgtttgcctcttctccaatttctggctccctttccagtttatgtattgcagagatggcatcttccggtttaatcctgtcgtattttctcattctgattgattgctctctgaactcatctagagttcccgatttcagcaagttgatcagctgcctcaattctatgaatgttgattgtaacgataccgaggttgggatactgtgctcttctatggatttttcttcatcttcatctgcaggttggttttgattttgcccattgagttcattaatgattgattcgatatacgtgatgtccatgtcgaaattgtagatagcctccttggtgaatagactgcttcttttcagaaaatccaagaaatagctcgataacagatcaaaagtacgcaaaagcaatagagacttgacggttcgaggcaaattggagaaagttgatgtaaacatcatttgtaggaactggccaatatcttttatgaaaatgttgggctctggattttgctcttttgtcctccaattgtagtcgacaaagtccaaaagatcctccacttttgtatctaccatttcaaacagtttgtcctctgccaatttcctcgttgctagaaaattatcataggcagtcaaatgaatggaatctatcgacctggattcagaagaataggatagcaagttctcaatctctctcacacttgttgaaaaaaattccaagttgatcaaattctgggcgatcacttctttaatcgttgactcaattttatgacgaaggttctttataacgatattattcaaaacagagtcaatcgtctcaattgtgatccgcagaatttctcttccttgataagaataaaagtcatcgatgaattcgttcacttctttgataagattttgaatttgaaggcaggtcattgggtatattgatgagaatggtaactgtttgggaaacctattatttgacggcgtgtgtctgtaccaggatatgatcgagattgacttataagactccatatctttaacaaccagaggcatagagtcatcagcattcatgttcttgactaactcaatcttaaaattgttggtgatgatcttcatgtatctctgcaagatgcaaagtagtatgctataaaggttttcgatcggatagtcacattgttctaggatctgaatggaacaacaaatgagcttcttgaaaaaaataatgtcatctaaagtggttattttctcatccacatgcttctttaaaattggaaccagacgtttacagatagtaacaaacatctctcttgattcgttagatgacctgagcttgaaatgggtcttaaccccaatgagcctatcacaaaccagcagacctatcaaactgtaaatgaaatccctcagttgatttctatcaagaaacatctcctgggaagggtttgaattatacatcggataaactaatcgatccttttttattagccattcttttttgaactgttctttcaattcgtcaagctcgttgatggtatcataaaccatcatgctgtcataaacgctgtctaaagtaatattattcaacgagaaggggtcaaaagttttgaatttgtcaggccgaaccgataactcaatgggggagttaatgctgtattgtgcaagtatagggttctgtgatcttgtttccgcccaataactattcaaagcttgcagttgttgaaaacagtcatcgccaattgtatggaaatgtctctccagattacccagccatttcttcacgaaactaaaagaatcttctttgatcattttgtgcaaagtaggtaccgaagagatgatctttttggtaaactcaaacgtttcgatttcgttcaaatgtatattgaccaaatcttgaagatttttcaatgcatgataaaagcttttctttccaatcaaatcaatgatcttattggtgagctctaatatctgtagacaggatttcagtacgaatatcgtttcattgatcttattgtacaactttttgtattttatgctgactttatttttctcattaagcaccttacccgtagattctagatcgtcgtttatctccaaaactttgtatctaaggtcatcagatatcttcttcacttctatgatgcttcccacggccaattttatatctgacgaacctttgaccgagacttcctgcaattgttgctctttatcacaaactgtctcctgtagggtttcgatgaggttatccagtccgttattctttatggctgttcgaatgattggtccaatgttttcaatgtagtcatctgagctcaatgagtggagcaacaacgactctttgctcacctcattggaatgtgtaagcattctctggggataatgtttggttcaatcctttgtttcgttcttatggaacgtcagaagacggaatcgcgcgtttctaacaatgtgggcagggaagattggaatgccaaaccggcaatccaatgcaatgaaaacatttacaattggatgtaattaatgaaaataagcttactgtcactagtgttgttatgaatagagttatcatagttggtcagaaaaagactgccaaaattgcccttttgagaagcttatttgaaggggttactgagagaagtgatggcgatgacaattctgggttaatattgagtaatgttcctctgtccacccgttactattcttgcaatttagatttcatggttgatgagtatgatgactcaaaagaatgggaggattggtgcgaggagatactaagcgtcgaagctctcgagttgcgagaggctatcaatggaattatattcatatttgatttctcttcaaagagtattctccaagatttgacaaaattgtctaaagtctacgatcaaatagagcaagattttttactaagaaataaagattcgatacaatgggagggcatcaaacttgcagttggattttcccgttctcccgtagctcaacaactactggatgaagtgtatgatgccagtcttgaaaagggaattgaactggttgatcttagcatagcatcgcaggagaatgcttacggcgaagctactggcatccgaagagtcaaagaaattttggagacttgcagttggcctgatgtggtgaaacttcgctgaacactttgttggtcaaatactaaaaccagaaatatagtaataaagtcattgagcagctctttactagtccaatcttgtatttggccagaatcttattttcccttcatctacgcgtctttttctcccttcatcgattctttccagcctcttcctatcagcgaacggagataattcaggcatttattttcctttacataaccatgattagaacatttgtaagaaacatatcctacaaaccccaaccacaattggtaagtatcagtactcccttgcagttgtgaagagtgctaacctctagttcattcacgaactcccctccttgaataaagccaaactttccttccatgaaaacccgaataagctggaagttggcataatcaataacgttcagggcaaatcccttgagaacttgaagatcttacccaaagacttcgaagaaaacaaggagtttctctccaagttacaagagatcattaaaaataatattcaaaatgattttgctttcatagttgaagctggtgcctatccttcgtcccacttaccaatttacgatttcaggctccctccttcccatggaaggataccagaagtggagaatgttttcggatacgtcaaagtttcagacgatggtgttatagaaccgggatcatatcaatcaaataatatgtacagattattgtcaggaactgatggtcccattaatcttagtgattacctactagaacaaatacagaatagctgaactatttcactagaaatcaaaactcatctttgtctcccaatatccgcgtatggttgtctaatttgttcaatttttccagggccttcaatcgtatttcattaaatggttctttaggattgacttggttgttggaaactgatgctatggccaacctattgaacaactctgagactttataattctcaatagggtccaacagacaactgtaattagaatccattgggtctttgaatgcgattaaagttaaaacgtttttaatccttcgatcaaattggggaatcgtatcaaatttggaaaataattctttggaataggctattataccatttacattgtctttctttaccagatttatcaattttaacaacatcagattgaacgatagactcactgatgaaactagctgcgggaagtgttgcttaatattggcgattgcctcgtcaatttcaccactttcaatgagagactttatcttgcctctagcaccaatcttggggtatgccgtgttactctgttcaaactccagactagtatcttccctcaaatcatctacgcaatcctgccatccattcctctcgaaatgactgtggatcaatttattcaagcaatacgagggatctttagacaaaactgctgggattttaagttcttgcagatcgcaattcagagcattgaagtcgagcgtatttgagcttgtcatgtatttcaagcaggacctgtagaaatcttggacgtagttatcaatgtcaaacagaaaatttccagtgaatccaaagttagttcgtatctggttacctacacccattccgacaattggataatgtgccctagttgatgatatgccgtaaaatgcatcacccaagaaaacgccattttttgtgtagaagatggtttccgtgtaatagttgattccacaacccatggtgtcgtttagaccaaatgtcgttccatacttcgtgtgaatcgagttagataagttcaatatttgaccttctttgccgttgtaaccgtaggttccgttctcaaacccaggagcgttactgatgttggctgagctagaatcctctccgtattgaagatatccaagtgaaatatcagcctctcttagacccaccagaatctcgatttcgtaataataaatgccacagtctacaggaacagacatatcggctcttgtagctgatctcccattattacttgtagctgaatgagcccttgggttctcaattggatcaaaattggtagacagattaagcccattctcactctccgtgaacgtactcgtgccaggtatgttccaggttgtgggtaacattgctacagagtctttttgtacaatagttcttcataaaccattttctccattggtgaatcaatttcatttattagttcttcatcgtcatttgcgttactagttccgtttgcggagcttgagtctgtgttacttaaaggagggtttccggcaacctgttgcctctcttggaataaatttactagatgtgacgtataatcttcattctgcatgagctgactggggttgttccccaggatgccaaacttggccaagttttgcgtgaactgctgagttctttcaattccattgtcggattcagtgattgaggttgacttttgaagcagctcttttcctttcttaagctttctaaggtaagaaggaacacaaaatctcttggattccctgtcgttccccaaagacatacttattgaaagtctaaaggacgtgaaaaagcgaaagcgaagtcagcaaatgctacataagcgatgaatgtagggaggcggctagacaagtgtgaaaaaaatgcctccgatgccgggagtcgaacccgggtctgcccggtgaaagcggaccgtgctagccgttacactacatcggaaatttccaaaaagattctatcgttgatcggtaaaccgaatagttttgatctatctggtgctcaaaggaaccaagctgagatgagtttctagctaaaagtatcactgtacatttaattactctacatgacattaatgataggtatgtgctcggctcataacctaacttccaagatatcttgaccattcatttacattcataatagtgttatggaattggaaactgcctgccgtcaattgactggttgacaacggtgagccacatcaaaaggtaacaccatacaatgctaatacaatttacgtatttatagaaattagaacaacattcgttcggaggaagtttcaacttctagaaaccttcagactttttccattttgggacctcgacaatgagtacaccgaaatttggatattgattcacagatcaaacagatcaatcacactagagttatcaaagtataaataatgctggtttctgcgtatctttgtgcttctgtccccaacttaaaccatctcactagacaacgccaaccctggccttaactatgcagccctctaccacacctgtcacagctcaaaagaaaaatgacgacaatgctgacaactcccaccaagtctaccacaatggcaacaaatatttggctctttatgggtgcgttatcgtctaaacatcgcctaaacaactctctctaaacattgatcttgtctattagttctttctagtttaatttgatagcactttgagaatcttgtcccgtaatcatctttataccctagtcgccatgctacattctgtcgtggcatcgttggctcctcctacttgctttcctgcttacaactctggtcttatcttgctctaagatcgtagagagatccaatctgggagatatcaaggtttatttcatcctaggaagattcttactcgctttagtccaaaaccgtgtaattggatgcaggccaagtacaactatcctcggttatcgttgaaactttgcaaagtgtcaaaggtttcacaacttgcaaacccgcaaagtgttatctcaaaccagatcaatctaacggacggagaacatctgtcttcgcgaaaaagtgacattcgaaagtactccatctacctgaacttctaaatttagctagtgaagtctgtcagtttgataccagggacacccaagacttgtagtctaccgctaataaccgaaaggtaaaagtcccacagataaaacacaagattcctctcctttaagattttagtgcaagggaaaatttctaacatcaaagactggactttgtccatggatattttacctctaaacgaatgactgacaagcatcgcaagaacaactcttttgagtctggaggagccatttcttcctcgagctccttaaattcaaggggtagctcgacaacacggcacaacgcaggaaatcaagatattccacacgtgagtatagacgatacagattctggacgagagagccgaagccctagaagatttcagaaacaaatcagcccgttcaggtctcctagattgggttttctgaacaatttgcattccccaaaactgaagactaagtttgaacctgcatatcacgaactagaagaccaagacgatggtaacgacaatgacgtgtcaaggacaatgcccactctacgcatagacactgagtacagtgagacaggatccaacccctttttggttgcagatgaacagccaaaatctccgtcgggcagttttttgcattcgccaattcttgaaaacgctcaatcatctgatgttttaaatacaggtcttgaattggctttgggtgaaaggttaggtaaaggtgcctggctgcccactgctgaaaatgcagatgaaactcaagatcaagacttcaccaattatcaagaacattcgatcccggatgatggcagccaagcccaaaaatacgaccagagctcctcactttctccatatgaaaacatagaaatggcgtcactgaatagtaaactatcaaacatagagactagggttgaatctaattcatcaaagccttcaagtccaaaattagacacttcgccgaaaaaggttacttcagcagttcggagactttccttgagagttagtgggaaggacgatttggaggagtcccaaaacatgagaacgtctggtgatatgcctcaaatttatttaagtgatacatctgattcgaatgattatttacagccggcagtatcaaaatcagattttttaagtgtacatcctgaatccacaagaggttcctttcttccaacagatggcaagcaggatggcctgtcttcgattggctctgctaaagaagaggttcaaaaacacgaggatgaacacgaagagatctgcttatttggatccactttgcgattgtttgacaacgacagcagagttagacaaaggtgtgcaaaaatagtgatgcacaaatattttgatcccgtggttgttttcttgattttcttagtgactgttcttttatcctatcaactatggattccagaagttagaggctatcatcatgcagaagagtatactagtgttgactgggtcttggtgtttatatatgtcctgttcacaatagaaacagttctcaagataataacgttcggcctcgtcgatgactcacaaatgtacgaggctttgaatatcaccatgaaaactaaccagttttggttattttgggacagatgggattggaaaaaactgcaatttaaaagccagacatcctcttatcgaaagactatgagcgaaccttcagaaaagttttcacatagttccacgaagctgaacagagcttatttaagagtcagttggaatcgcatagattttgttagtgtgtttgcattctggatatccctgtttctttcgatcaatcattatgaccttcgcaacggcatattcattttcagatcattaatgtgtttgaaaattttgaggcttgtcaatctgactcatggcaccttcaccatcctaaaggcattaaaagaggccataccagaattaatagatgtcattttattcttagtgtgcttttggtctttttttgcaattttaggcgttcaatgttttaaagcatcatttaggcggcaatgtgtttggaccaaccctgctgatcccaccgatactttcgtaaatgaaatgcaattttgtgggagttatttggataatggaagaacaatgccctatatttactcaaatggagaaagttcaggaattgcaaaaggttatcgttgccctcaaaattcggtatgcgtctccgatgtcaatccctatggaggtgtactaagttttgataatattgcgcactcttttgaaatagtgtttgtcataatgagtgctaatactttcacagacttgatgtactacgttatagacagtgagaatcttgctgcatcattattcttcattgtcactctgtttacacttaccgtttggttagtcaacttgataattgctgtcattgtgcactcgtttatgaggatcaaggataatatcaaagctcaaaataaaagtcgaaatgccgatagattactcatttctaaaacttgcaagaagcagcacgaaacctactcgaagacaaaacgtattctctactacagcaagtttgaaccacttttttgtttgttgattgtttgtaacattgcaatcagggctaaatttgacaatgcaagcattgtttataggtttgattgtgcagtgactatcgtgttgctacttgaaattattgccagattttgcatctttttacctaagtggaggattttcttctactcctatgccaacgtgatcgatctactgctggcagtgatcacagctcttataattattcctccaattaggactaacctaaacattgcttatgattggctctcgtttttctttctctttagaatttatcgtgtggtcatgatgatcagttatatcaaaatgacatggtaccgcatcatcgttaatttgcaatcaattattgatctttccatattttactttgttctcttgtttttggtttcaataattgtaacaagattgacagaaggaatattgcctgaagaagaaattgaagagaatatgctgacgctctacaaccttcccaattcttttatttcgttatacatcataacaaccacggaagattggacatcaatactttacttagttcagcagtactctccaaacacatcaacagcagtatttgtcgcttgttacttgatattttggtttttcttctctaacatgttgatcttcaatattttcattgctgtcattgcaaagagtctggaagtttcagaaatggacaagcgaaaacttcaaattacatctttttataacaagttgaaaaggcacttgaatgagcaaaagtatacaggtcttctgtcaagcttcaaaaggaaatttactaagaaaagcgattacaaagataaagaagaatttgacgaggcacttttactcttgctgctaaatgggaagcttaatgaatatctaatggtaaatgcagctcaaaagcctgaatccaatagaatatataactacatttcaaagttttctttcgtgcagaagattgagaaatttcttacttcttgctttcagaatccattttacaactttgactcctttcacaacggatacaagaaaagggatgatcttacatttgcagaggcttctcagtttctcatggaccagaaacagcttcttgccaatgaaagaaccaaatacctgaaagagaatcctttttataacacttcattgtatatttttgctcctaacaacaagttaagaatgaaatgtcaaagaatagtccgtcctactaatggaaagaggattgaaggtgtccagccaaatgagaaactgaaagatacattcctttttgtcagctttctcgttaccattatgatggttgtgtcggtatgtattgtcacaccattatatcgaagggagtatgcattttattcttccgattgggggtggcccacatatctagattgtgcattcacaatttttttcacactagagttcattgtttcagtgattgctgacggcttagcatttacgccacatgcatacctcagatcgccctggaactgtattgatgctgcggttcttatcaccttatggatcaattttatttcagaacttcaacatagtggccctgcatcccgagttgttaatggatttagagcactaagagcttttcgattattaactttgagctcgacggccaaagagacgtttcaaaacactatgatttcaggcttttggaagattttaaatgccgctgtagtgtccatgaccttgttggtaccattctccatctggggtatgtccatattcaagcatcgattaggctattgcaatgacgaggaaagcacaatggccgaatgtatggatgaattcgcaaacgaagtttttaattgggaagttctgagccctcgagtttatgtggaacctcctttgtatcttgacgattttgttacttcttttaagtcactttacgaaatcatttcactggaaggatgggttgaccttttggaagatgttatgaatataacaggactaggacttccaccgagtcattttgctgatcccttcaatggtctgtttgttgtattgtttaacttttgcagtacagttttcattctgaccttgtttgtgtcagtcattatcagcaactattccaagaatacaggaaccgcttacttaacggaagaacaaaaatcatggtatgagatagaaaaagttctaggaacagtgaaaccttccaagaggcgggatgcgtcaagatttgggccggtgacaaggtggtcttacagattagtagttgaaagaaacgtttactggaaggcgttcttaaacacctgcctttttgttcacaccatcgctcttttttgtgaaatttatccaagccctgcaatgctgaatgattttagatatgctgcttatttgatatgttctattgcgttcactattaacgttatactaacgatggttgctatcgggcccaaagactttttcaccagcagatggaacctattcaagactgttgtcgttatcggggccttactcacttcagcaattgcatacgatctccccagaaatacggtcttcgcaaacataaataaattgttcttgatctcccttttgttttttgtgattccaagaagtgatagactcaaccagttattgaagtttgctagcgcaagtttgccggctcttttatccttagcctatacgtggggtgttctgttcttggtttatgccattgctatgaaccaaatatttggtttgacaaggacgaatgaaaactcgtccaataatgttaacttcagaaccgttccaaaggctttaatcctacttttcaggatgagttttggtgaaggttggaattatgtcatgaatgattttgcagtcgaggctccgttttgtttttattctagcaatgtttacgactccgactgtggaagtaaatcatatgcctacttcttgttcatgacttggaacatattgtcgatgtacatttttgtgaacatgttcatatctttggtggttgatagtttcagttacgtttaccgcagttcgggacctctctcaaatgtcaccagaggagaattgcgattgttcaaacaggcatggctaccgtttgatcaaaggggaactggttacatctcagaggaacggttaatgagtttcctaagaaaaccaaagggagtattttcttaccatatctatgacgaaagatattcagtgacaactttgagtaagagatggtttgtccaacataatgccagcgatccttacgatgtcttcattgattacggtgcaatgtccactgatataactcatttgtcacagatgaggcttaaaacgcaaaacagaattcaaacttacgaaagaatggttgaatatttcaggttgattaataggagaaataatttcaagggaattgacttcaccagcacaattagaaggctggctctggttacactgtttgaagagagttcatgcttaaagcttgaggatttcttgactcactttatgaccaatcaaaagtgtgatttggccatcaaggagaagagagtcattgagacactgaagatggtcatctgccgttggaaattcaaaatgaaagattatgatgctcttcgaagtatggttctggaagatgaactgaatactgcgtttatcaagcaagaatttattccaacagaatccgaaaatccgtttgaggaaactgaatcgaataaacttcaaggggaatatccaaagcctgatatccaagcccagccttaccccaagtttgattatcacaacacttttgacagatacgatccttataattacgcttcatatgggtatagaggagatgagcacggtttttcacaagatattcgtcttcgaaatttaaccaccagcaatgacgaaactactgttaatccctttgtccatacttctgttgaagcagatgaaaatgactccgataagaaaacaaccacgtcggtcaaggaaacagaactagcttctcgtaccagtagttcgtctacttgagaagcagatatagctaaagactaataatatttcattcctaatttaattagttagaactctcatcttcgtattcttcgatggagtctaaaataaagtcggtagtttcctcaaatctttcatcaacaatatttggcagtccatctatgtcagccttcagcactctaccatactttttacgaggtctcttcatttcactggttccctgttctccccaacaaggatgcctagtactagtgaaaactagtgagtttttataaaaccagtcagtgacagattcatctatgctggaaacaatagcacgtaacggagttctatccaggaagttgatagaagctttcactatgctgcggacttctcgatgaccacaaaggtgtatgactccattgtaagcatcaccgaatccaacaagtgcaatttttgtaactggaaagtactgaatgtaattgtcccaaatataaaggagtagctcctgagaagctgtaacgttgttgtatgtttcatcatccttgcctgtcaatgtcaatggaacatttatatctataactccatatttcaagttcacagcccattcaacgaatttagaagaggtgtcgactatcatagacccggagagatccagcagtccagacctcgggtcttgtctggcccatacatcggatggatcgtgtattactattattatggtattggcttggaagatgtcctttgttgacagaacctggttatccagagatggagaagtcaatcctttgcctgaaacaactggcagattaatgaaaccaaacttggacgacaaatactgagcttgggaatttctaacagcatcgcatagtcttggattaactgcgagatcgctgagaactttcttttcagtggctggatttactagtaaagagtaattacccataattgaagggtttgtaaaacatattcctgtgtatgcgggttggagagttttccaatactgagattgaattttgatgacatcatctatgacttcaatagcatgagcacttggtactgtgactttgggttcttcaggtgattcacccaagagcactttggtaacacttaatgcagagtttgctatcgaatccaggttatatccaccttctagaacaacacacacgtttccccgtgcaagggactttagcatgtgggtcatttgactgtaaccagcgggcgatatatgacatcccccaatgatatctccttcagcagcgtcaaacccagaggaaatgattagcaagtcgggtgcgtattccctgcaaacaggcatgacaacttttctaaaggcatagaggtaatcagcgtcgttcatacctccaacaggccaagggatgttgatgtttttccctaaaccttcattttctccacattgatcagctcctccagcttttgtcccagggtagtatttgccctgctcgtaacgatgcagagagatatatagaactctggggtcttcccaaaaagccttttgggtaccgtttccatgatgaacatcccaatcgagaactactatttttctgaccgattcagggtagttcctgagaatgtttttggcagctacggcgacattggaaaaaaggcagaatcctcctggggagtctggctctgcatgatgccctggaggcctgaccacagcgagggcattcttaacccttccttcgacgactgccttacacgcttcaatggctcccccacaagataacttagcacttagcaaagaatcatggttgaagtacaccgaatcccctttttccgtttcctctagaagcctctctctggacatgcttgaagtactctctataaatttcaaatgctcttctgaatgtaccaatagaatttcctccgccgtggcttctctaacagggattttgagcatatagtcaccgatttgatctattccagacagcgttggatctgtgataagcccattttctgctagtatcttataaatacgatatatccttctagggtcttcagggtgtggatcgatgtactcaaagtaggacgtgaaaattttggcatgatacctcatgcgcacatcataacataaaccagtcttgagcgtaatatatctaagtttaggttctaccacggggacaattaccgacccgttaacgatttggttatcgtcccatttacctgagggaggtaatccggaaagatggccctcaccttcttgtttggacaattgcaaggcatcactttcctcctcgagctttcttttaccgttgctttccgtcgcttcttcttttaaaatttccatcacagattgcagcgctgttgttgaaggagtgttgatagaacagatgtgacatctgacagagcacctgaaatttgtcacgtgatataatatataatcataattgaggacattatgaggacattatcgaagtctgatttgattgcagggaggtgaataccaggcaagaaggacacagaggaggaacgagagaaaaaaaaaggagaaaaataagaagtattcaatcttccgtttgacataataatcaaagaatccagaccactcatttagagcgctaactaataggacaatttgcatacgccaatcatcgtaacgacttgacttactctcgttcgctaccccaagtaactaagtacctcacattgtgatatatatttttcatctacttaagaagtcttcacaaacgttggaaagggattttgcaatgtcttccaattgttgttgagcagattcagcgtctttgttgtaaattgcgtctctgactcccgggaaagtactgtagagataattctcgggatgatcaggaatgatgtactgttggccgtaaatgaggttcttgaaccagggtcggcggggaatgccataattgcttcgtagttttttttcaaataaactctgtctgttgttccatgtccacctattgattgctaaaagcgtagattccaaaccaccacttagcccgacgtcattactccatccagtgatccattctgagagttgatcgctcacatgacgaagctggcccaatgaggagtccaggctttgaaagttcagtgtattagcatctcctaacacatctttgtagtatctgttaacgtcttcttttatgcctgcaagttcattagcatatgcaccaaagtcaaacggaatactaggctcattggtcagatgaatcataattctaccgataatcttgactaaagtctcatgatactgcatatctgggtcaacctgcttttccttgaacctttcaaaagagtcaagacaactccccttggggtaaccttcgggcgaacgaaacccaatgtccagtgacgggattgcttcatacgaggtaaaaggaatgtaatttctctttaaaccatccagaggtgagatcttagtcttcagttgtgaaaaagtttcgttggaaattggatcggtcacctgaaatagtgcactctcaatagctgtcttcaaaagaggatgcgattttatatccaactgattaccggtgattgcatcagataaatcaatataacagtaggcctgtctacgaagttctcgagatctcgcctccacccattcagttgaaccagccatattaaagtttgttccgtcgaatgacgcaaaataaatgcttcttaatggtttccagttcagacgtctggacatctcaccaaagatccttatcaaactaagtaaaatggacgtgctagttccagattcgcatgccccaaaacaagatgagtctcgctgggccccgatgacaatagcttcttcgtcttgttctcttccttggatcttgcccaacacgttccagatagatttttgttctttcattattggatgattcacaatgtgaacttgagatttggtacttccaccggtaaatgttgcaatcttttctcccttgatgtttaagttccaactctctggaaccttttctcccacattatctaacgacttaagaagagggattgcgtctgcccatgaaattgggattgtgactatgcgtgaagtacctggagagtcgtcccaatggtactgatggtctgattttgcagtggagaaaccaggtgacagaatatcacccggagcaaaatttgaaactccaacatcctctctttcaatagaaaacatatcgtacccactggatgaatcagggtcacttataaaaataacacctttacagccaaatacttctgcgtattggactttttggaaagctgggacaaccccatttcttattagtaaaacagagtctttcagttcaatgttcttgtccttgagatagttgaagtcacgagataaaccatagttggcatagactaaatttcccctatgctcaccgtacattgagttataattaaaggagataagttgcatatcatcgccaccttcttccttaatacctcgctctttcagtttagctgtgaatttttcctcctctttctcgttatagagctttaatgacacttcattaggatagtttatgaatggcctcacttcgaaaaaatctctgaggtctagtccacaatcagcaatgaacttgtccacgtatctcgccaaagacagccctcctgcagttcctgctgcatggggcattgatgaaatatactccagttgttcttctaactgagctccgctaacctgttcatccaaaaaggcaaacagagcatcgttgcttctgaactcacccgtatatgaaccgtatgcattgtcgtataatccagtgatagtgatgacatacatgagtagggccaccagaaaaacgaaaaatagtctcttgactatcaaaggattccctaccttagccaaataagaatcgaatttcatgctcgctatagagtagtactcgtacactggatccagcactcgggttattggtataaccagcttggagttgagttggtcagccatatctcgtgtaacttctctgagactgcgtcgttcctgttcagactcaggctcttcgatgttgaaacgctctatatcattataatctggaggcaatcttggcggatcttcccctgccagttgttgatatgacattgctgactatagcgttctaaatttgttcaaggttaggccggaggtaaatatgcaatgcacttacgagcactgtggcagaataaaggcgaagcgcgcgcttcctccctctgggcgggacaccctcaactgtcattcaattactggttgaacccttctctaaagtgtacgaactgacatatatttgaaaaccaccacaaaagtaaggtacactgaagagtagcctcagcactacttccacaatgaatattgcaatggtctcggacttcttctacccgcagccaggcggagttgaactccatatgtaccatctatcccaaaaattgatagatagaggccattctgtggtggtgattacacatagttatggtggacgcactggagtaagagttcttacaaacggactgaaagtgtattatataccctttgcagtggtaatgatgcaatgtacacttcctgcagtattctctgcattccccatacttaggaacatatttatcagagagaacattgagattgtacatggccatggatccctaagtttcctctgtcttgaggccatcatgcatgcgaaaacaatgggcctcaaaaccatattcacagaccattcgttgttcgggtttgctactgtttcaagtatagttggaaataaacttttaacattcacattgactgaaattggccatgttatctgtgtttctcacacttgcaaggaaaacacagtgctgagatcgtcattagatccaaacaaagcttcggtcatacccaatgccgttgtagctagtgacttcacaccggaacccaattttagagacgaaaataccataaccatagtgataatatccaggctgttcccaaacaaaggagctgatctgttgacagcgataattccaagaatttgtgcataccatgaaaagattaggtttattatagctggtgatggcccgaagttcatcgatttcgaacaaatggttgaaaaatatcagttgcaagacaaagttcaattgattggaagcatcaagcacgaagaagttagaaatgtcatggtcaaaggccatatatatttacacgcatctcttacagaggccttcggcaccgttttggtagaagccgcatcctgtgggctgttcgttgtcactacaaatgttggaggaatccccgaggtcttacctaaccacatgactgcatatgcattgccagaagaagaatcaattgtatctgccctaacatctgccattgacaaaatatcggctgggaaaattcacacctcaggatttcacaatcaagtaaaagaaatgtatgactggagagacgtcgctcagcgaacagagctggtctacatcaatgtgaaaaggactacaaagcccaccaccaccttggaaagaattaaaaaatactacatacacggcttttggggtggtaaattatttgtcttatgtttggtggttgatatttttatactaacagttcttgacttttggtatcccagagataagatagaccgagcagccaagtggccccatggacagaaatatgccaagccccagtcatgagactatcctcagatatatatacattaaagatctttccagatcaatttatccacgcattccctcctgtttttgctttccttgacgaatcctaataggttcagttccagtagaccttgtagaaaccaagataaggaaatttgatcccactcagattcatcaatagatttcaattcaaggacttctaatattgcatctttttccaacctctgtttgaaagcggagtagaagtcgtagatatttatttgtgaagatgcttccctgtacagaccatatagctcactaatcataggtcggatgttcatcttttcagaggtgtaatagctgttttgtaaatgcattctgggatcgagtaggacgctctggacgttatcccggatgtttggagtgaagacactagaaagatacttttcatcacagtctactgtgcatatttcggagaacagtaggctgtcctcccttagcggaaccaatacagattccacggtgtgaagaacttggcttacaatgtgttggtttaaaagaccgagctcaatttttgcatctttggaaagacctttgagagtatctaattctggctggaagtaaacaccatcaggggtgaatttttccagaatactagtgggggctccttggaaagtttccatgaatttggaaaacaattcattcgaagccaaatcgcttatttcggctacaaaatcgaagactttgagcggagtggatgtctcaatgcttgaaagcatggatttcacgaacttggaccgcaaaaagcttggatcggttagcatatcatagtatagttcgaattttgacttcatatgaggaccgtagtccatgaatttcagttgtagaataatcaaaaagtttaggcactgatatagttcatgttgccattgcgagaacttctctaaagactgaggcaccaaggacagcagttcttcatcattattaagtaattgttgaacaatcttttttctttcgaattcggggatcgaactatctttcatggtactttcaataaactgcttgaaggagggcagcagtcttagaatacgagcatagtcagagtttcgtttaagattcttcactgactttttctcccaaaatattgtcaaaggctgttggaaaaaatgcaacatgtaaccatacttcagaatagatattgtggagttgatgctctgattcgacttgatgtttctacgatgaatagttcgtagaatattaggaccaaaattcaaacttcttcccccaagagatcccgttactttaccggacacattctcaaagagcagcttatttaggatttggtctaccaccaaactcgaattatccaattcatacttgaagccctctatcatagccaagacttgtcggggcaatttttcttgaaatatagttatggaagtggtaatacctacgatgactctgatttttatctttcttgtgtatcgacttagaagcgttagtaacttgatcagggttcctacatcaaataaatccgcctgcgatatatttagcagtagaaatttcctgacatcccagttggatgctaggacatttagatcagtcttgttgtaaattccctcacctgggccttcatcatcggagtccagatctgcaccatcatcaaattcagttgaataatctgaattaagtacaatttttgtaagacatgtcttaagattgtcatttccatataggttcactagttgcatattcttgtcagattccagatagctgtttaacctacgaattgagtcgtcagagatattaggcagaaaaaacgtaggtatctttgctgtgtcaatcacactcgttatttgattttttaacgattgaaatgtcccaccgtttattactttcaatacgttttcaattctatctctttggatgctccattgcttcaggaacagttgatatctcaagttcacattctctagcggctctttgccatttaaaagccgttgaaacgggataggtaatggaatcaaatcttcatcaattgtctcggtaggcggtatgtctattccttctcgttgaaatgattcaagatcacttgcaccgttggattctaaactgtctgtaaaactttccggatgcaaaacataggtggtctatcgcgtcagcaatacaatctgggatcctacaaggaacaaaaaacataccttctgactactcaatggtatcgatttcataggctaggccgatcctttttaagggggacttggtgtgaactagtctctgatttctcaaaggaagcgaaaggatgtacttacataatcaattgtgtttctaagcttttgtctatttggatatgtattcgggtactttcttacaatgccgcacgtttgggatgttcattagaacctaagctgtcttggtactcatgtgggctagcctctctttgagatgtgtcctcaaacatcaattctgcatcggaatccaaggtgaattgactattggcttcttgatcttcttcagtatcaaagtcgtcatcggctgggatgagatcaaactcgtattcatctcttcgatttcttctctgtcttctctctagcttgttcctatttgtgaacagaaaaatgatacagatcaaaaatccaagcccgagaaggaaagctaaatattcagtaatatgagaggagttagaatgcttgtaggagccctcctcattctcaaaatcttcatcaccggttgtagaagtctcttttacatccgtttccgtggctgaagcctctgaaacagaggaagacgaaaaagtggcttctgtagatgaggtgtccactgtcgtggaagtagatgaagatggagggttgactaatatttcgtcatatttcttagttaaagagaatttttcagccttttcagggtcttgactttctccaaagaattttatttgccaggagttaagcaccacagaatttccttctttgttagtgattttcaatatccactctcctaacccgtcttcaccccaatgagctactgacatgaacgtccaatttggaaatccttccttatccttgtccattcttcgatagggagccaattcactgacaacacctgaaggggagatcaactcaacaagaactttacctctttccgccgcctttatatctacagtaaccgtaacatgctcaattttttcaaagttcattagatctttggcctcctgggtcaattcatacttggatgtcagcacaccgttagcttcggaagtattcaagctttcgtgaacctcagtgccataaatccagctttgtggtttgagatacgggaagtctggagatcttgctagattgaccagtgcatatgcatcgatcttgccatatccgtatttatgagaatacatcttaccgatagcagtcttctgccagccaggctcctgttcgttaacaggaacggctgttaaaacagtcagccattgaatatctcgccaagtcaggtccggattagcctgataaaccaaagaataaagaccagccgctaaaggtgcagcagcggatgttcctccatgggtatcagaacatttatcgttgatgtcggttgtgtgtatgtgctcacccgatccagaactgtatgtgacagtcatcacagcagagcaagcctcagcgtatggtggatgaagccctttaatatcaattgccccaactgttatggaataaatgctattggtgtacccgtcaaaattgcagttatcaccagaagatgctccgtttccactggcgaatacatacagcgcacctttaccctttcttccatcctgaactcctttaagcatggcttctttgactaacgagctgggaccttgcattgtgattccattgtctgctggcccccatgaacatgaataaatgtcgttgacatcaagaccgtagattaaggagagagcttcatcctctggtgtgattttatcactaagaatcctgatgccagaaacctttgaatcatatgccacaccaactccacagtatttatttcccttcttagctgcaatctccgctgcacatctggttccgtggtgatcgtctctaagtcttggtttgggtagtctagtgttggcattgaaatcccaagatccttcctcacaaaaagattctttgagatctttactgtccatatctagtccgtcatcaactatggcggtcactacaccttttccagtgataccatcgtaccaaacttgcgacacgttcacgtcgtgtcctgggtaacgaggattaaatagatgccactgtttagcaaataaagggtcatcaatgtcaaaatccttcgctatttgttctcttaattcctctgacttgtccatcacaacaggagctcgtttatgcaaataatgagagggccttagcatgtgaacctcgtccacattgtgggaaatcagttcggagtgaagattggcgttgtctcgcgtcaaaagagtcttcactttaaagttctctaactgaaactcttcgttcttactgtgtgaaaaaacatggtagtcatccaaaccgttgatctgtctttcatacctgaacttatcttggaacgtttctagaaacgttggaagccaggatttatccagcttgagagcaaagatctctctctcggaagtctccaaagcctccgtagacctaagaccaattaagatccagcatgctaagcgaagtgctggcaaatacatccgtgagagtattaagtttcaggtgtaccgaatacaggtaatgtaaatcacttaaggatgagccattcgagcgatgtttgattaggtaatcactaaaacttcatttcaaggtgtgtaagacgtgttattagggttgagaggattatggtgggcaaacataactagttcttgtgtccgaatgactgttaaaagaacactgtggcattgcaactattcaaggagaaaatcattttcccggattggctctagcatcaagttatcgtagactacgtagtcattacataatcttttttatctgccaagcgtgagcgactgatttgtaatcttggtcacttgctagaaaaaaaaaactaaaatatatttcctctgataagacatttactcaagacaaaactgtgtgatttactcggacgctactcttattctcataatgagtgctattttgagagcagatgacttgaatgacttcatcatgcctggtgtcgcttgcataaaacctgttgaaagcggcaagaaaggaagtggggaagacttagagattcagatagattctgaaggaaatgctttggaagtgacgaaagagggccacgagaggaaactggacaaggcacaaatttcactaagtgactgtctagcgtgttctggttgtataacctcagcggaagaggtgttgatagcccaacattctcacaaggaactactcaatgcattggaaactgatggcaatcgcaaagtctttgtggcaagcatatctcatcaaacgagagcatctctagcatctgcgtttgacgtacaaattgaggctatggataaggttttgatttacttactcaagaacgtcatgaagttcaagtatgtcataggcacagaaaccggaaggcgactatcccatatattcacaacgttagaccttcaaaataggtcacctcactcagaaaaacctttgataaacagcacttgtcctggatgggtactatatgcggagaaaactcatccgtttatacttccaagaatatctaccatcaaatctactcaacaaatcacgggtcatttactcaagaacatagtttcaaaagatctagggattgaaaaaagtcaaatataccatttatccgtcatgccttgttttgacaagaagttggaagcggcaagagattctgatgttcctgatgttgattgcgtcattactgcaagggaactagtgcaagtgattgaagaactgaacattgatttacaaactattttaaaagaaagtgtattagacaataccgatatttattctgtatataggagctcaagtcctcccggctggtaccaaccagaacaatcatggcttaataacaaaggatccgcctcaggtggatatgccatgcaatatctactagacgttcagcagagacacgctgattctgaaattataacaatagagggaagaaattcagatatttatgagcatcgattagttttacgagacggccaagtagtagcgtcaagtgcggtagtcaatgggttcagaaatattcaaaacctgataagaaagcttaaaccaaaccataaagccacgggaggaggaattagtgcaagaagaagaagcagaaagctgaaagaagaccagactggggatcaaggccagtcgaatgcggtggtagatccttccaaatgtgactacgttgaaatcatggcgtgtcctggggggtgtatcaatggagggggacagattgcggcccctgctgaccagaattcgaaagactggattaataaagccacaactaagtactataacgttccagacactgaatactctgacatccaactttacgattgggtgaaacaaacagttttatcgtacgacatcgaaatggatagacttatccataccacattcaagcagattgaacgacccacagataccacttccatagccctcggatcgacttggtgaacaacttttcaatccttaattatatttatcaagcacgtgttctcggtttcaaacagagtatgttatcaaacgtaaagctggggtcatgtggtaccttatctcttaaaaagttcgcagtagagtgcgaaaagtcaagatcttagataggggcataacggtcaaaaacggttatgtcaacctaaacatcctcgcagttaggtttcgtaggtacggtttgaatcgtagagtatgaatacaacataatcatccttaagctgagatgtcaaaacactcttaagattttgcattctaactttgtccaaaatgagccgtcgcttttatcgtaaatttgatcgaaaactgaaattacgacgtagctgggcccatactgaaatttcacaatggaacggcaaaacgcaccttggacctgcactgataggaggcagatctagtagaaagcaagtggatccagatttgtttgagaagcttaatgtcattctagaaaacagaaagcaaaaaagatcagtctaaaatgagtgaagaggaaacgtcacaataatgggtttataaatagtagagtcaaccatcttaacctgctattcgaaggcagctgtttacactttcccgatagtgaaagaagcatttttcgctagccccggttactgtgggtcggcaaaaaaagtgtttctcttttcccaaaacaggcagaaaataagacttttccttgacagataagaattttgcatcggtttcaataaggaactgataaatggccgtttactattggtttgataggtaggtatatgcgaatttaagcaattcaggagatatgcatgcaatacgcgcatattatcatgtatgagaccagaaagttagcagaatattgttctaatttgccgaggacgttgcattcagtaagcattcttctagactacctaccttagatagctgaaattcaagctactggattattgctgttatcaattcaggtgtcgttgaattccaatataaaagacaggaatctttctctgtatttttcattgaatcctcaccccgtcaagatccaattcttttgagcaaaaagagtatgaaattcggcaatcttttgagtttcaccactttggtgggtttggcagttgctgtaccagacttttatgataaacgtgaagctgtcagtaccaaagaagctgctttgttgagaagaggggcttcccaatgcaaaaccaatgagaacgttaacattgaagctccaaaacccaacatttgggactctttgtcaaacgatgagcttaatcaggttgtagatttgctgaatgaaacttacaacttgactgaaattatggacgctgatttctactccaactatgtgttgaccattgagacattgagaccaaacaagtctgatgctttggtcttccttgatgaagacggagacatcccagacagaaacgccaaaaccctggtttactttggtgagggagaagaaggctactttcaagagcttaaagtgggaccattaccagtaagtgaaaatactaccatcgagcctctttccttttataacaccaacaacaagtccacacttccattcaagtacggattcggagacagtgttctgaacactgccaaaaatcagttcataaccgacaatcttaataccacggttctgagagacgtgatcgttgatttgattggtgtcacctttgaggaaattacatgctgggccactgatcctcaaatctttgatccagccactgaaaccaccgttgcttacggtacgtgctacatcttaactccaaacgacgcggaggatttggtgccaattggttttttctacaagttcgacatgactggaagagacgtgtctcagtggaagatgttggagttcatctacaataataaagtctatacctctgaggaagagctctacgaagccactcaaaaggacgactttgtaagattgccaaaaattaatgttgatgacctctcttggactgttatccaaagaaatagctcttctcctgtcagacacttggatgacagaagagctcctcaattggttgaaactcaaggccgtagatgggcattcgatgctgacgaggagtatttcacctggatggattggggattctacactgcttggagccgagacaccggtataagtttcttcgatataacctttaaaggtgagagaattatttatgaattgtctttgcaagagctgatagctgagtatggttcagacgatcctaacaaccagaacactttctattctgatatttcgtatggtgtcggaaatagatttagcatggttcctggttacgattgcccaaccactgctgaatacttcaccactgactactacgaaaacaaccaccattataaccgctcgcttagttactgtgtctttgaaaacatggaggactacccattgctgcgtcacactggtggaacttattctactgttactcaaaacccaactttgaacgtaagattcgttgctaccattggaaactacgattacaacttcttgtacaaattcttcttggacggtacacttgaggtctctgttcgtgccgctggttacattcaagctggttactggaacgaccaaaccagtagtgactttggtctcaaagtccacgatgtcctgtcaggttctttccatgatcatatgctgaactataaggtcgacttggacatcgccggtaccaagaatcgtgcaacccaatatgtcatgaagaatgtcgacgttgaatatccatgggccccaggtgttgtctacaacaccaagaaaattgccagagaagtaatagagaaagaggactttaacggtataaactggcccgaaaacggacagggtctactactgattgaatctgctgaggagacaaacagctttggaaatccaagagcttacaacatcatgccaggtggaggagctgttcacagaattgtcaagaattctcgtcttgcccctgaaactgaaaactgggctcgttccaacttattcttgaccaagcaaaaagattctgaattgagatcatctaccgctttgaactccaatgctttgtatgatccacctgtgaactttaatgctttccttgacgatgagagcttggatggtgaagacatcgtcgcttgggtcaatgttggtctgcaccatttgccaaactctaacgacttgccaaataccatttactcgactgctcatgcttccttcatgttgaccccattcaattactttgacagtgagaattcaagagacaccacgcaacaagtttactatgagtatgacgctgataccaaggaatctacttgggagttctatggtaatgactggagctcctgtgaccttgagatccaggaaccaaatttcgacgatttcacctacggggaagagactcgtatcaacaaaaagacaaccaacgcttacgaaatttactaatttagttgattgagcctggtgccattctatcatccatggaactagttttccatttctgactttcttttactgcttatttcattcgtatagccaatagatttcccatattttttccagagtacgtagatggtggattaggtaattgttggcatttctagttgctagtgaacttagctctggattattgtagtaggtgaaaaataccaagggcgatggaaatttcaaaggccgatctggggatgtgtggggtaaagactttggatggaatccaggggcaaagacaagggctagacttcaccatattggtggtaaaagtgaatctactagaagtttgagtcaacgacgatatggagtaaccaagtgaagacgatatctttagttcgttatggccaccttaaaagaagcccactcagtccatgtgagttctgaaacttttaaagacagttaacccaaggttcacaattgtgtgaccttatgtcaactgtactagaaggccaaagattattggacgattgggttatctatttccttgataagcatgtgctccaatcaatacacccacctgtcaggggatacacagtgcggagctccgttttctcccagaaattcggttggagctcttttcttaaacttcgaaagtcccccgacagagaagtgccgttagccaatagtgtccctgcattctggttcctccccactgcagcgtcagctggaaagggctctattctaagctattctaaagcaatccaaaggtgggggtcggatcaatgcgcgatctttcgtcgccagtgtcggggcccggcacgggggccgtaaccggcttttctctaggttgacaccatgggatatcccctgattgggcaaatcccacataagtatggcttgcggcttactaatcgcgtaagtcgcgcattctctttttcctgatccttaatatcaatcctccggcaccatcatcgtagtttgcgagattccataaactttttggccccctaactttttttttgttgccatcctttacttccatctaaaaaaaccgacacagaatctgccaaacaatgaccgatacgaaagccgtagaatttgtgggccacacagccattgtagtctttggagcttcaggggacctggctaagaagaagactttccctgccctcttcggactttaccgtgagggatacctgtccaacaaggtgaagattattggctatgctagatcaaagctggatgacaaggagttcaaggatagaattgtgggctatttcaagacaaagaacaagggcgacgaggacaaagttcaagaattcttaaagttgtgctcatatatttcagctccttatgacaaaccagatgggtatgaaaagttgaatgaaactattaacgaattcgaaaaggaaaacaacgtcgaacagtctcacaggttgttctacttagctttgcccccttctgttttcatacctgttgctacggaggtcaagaagtatgttcatccaggttctaaagggattgctcggattatcgtggaaaaacctttcgggcacgacttgcagtcagcagaagagcttttgaatgctttgaagccgatctggaaagaagaggaattgtttagaatcgaccactatctaggtaaggagatggttaagaatttgttggccttccgttttggaaacgcattcatcaatgcttcttgggacaacagacatatcagctgtatccaaatctcgttcaaggagccttttggaacagaaggtcgtggtggctattttgactcaattggtataataagagacgtcattcagaaccacttgcttcaagtgttaaccctcttaaccatggagagacccgtctctaatgaccctgaggctgttagagatgaaaaggttcgcattctgaagtcaatttctgagctagatttgaacgacgttttggtgggtcaatacggcaaatctgaggatggaaagaagccagcttatgtggatgatgaaactgttaagccaggttctaaatgtgtcacatttgcagccattggcttgcacatcaacacagaaaggtgggaaggtgtcccaatcattttaagagctggtaaggctttgaacgaaggtaaagttgagattagagtgcaatacaaacagtctactggatttctcaatgatattcagcgaaatgaattggtcatccgtgtgcagcctaacgaagccatgtacatgaaactgaactccaaagtcccaggtgtttcccaaaagactactgtcactgagctagacctcacttacaaagaccgttacgaaaacttttacattccagaggcatatgaatcacttatcagagatgctatgaagggagatcactctaattttgtcagagatgacgagttgatacaaagttggaagattttcactcctttactgtatcacttggagggccctgatgcaccggctccagaaatctatccctacggatccagaggtccagcttcattgaccaaattcttgcaagatcatgattacttctttgaatcacgcgacaattaccaatggccagtgacaagacccgatgtgctgcacaagatgtaaattattctatagatttaggacgattacagatatcaatgatagtttagcttgtttcagtattacgtaataaatgactcagaggtatctcaggatctgtggggcaggaagtggcattgcatttgctcgctcctattagcttatcagggaagaggaaagaaaaattcttgcatataaagtgctgggccagcccacatccttagcacgttatcagcttttcacaactctactcctgattttctgatggaaaccccaagctatccactgaaagcaaaaaccaaagatgaaggggaaataattgtaagggatatcattctaactaaccacgaagagacacagggtcattcttcggcggttgaccgtttttcaatcgttgacgaccatggcagtcgaacgagccaaaactcacctgagtctttggatttaatttttgaagttgatgccgaagaggattttccagatggtggttgggatgcgtggctagttgttataggtgctctgtgtggttgcacgccaatactagggctaatcaattcaattggccccattgaatcttacatctcaactcaccagttggaaaaaacatccactacagtaattgcttggatcttttcaatctttaccgctgttggatacatgtctggtatactggttggtgtcttggtggacgagtttggggtcaaactaccaatgctaatgggttctattttccatttgatgggattggtagctactgctgagtgtaagacagtttaccagttcattcttgcttttagtgtttgcactggaatgggaacttcactttgtttaaccagtaacatggctgttattccacattggttcaagaggaacaaagctaaagcaaccggcattgcaaccatcggtggctctctaggaggagttgtttttcctttaatgatgaaaggtctctacgacaaggttggatttcaatggacaatgagaatagtgggtctggtctgttttgctctcaacatgatggcatttttcctcattaaaacacgtctttcagggaagacgggagtattcgatattcctgaatttgacgagaatggccaaaagttcagttttgttagaaaaagctggttacgttttgaacaattctccgtgtatgtcaccaaacttattgatttcaaagcattcaaagaggctaaatatacctgttgtgtcatagcttttgctctcagtgagctgatgttagtgtgctgtatgacatacttgatgtcttacttcattaaaagaggtcattcttctgctactgcttttaatatgattattatagtcaatgctactggtattctggggcgatttgttcccggaattgcggccgatagatatggagtctacaatgtcatgattggcatgctggttacactgggtattgttcagtttgtgttatggttatcactgggacaacatctctggtcattgtatactttttcggtattatttggtttcttctctgcttctgtgctgagcttgagtccagtatgcctgtctgccatatctcccactaaagattttgccaaaaggttctccacggcttttttggtcgttgggtttgtttcattgatgggactccctattggtggtgctatcattgataacgcttccatctcaaactacaacaatttcattgtctacacaggaatcctatgtgctgcctcctctgtcttctgggccctaactaggtacgccattaggaggacctggaaaatcaatataaaagtgtaactaaatatatataaagcgtcacgtgacataatatatatgtatacctatatttttatttctgcacatcgactctcttccctgacgtttacaatgctcaagcagttgtggttgaagtacaaccaactaccgttcaaggtccgaatgtatatcggaatatccactatggcagtagcatattttggtgacaggattagctcccagatcatagagaacaataagctggaggctagagccaaggaagaacttcgaagatctgccaaatagattcctggccaacgaaggagctgagaggaaatacacgtttaagggtgacacggctaccttaaatccctttagaaaatgcctctccagtgaaccgatagatgagaaaagaccaccactacaaccgttcctgtaactctaacttgtttctattctgtacataactttaattaattgggatatccccatacttttcttctctttcctctacaatccccgagacttgtactctctttttaatgaagagatgaactcaaggaatctggcaggattggcatcaatgcccctagtgtaaacaaatctagaagccaaacgggtagcaaagagagccttcaagtagttgactgggactctgttgacaatgctctcaattccaatcttctctaataagagaggaggcaatgcatcttgcaaaacagcatttctgaatgacagatcatcgttccacaattcttcacttgatgacagttgatctgccaagtcgttgatagcgatggagagatcgtttgacaaatcagacagtggtttgcctgtttccttgttcagagcccacagtgactcaaactcactctcagcattggcaacaatgactttctgtacttgcttaacatactcctggtaaaattctggcttgactcccgtctttgggtctaggcacatgttagacaagaacccttcatcatcgaaagataaagctgccaagacttccagcgaggaggaagtgacaccacctttgtttgtagaagcatccttaaacagaacagtcccagctttttcaagttgaaccttagcggcttgactgataaacaagttggcaccttccacaatgaagggaatgtaagacttaccagtgttctcgtcaatcaagaaatggacgttgttagcatcaatggagtttggtctacctccacatggaacaaacagcttcagtctatccttaccaaaaacttcagcaatcttaagatggaatgtgtttctgaaaacagttccattggtgataatctttccatctggagttttaaagtcaacatcatccactgatacaaagtatccttttggagagagtttggttctgtcaaattggtcaaccatctttctctttgtagccagagagagaagctctgccttgtcaagaccgttttcatccacgatgacaccagatccatcgacgatcgcaacataagactcgtctcttgacagcttgatctcgttagatcctagatcaccatccggaccaccagtctgcaatttagtaatcttggacaaatctttaatatcaagcttttcatagatcttgttgacataagctctaacagatagagatgtcattccgtattcgtcgtggggtataccacccaatgtttgagattttccagtgaaaaatgatttccaccaaggagcacctcttttacgagcatgcaaagtggcccaatcaacgtaaccagcactattttcatctggacccatgaacaaaatttcgggcttgttgtaaagatcaacgatgccgttagatttgtcctggtgatccaacaacaacaaatccattagcgagtcaatatacttgataaagcattcttttggacgctcttgagcctgtgggtccaaaaggataacacctttagccccgccctcggggatatctttgttctttctctgttgtgtactggctaagttgtagttctcgtcaaacagattacgtttattaacattatagttttcaacggaacgtgatttgacaattctgataccacctcttgcaatatctctgaatctgatgtggaaacctctgaactcagatccaacaacaaagaacattccaaacggcttatttggatactcaagagctggaaggaaggagggttccaatctgaaagaaattgcaatcttcgaaggaaggaagaaattcgttttcagaatactcttattgaacgagaaaagggctctcagaatgagagcatgtctttgattctgggaacaggcatgattcaacagattttcaaagtcgctctcagatttaattggctcaatggcttccaaacgtttgtaggacaatgtcttctccagcttcgaattgatgtagtggacatcggcaaaagaacggtacaatttcttgaccaaaggcgtctgcttcttgaagacctcagtaatgtagtcttgggtgaaagtctccgtacgcaatctgtccttaatcttggatagaatctcaaagtggagtaagttcttgtttggattcaagatttccagaagagactggtactcagtaccaagtctgttcaagaaatgggtaacaaagattacaccgcaatgagcgtagatgcattcttgaattgacagctcacctttagcaaactcctcttggaaaatgttgtgagggattgtgtacaaaagagaagcttccttaacaacttggtcaatcggaaattgaatgaaggaagagtctcctgcatctggaggggttatatacattgaaataatggaaatgccattactgaattgctcaacgtactttctggtaactttaagtccgtaaaattgacacaaactagttaaggcagagttataacgaggagagctgttctggcggtaaccaataataactctatgctcaccagtggacttgattccaaaatgcttgattattggaccgtcaacggctgcgacgtcgttgatgatctcggagtagagcctcttggtgtgattggagcagattttaagaaaggtctcatcactgattttggtcagatctaagctctcagattcagcagcaggagctgcctttgggaaggaacacttgtacacgaagtagcaacgaacattaccaactgcggaactgaaagactccaatctgtaaccaggggagtcgactccgtgatccaaatacctgtcatcaatgcgttcttcgtagttgatcagtttgaactgaggggacttcggatcagaggagtcaaagtagacagcgtgatcatcagcctctctcttgtgttgcaacgtagggttttcattttcgcctcttgagtaagattccaacttggcagagtacaaagcatggatatgagacacaataccttgaacggactcccttgcgaagtacacgtcgtctattccaagggactcatagaaccatctaacttcggactcgattagtggttctgggataaatccggcctcgtctagagcgtcctggaccttttcgatctgatccagtttgccctcaaacggcaatgggttgtatcccgatttcttgagttcatcgtcgctaagattgtcaaaggaacgagagctgaagttgttgtttagtgtcaaattagacacttggagtctgtcgaccatagtgggttgggagtttagtggggggtagttttagtttctttctactaattgagtcaagggcgagattcgtctgggcgatctggagctatttatacggagttttttgctttttctgtttgtgggggaaaaaaatgacttaagagatgcctcatcgagaccccatcggtcgtgattatttttttagaaaaacctctgaaaaccacaatgccagaaggatgcaagataatgagagaagaccagagggaggggagagccaagaaatattgcggcatttctgtggccagatctaatttggcttagcaggttgcaatccgcttgaaggagatgagttgcctagggatagctgggtgactggtaggcgataggagaggttcgacggtctaggtttgcaataggaatgcctttccctggagccatggcatttccgtttgtcctgaaaaattaacgcccttgccaacgtccgtataccccagatagccatggttgagtccaatctatgtgtcatctgaaagtgaaagccgctggaattatccgaacatgagagggttttgttttcatgagatgagctagaacgccaaaggcgcgggataaaaagaagatgaattaaaagaaaaaagaaattccagataaccatagagattgactgataacggcgacaagatgaggaaatggacggaaaaactttctgtcaatctcaaatctgactcctgtcggtggttaaactgattatcctgaagttttggaagaaacttaatggttggatgagatgagagagatgacccctcctcttcccggaacggtaaccccgaaactttctccgtattaactaagaacagcttttcccgctaattaggaaggacataccgagcgcaaatttgaggagacgtaaacgtaaacagagaaaacggttctagcaaactataggtcagctctgacgtttccaactgaagccgttgaatgcaagttgtcccttcaggcggatgctttggttgtccaaaagaaacgtgtgtggctcgtactgaacgccaactcccgcgcgggggatttccgacaaattggcttatcagtggaaaatctagattccttcacacgctagtaaatgagggatttgttgagatggcatcaagtagatgaagatctgatacaaaagttgcactgttcaaaacgaaaagcatttgcacaggaaatggcgtcatcacattaccctccaaggtgaaaaatttcaggtggaacaccttgctggatgttcgtcagaccaccaaccctcactacagatacatatatgctggaaatactccggctattattgactatacacttaatcggcagataagaaaatcttgatggctttggtggtggcagcattttgagaagtctcataggccttctcaaattcactgaacttgaactcatgtgtaaccagtggtgtagggtctagagacttgtcagagactcgcttcaacaggtctttagtggagtatgtggctaccaaaccggtggtgatagcaatgttcttgatccataggtcttgcagttgtaaatccactttagtgccgtgaacaccaacattggcaatacggccacctggggcgataatctcttcacaagttgcaaacgtgtcaggaacaccaacacactcaatggcaacatcgacacctggctccaggtcgttctccttgacgcggacagtggcattgacaatatcataaacagcatctttgacactgctgaccttggttgggttgactgccttggtggctcccaatttcaaggaggcactcagtctttcatcgttagtgtcaatcataataatttcagaaggctcaaaggctttgacagtcagcagagcggcaagaccaactggaccggcgccgacaatggcaactgagtctcccttttggacatttccggcaagaacaccaacttcgtaagcagtaggtaagatgtcagacagcatcagaactgccttttcatctgcttcatgaggaatacggtgcaatgagaagtctccatatgggatacggacaaactcagcctgcgtaccgttcaaatcgtgacctaatttccatccaccggtcttgcaatgactctgcaagtttctcttacagtagtaacagcttccacaactggtgatgcatgaaaccagcaccttatcaccaatgctgaagtttttgacgttatcaccgatagattcgacgactccaattgcttcatgacccaagacggtttcaggtttgacctctggaacatcacctttcaagatgtgcaagtctgttccgcagatggtagtagccaccgtcttaacgatgacatctgttgggtgcaagatagttggtttagggaagtttttccaggcgaagacgttcttaccaccgtacacgagggctttcatcacagacattggttatggggaattgactatcttcgagttaaagttcaatagtagaagtaaaatataaattgatattgagcagggagtagggggcgggggtcctgagcttttttatatactatagtatttatacccagttagggtgatatgatgattttatttgggtgaggaacgttctcaaccatattgcccttatcgtacgacggcctgcgcaagagtcgctaacgtgcatttttcagtactcgctcctactaaagcgtaaattcgtttggagccaatttggctgtggaagaccacttcacgctggtcatttgtctgtagaccttccgccagttgactccactctgacttcttcaatcgcttagcaggcaaatgcaattgattggcgctctcctctgatgtaatttctacaccttcgaagtggagtgattcgccctctctcccggacattggcggctcgaccaattccactttccccgacttttcccctgccaaaagcattgcctccgatgttacacctctcatcttcgatggcttgaggtttgtgaccacaacgacccgtcgctgaagcaattcgggaactgaaaagtagtccaccaagccgctgcaaacggttagggtgttggatgtacccgaggcataattgtttcccacagaaatcgacgagacataaagtttgtctgcatttggatgtttcacgacgtccacaattcgacctattttgaattcaggtctgctaaggagagcaattgcgtttgtagctgtagagaaatgccgtttcaagtaacggaaggacattttctggctggttggtaccaattgagagagaagagtcagattgaagttgaggccgaagaaaagtaggtgggatcaggtctgaaaaattgattaaagcgaggtcaaaaccaaaaagggaaatattgtttgagaataaacgtatagtcagctgtcttgttaatacttactaatcgcctacaatggcaaaatgttcggtaatggcccaactggagtgatacccagtggattgatctggggatgagactttgtgtagtggaacttaatatggtcaaagtgtactgtgtccttcaactcgggataattccaatacaaacgtctcaaccacttgtggatgttggggtaatcaaatcgaatcattccaatgttacatttgaaatgctgaacgtaaacagggtcaaatctgataatggttacgaatagtctgatatctgcctcagtcaattgatcgcccactatgaattcttggccgtcatttgacagctcatcctcaactttatcgagatgggcaaacacctttttgacctcttcttcataaacttcttgctttccagcaaaaccagccttataaacaccgttgttgatgttattataaatccagtcattggtttggtcaatttgagcttgcaaagattctggatacaggtccaactttgcttgttcgtgtttaccatccttctctaacaactcgttaaaagcagtattgaatattcttataatctccgaactttcgttgtttacgatcgtatgctgtttcttatcccacaagacaggcacagtgaatcgtccttcataattggggttggcccggtaatacaattcactcagtcgcttgtacccatacaatttatccggagtggccccttcacaagggtcgtcgttggaaggaaacctccaacctttgctatccatatgccaatgcacaacactatagtcaaggtagtcttccaagcccttcaactttctggcgataagggtcctgttggcccaagggcacgcgtaggacacataaagatggtatctgtctggctccacagggaatttcgggtctttgccaattacgcttctaaaggagctgtcctgtcgtttgaactctcctttggcgttgtggaatttttgaatgtcaattttgctcatgttacgtacttgtcggaaacagctgcgggaaaacagttccatttatataagacagaagagcaaaagtaagggcagtaccgaagagcaaactgccccaggcagaactaggccacgcctcacaccccatctcacacccccataaattctgaggtaaggatctctagcttactcatacttttgtcagcgttggcagggtagcagtggttctgcgtttgtctgcctgcaacacttcttataataggttgacgataagcaagatttctgagccgcactagtgtgtggctgctacacggtacgtcggttgtacatctacgttactagatcgatgctagatgtagtaatttacattcatcaagaaataatccttcccttgttccattccgtctatatacatcccccattcgatcaacgaccatgaatgggcttgggattcatgtccgggagcatagtggggagcaacaggatgacctgctgccttcgttgccagcatcggcctctcaatttgaaccaccattggaggctttggagtccaagacttcaaactacagttctgcagtgtccctggcgcaaatacccctggacacctctaccagcggcatagacctgtcagatattaaagtgagcagtcctacccttgatgagtcatccacgtttgatgaaaaaatagacggagatagaactttatccaagcgcttcaggacttcgtttgcaaaactaagaattcagtcgaaagttgtgcctgctcatgagactgatgatacgcataccctcaaaaagatgagatccggtcttctgaggaagtggatctcccatgataacactggtacagattatgacacaccgcttagtcaaacaaattcgaaacctagatcttctcccacgttagttacacaaacaataaatgtaccctcaagatcttccagcccatcttttcataccatagcatcaacatcagctacaacctcagattttaaaggtttcgaaacttccccagtaataagtgtaaatgaaaagttttttggaactacctcagctatagctactcacagtactctacagaataccaatgagaaggtctttgtgaacatattcgatgaacttcaattttggaagaaactgcgctcagacaaagctcgtgggtttgaaattaccgagtctagacttaagagttcaggctggtcgtcaagccaagatatcgaggagcttcggagacacaaggaagcttcgttacacatttatgatgaaaaaataaaaagcctggaagaaaggctacaaggagattgaaactttactcctctacatagaaagtatcattagaataaaaaaagattgcagcacctgagtttcgcgtatggtctcccactacactactcggtcaggctcttagcagcttaactacggttgatcggacgggaaacggtgctttctgctagatatggccgcaaccggaagctttggtttatcttcgtactactgtagttgggacttagaacctaagaggcatctcgtgggaagaatattggaacctttcatcattgacttgatatatttactcgatgatgtctattctatgggaattatattatttattaccatatttataaaaatgactgatatataacaatcctattcaaagaattatcctgaggagagtctgtaatactactgacttttggactgaccagatacagtacaagaaaatctctgggacttctcctcctgtcaattaaacccacatgtcactttgctgttcttgctgcaaaccgggacatgtaatcaaatagttatgcaatgaagtgactagaccaaacaatctgccagagccgccgctaccgttttattattagatgcggagagtgcttctatgcataaatcgagaacccccaatgtacaaaaccgaacgaacctcatgcccaactgaatattacatttcctcatcatagttccttctttctgcaaggtctgatctgtttggggttgattctttaaaaacagcgccatgtcttcgaccaaaacagagaatgccaaagaaagtcttcgtagaggaacttctaatttttggatcagaaggtattgggccagcttcgttcgtttccccattttgaataaacctttgaaccaagtaagatcggttggctattcgtacttgaaaaacagcttgatttctttggacttggtgtccaccctgcgccgcttatttgtacatgccgatttaattccatacgacgagaaccataatttttttatttctgctttcctttccagccttatcatgatagtagaagactacgagtatgtggtcggcaatagacccaccacctaccatgttgcaattcctaaagaaatcagctccaaaaagccagttttaaaactgcatcctgatttcatcaagtcaagaaactgtaatttgtattttgatgaagagttttaccattttctaaccttcctgactctagaaaaagctaacatattatgggaagcttttatgaacttgaagggtgatcatactctttttcaaagtcaattgaccagtcatgataaacttgtcttcatgagaatttggcgggattatttgtcaactctagacatctttagagaattccattccattcgttgcattatactgtctcatgactttctgcagaaggaagataacttagggcaattggagttctgggacaaaattcagaaggatttcagctcattcgtctatttcaatgatagcaggaaaccatggtattccccgttttcgttaaacgttcgaattcaaaagttgttcagtatttattctgattcattctcagtaggcacttctttcggcgaatcaaaaggccaacacggacagagaaggctttcccgaagttctaaaattgttgcctctccgtatgtcactccaaagttccaaggtttaacgtttacaatacctccattttttccactgcactattggagacagtacgtcatggaagtgtacatcagtaaaagtttcaagcaagaaaacgtcccgcctcttatgaaaactggccatattatcatagatcattcgaactcgacagttgacgttgaagccatcagacatcgctacggcttaagcacatttagaagtacgacaaatagctatgtcgagtcattgttttacagtgatcggcttgatcttttttacttgccattagttgaattaaacacaaaaatcctttatgttctgggatacttggcggatccaagtgacgtcttatctgattctgaccccgacgacgattcgataaaggttatcgtggaagagttgagtgatatgaacgttgaggaaatggttgctaggattcaatctttggctaaacccaagttcttgaaaacattcaatgttgacgatttgattcagtacctagcggatttttacgagttcttgctgcatgtagagttaccaacaaaattagaaattgaagccaggaaaatccatgagttggttgagtcgtcgtgcatcacaggagagattttggaactttgtttcatattctacggagagtgcatgacattcggactatcagtttggtttatcaaatgcttggacataataggtgaagatttgatgaaatttgaggctgttgtatttaatgagatccattgtacaaaagaactccctctgaaagaagcatacccatacttacattatgtgatggagaagttcacttttgaattcacacatgataatcacatacaatattttgtcaacttattttcttacttcaccgttagccaaaaagaaaatacctggcagaaatttaatcacgtcccagaacaattgcaagcgtttgaaaaaaggttcaggtctgtatgtgacgacatagaatgcatggtgatgacattgtctattgtacaactaattcatttttattggaacgaatctggtgtaaatttttcttgcaattgggaccacacggccaaaactatttacactcatattcaaaactgtaatgatatccagcaatttagcagtttgaagaatggattatctggggagatagtcgatctatttcaacttcaattttcagctgatgaaacgaaaagcattcaaagatccgaatttgacccacagtttctctcctcttatctggtgaatgccgaccacacttcaattaaccccaaacaaagtgtcaaaatgattgtaatgcaaaagctggtggaactcttcgtgttgtcaacacagtcaaccaagcaagatcagttttacagattgttgaaaaaggtattccatctatcagatacattgaggttacaatttcttggcacaatctttgaaatgagctgcattttgaagacaagtctgacattgtacaattcaatctatgaacaagtctacgaaatgcacttcaacactcatagtttgaccactacattgattgactttccacgcattcaacaacaacgccataagcaaaaagatcttaagttccaatcagtgaaattgagccccacttctgggtccaacggattggaagatgccagggattaacgagccatttgtctgcctgaagcctgtggatgactgaaattgaagttagccagacatcaattcgctctggagatcccgcgaatctgttggactcaccttcagatcttgaaccccagactttatcctcaatctaagattacatgatatcactgattcagttattgaatacctcatttcttttgcttttgttggttcccttcggcgcagattttggggtgaaattgacaagctaccaactaaacaaacccactcgtttgactcttcttttggtagcacttataaatttcagacaccggctagtgtattatgcccaatctttgcttgatctactgtttggaactagtcctgatcttagcaagagccccaaaatcaaagaaatatatgtccacccagtgaaatcattacggggagattcggtgcaggaatgggaaattgaccagcatgggttgaaatgcgatcgaatgtatacgcttggaatattcagggatggcaagttcaaagcggttactcaaagagagtgccagaaaatgacgttagtgtattgtgacattgataaagagaataaatgctttaagtatacatgggaccttggcaatggaccggggtctttcacattacctatggaaccagacattgcatcggttgattcacaaaaaccagttgaactttggggagttaactttgaaacttatgttcttccagatatgatcccgtcaaagtttttcgaagatttaggaatggataaggacactcaaattctgtactctccaaagggcaaggctgtcaagacaaatgctcctcagtttaacaaccaatatcgattctccctcttccaggactattatcccctattaatggtaagtgataaggacatcgatgatctcaacgttcgaataaaggctaaaggcggtaatcttgtttgcagtgctagaaatttcagaccaaatatggtccttgaaagggttgggaagctgtttgacactgatacttgggataaattttctgtttacaccaaagatggaaaagtccaccattggagtgtaacctccaaatgtccccgttgccccattcccaatataaatacagaaactggtgtcaatgacaacaaaagtatagtttccagggtactttcgacttacagaagagtagactttggaagcgtttacgactccttcttcgggatgtcatgtgtgcagcacgattacaattattctattagcgttggcgatgcggttgtggtcaaaagtagacgaatcaaccattatgagtgtattggttagtctatctaattatagggatatttcccagtaaatagttgggaaggttggaaaacttcattcaagagtttccaccaaaaactagtgaacctttcttttgggttgtcttcggtagtgttatcggtcaatgcagacagtaccatttcacttaaaggattcgtcggtaattctttcaaatcttttattaatcccacaatgtatagctccagtaattcgtcagagttgtctattcgtttctccgagcgtgacgatttagttttcacaggaatcaaatgacgagcgtactctgagtcataggttcgattcattgggtcatcgtactgtgggagtttaggcaaaaaacgagatgtgagtgccttagattctggttcttcaggcgccagtacatctatcaacgatatccgagttccgattgactttgcatcatcattctcttccctattcgtggacccagtaagtggcggggtcaccgactttgagggagatagtcgcctgggtggggggtttttggccggtttaaccctacgatcaagtaagatcttggtatgcttgtaaatcaaacgaaaaatcactatcatttgagtcatttgtaaaccaaaagcgaccggcctgtggttgtcgttgtgaaacagatccatcatcgtgtctaattccagaagcagttcactggaggtcaacgggagagtgtcactacagacactgtaaaaatacaaaattgctgtgtcataaaatccaccgaagcggaaacttgatggaaatctatagttagaagtcagattttgatcatacaatcttaaaaggttgagcgtggagttgtgcagaatgataaaatcacctgtggagagctttgtatgttggatgcatgggcgataaagttggtttaatgttgaataatacataaataggacgtcattttttttattcccatttccttattggtatagactgtgctaaaccagtcattaatttgattatggcgggaggaaatccaagcacgagaagtagacttcaaaaaggggttcacaatgtaagggcggtataaagtttgccatatttgggattgaattttccttagtttgaccaacgaacagagtgggtaatacgactcattagactcaagaggtcctagaagagctgtgatatcaaaatcgttcaccatataaggtcttgatgaaagtccgttgactaaacgttcctggcaataccatgcccaaaacagctttctaaatcgaatagtttcctcgtgttgaaataaatctggactttccgtgttaatcggtagtttctgctccaagctcaatagggatgactccaaatataggctcatttctatgacaattctgccacaaacattcaggatactataaatatcggtttccattgatttgtagaacccacagagtgacattagtaacagacagcggagagtttctgtttgctgaatgataggaggttttgaatcctttgtaagctggagcaaaatatggcggaggaaatactgagcacttttatgatactcatcagagctcaaaattgtttcactattctccaattgactcagtttttgtgacactactagcgtgagtatggtgtaaagaacgtagagctcaagtgcggagactttgcaattcagtaaatacaagatagcattctctgatgatagtccttgaaattgattcaattttttgtatactttgttggtgacatccaaaacccattcacgatcaaccaaatgtaaatgtgacatggaatccttaaagaagtactctattaccaacaaaagctcttctttcaaaggaaggtttactactgataaggacgccaacgtgctcgtgggttcatcaggattactaaaatgaaatgggaccaagctcaaaacagacagttgtggaagtttctcaaacaattccgcttctgcaagtttccgacgttgaacagtagctaccaaggagccacctcgtaattcagaggattccttgggtagcaccgaatttgaatcattcaaaggagttatttcatccgtgtcactggtggaactgagcaacttttcatagtcggttcggctcatcaaaagttttgtcaccggatgatgaaccatgcactcaatcttcgacttctcacagcgggagcatctcgggtaccggaagtcacatctgtgcttgagcgacctgcatttctggcaagcagttctggctctgatagctcccatctttgaagctggttatacggagtttagggtttggaggtagctacagttgggatggccaagggcccccggatcaacaatgtgatgttggatggcaccattatattgtggctcaattggtgacagatacgcgaaatacaaatatgggacacttgcatcttggttgagatttcaatgtgtgagtgcagtaacgacaatagctagttttccccttttgataacctagcgacttctagacacattttcctcagctctgtggagcgaatattacgcagtacttcgtttagtacatcgttgaaagtcttgggaagcgcttctcgtagcttggaggtggaaatttgcccgcaattgatcagtatgaaaagtgttcgttcaactattggttcttccgacctctgcttgtctagaacttttgacaagtagtgaatgaaatctttattttcgaccagtacatcagccaccaaatcgtaaactgaagcattagcaaagaaacttagtattgcgctttgggagggaccagtactcagatggtaaagtaaatccaacagtgtatcgtagttcttcttcgtgtctggttttgaccaattgaagacgtattgtaagcagtcagggcagtcgctgagattggatagtaactccaacattgattgacgtatgctggatatttcactaattaggaagttgggtagacttggcaaaacggcattgctgatggttttcttcaaatccatatttggaactgaggccaaattcgtaagtgatataattacttcaaaaacggcttgatttgcaacctgggattctagatgcatggcaaatatcgttttatatcttgtctgatacttttgatgatcatatgcctgcactagttgaaccaaaaaggccactgggatcagatcatatttttcaacaactacctcagggttgcttgtaagtaggatcttagagactgactcaatgcataccatctgggattcaagttgagcttgattatctttggtagatattaagtgggagaatagaatatccaaccccttttgttcaaaaactatcgacctggtttccttgaaaataactatgttgtgtatcagattaataattgaattatggaccaaactggtagatgcttcatctttgaaaagggctagcagtgaactcattaaatcttgatgggcaagaatgtgaaatatgaagttgagtatctctgttgggtcatctttttcggtatcctctagaactttagaaattgattcgtctggagttttcgtagaggtgacgttttccaaaatgctgaggattccataagccaaattgaggttcttcttctctttcagtaattgcaatattgtaattaataaatcgtcatcgttccttatcattcgtttggcctcaactttgatggatagatacgtaagtccttccaatgacagatccaggatctcagtcgaagcatcagtaattacaccagcaataaaaatatcataggtcatggtgagctgcgtactcttgtctcccattgagggcatatgccacgttttcacaatgaccaacgcagttaatgtgagtatcaattgagctcgttcgttctttgaaaacgaaacagtaagaagcttggacaacaactgggaataatgactgtggatgaggtttcgggtggattcatcaatacataaattcgatagcatgtagagtatcttcagtaataaagaactgttctcaagctcagctgcatttaaggttgttaacctggatatatcagtggttagaagccgaagaaaactttcattactagcgtatttggaaactgtctcgggaaaaattactatcaaatggctaacacattcgtacaagaaactgttcaattcctgtaaccccacatcgttcaagaaactatccacataatattcagctgtacgttcaaattcacagtaatcggaaatccttttatcaacctgttttaagtgtgccaaaactagtaaaatatctggtctgaccaaagcatcatttagtaaatacagcattgacatgactggaccctcaaggtcctctttaatcgagtgaaaattggtgtcaattaagttattgaaaagttgcagataggtaacaacgtggttagtggatatggtggacgagccatttttcttataccacttcagcaaatccgtgaaacctgagcaaaagtggctcaaaacaaaatcagctagaaagggatcctcatcagctagcagtgcttgtaacaaggataccgtcttcttgtaatcaggatcaaatatccataacttgatataagccggctgcttgactaacttcttaaccttctctctggaatcttttgacttactctcaagatactcgtcaattgtggcagtcaattcggtaagttggtccataatggggcagaaagtgatagatatgatttaggcagataaccatcgctcgtaccctcactgcataaaagcatctgatatgaaatttgtcgagcacgtatgtagactcgaagggctgggccagtcaatttagtatacatatattacaaacttttacgtctccaccttcttcttcttcctgtctctctttcttacactttgatcgttcttacaatctggacagtaccaaattccagagggaggttgtgcagtgagaccgacacaatcgtagtgaaaccactcgtatttacaatctggattgtcacacgcaatcatatcaccaaaagatacttgttggcagaaacaatacaactcatcttcttctcctgtttggttcaattcacttgcgttcttctttctatgtgttcttgttggtgctgatgatgataacgggggagattcaaaccttgattgcgttctactaacaccatttctctgtctctttttgggtacaactccaggtgtgctgctttggctcggaggaacaggagttaaactactcatcccatccgacatgttcttgtcctcttcaatcatatcatctggggctagtaacccttcactctccaatttctcaatatcactttccaatctgaccaaatgtttactgatcaaaagaagagctgtgttggacagcaatatcttctcttcctgtaaagctttggcctttgtgaagtcttcatttatcttgctgtacaactgttgttctttaggatgtttgactagtgagccatgttgtttgatgtatttatgtaattggttgtcctttccctgtgtccttttccgaatctgatacagcgtcatatctttgtccctgagctcctccagaagatgagccagttctgaaggaagattggacagatcctgggtgtactgctctagaactgtggcagcatccatggtgggagagttgaatgttggaacaaattttattacatcgcgctgtatacttcctttacttacatcatcgacctatcgaacggcctactcatttcagcatggtcttttgaggagaatctaccgccctggcagttgaaattcctcccgtggagttcacccttggcctaggcttattgagaacacttttggagctgacccccaagtcgatggactcaatcggtttttcttctacttttgctcccctcccaaagattctggacctcaacgaaccaacaatatcgggtatcccggtgacactggaggtctgccaggataccagtgatttagttgacgctgattcagaatccacatcgttgaaaaattgattcgctttagcaacggttgccaaatgtttctcaattaacgcagcattacgactgttggctttgaatccaatgtccacaaagctgcccacaattggaatcagcttaaacagaaaatcggctataatattcagcagtatgaagaaatggatatcccatggaactggattgtccaattgaaaaattagcctgtagattagcaatgagttgattgcagctaacacatctccaacaacaggaaccacagatataactccattccaaccgaacttgactccgcaaatattgaataagtagtctagcctataggatcttctttgaatcttttggaacagtttggtgtcgttatctgaaagccccacaggtggctggatataactgcgaatcactttggaattggggtcggtaggatcgagttgcacctcctcgtaataaggatcatcaaagccaaaccggttcagcttggtctctccaaagaactttttagtgatgaatttcaacaaaaatttcttcatctctgggtttacttagtggttgaaaatcgataacgagcaaagcaatctaggcgagatagatatacccaactccaaaaacagcaagcaatacgtcaaacaggcaatttttaattagtgtgtacacattataaacatatctaggttctctttgtagctttagtcgagttcttagcagcagacgaggaatcagtcttctcagtctcatcttcagtaacctcctcgatcttctgggtagactttgttggtgtctttgcagaagtctctggcttcttgccagcaccggtcaatgcaaaaatcaaacctgaccaaacggctacaaggaaggtgaaacccgaaaaaaatgtgaccaagtagtaaactgcttcgcccggacgttccaacaaaactgagggttcttgaacaacatcattcaaaaaggcgttagcactgacgtaatactccaatacagtttggaaaacagtgtcgaacacatctgtaaaaatgtttccagtagagtctaaaccagtttcaggtggggtttcaggctcaaaatctggctttggagcattctttgcagattctgcttcctccaactccaattttggaacaaaagtttcgtttccaatgaattcagcttccttaatagaatggcctaggtagatgttgtcaaagagaatatctgcattcatggtccacaactcaaaaccaagacctccaataggttccaagtttgctggtttcttgtcttcaaagtagttagggttggcaatcttcttagggctccaaggtcccttgtaatcagggttctcaataagaggaggactccacttacccttgtagttaggattggtaatatatggagccttccaagggccacatccaatatctgcgcattctggatttggaataacaggagcaacccattcgccatcctcttcatcgtcccagtcttcgggcttggtggcctctggatcagggatgtacaattcagcatcttcgttccagttttctggtttcacagcttccggatcgacgattcgcaatggctcggactcgtcccaatcttcaggcttgacagcatctggatctgggatcatgtcttcatcaacccaatcttcgggtttttggtcttccggatcgtcaatctccttcggagcgccaaatggtggctttatcaacttctcgttcaacaagttaccagctttagcaacctcaccgttgattctgatttcaaagtcattattgggcttgataatcagggtgtatagagaagtagtcttgacgattctacccattggaggagtagccaattgatgttcctcatattcgccggtggctgggttcttcctcttaataatcaagtgcactttattcgtggttccacatttatcaggaccaaacatgacttgataaggggtttcgttagagaactcattcttgttcagaccctcagcactcaataatttaacataagcacctccacagttcaatccttgttgaagcttgacttcgtattgcaagaccaacgtattgtcagtgttgtcaaatacctgtggtaattgggcagatattgcgtggtgagctgcctcagatttcacaaccagacccctgtccttcttgaatccaggatagacaacaggttcctcaatggcccattctccaacataagtgaattcttcattcttaacggcatgggagatcttccaggtgtcgccgagtttcggttccttgtcgaattgttcaaagaaagatgacttgtccaactgagcttccaagggtctgaactcagcgggttcggattcggctaaagcaccaacagcgaacaacgtagaacttgcaatggtagagatcttcatgacgtggcaaaagaactgatgagtaacaagagaagtagtccgttcaaaaaaggggttctaggtgagtatatatagatgcagtaggatagggtggtagatctgttcgaaatatgattacgtggcgatttcgcgtaaattccatcaaattctatgaaagatcgtcttggctagcagaggagagaggagtgcagttgggggatgaaacagattgtaacgtctgctttcgcttccaggaaaggtagtttacctaaattgtcttgtgcattctaagacggccttgcttgaacggtttatcgtggaatggagacaacatgtggtttaccagttcttccccagaaaatcagtgtgaactttatgcttcgcgaaactgtagatgatttgggtctcagcaaatcagttaccttctttctgcttaattcacccattatgctccggcttttccaaagaactcagtttcaaggtagcaagacttgtccaagggtgttttcgaaatcttttcattctctccccttcttgaggcaggagctgatactgaaagttgaacctctgaaacgtgataacgagtcggaagatgtcaagagacgccgtctggtttatcagtcaagaaagagaggaatcttggaaacagaccttcttctgtctcgtttcgcaaaacgctatctaccgacaatgagtgtggaagagatggaagagtatgatgacttattaaacgagttggattgggatatttattactgggccgtgaaaaactacgaggttaccccattgcctgaaaagtggaaggactccaagattctcgctaaactacaggagatgagtgcaaacaacgaaggcgagatccttcgtatgcctaacttagatgattctccgtgaaaaagtggagttctgcttgtaaatgtatttatttcttcaaggaacctctagaaagttccatcaccattcatatcagagaatcaatgtagcatctgatgatgtaatcacgctacactccatcgcgctcttgcattcatttattcctctcttcgcactatctgagcacttccacctcttacagatacttttattggacttttccttctttgccgcccagcgttttacttcttgaagagcagagataacacaatgccaatcgattattcaaagtgggacaaaattgaactgtccgacgacagtgacattgaggtccatcctaacgtggataagcgttcgtttattaaatggaaacagagagacatccatgaaaagagactgcaacggaacacggaaattaagactttaaaaatccaaagagagatgtatactcagttgaacaagagagttgactccatgctttccaagttggatttgaatcaaattgcggatgaatccacacgaaacagttttcttgcctccaactttgatgcctccgagaaatgtactattgaagaggatcagcagaataacccaacttataatgaaatggtagaagatttgttcactcagattacggaagacatttctaaagaaggcaaagatgcaaagaatggctcgattattgtagataagctgaaggaacacagagccaagatcgatgcggtgttgaaagagattgatcctaaattggaccaacttctacaagagaaagcactgcacatttcaagtgaggatatccatgagggatttgacagtgtgatcattaacaaatctgcaacctccaagattgcttcatctcgatcgcctggagagactgtaaaaactaccacaattgaaacaatcaataatccccaaccaacagtaccacttcccgatattaccaaggctccgtctcaagaattgagcactttgggtgaactggacgttcttgatgagactttagagttttccaagattgatgtcagtcaataccgagcgattgctcgtttcttggatcaacatccttatatcatttctgaacaacaacaacaagccttgacaatgaaggcttttgatgcacaacttgagggcaactcccaaagagccttccaaattgttcatcaggcactggtcatccaatacgtcaaccaattatgcggagctcgacccaaatcagaaattcttccaagctacaaacctcaggaaactgcgatcaaactgtttataggcaagttgactgacaagaatcatcctgcaagaaaagcatttgaagaagatgtcaaaagaaccttcacccatattttggagagatgcaaaatcctcgcagaagaaaataaggctatgggtgaagaacaagtggaacaaattcaattaagatcaatggatgaaggtaccgaattaatggttacaattcctcaggaaaacacaccagaatatgaagctttcctcaagattccaaaagtcatgcaggatgcgctaagaacctcttcaatcgatgaggtcaacaaagtattttccaatatgagcgtacctgaagccgagaagattctagagctttttgatcagtctggagccatatcagtggctcaactcttagagaatgaggaggagtttgacaaacttaaacatacgatgggtgatcaatccatagatcaagaggttgataatttggcactgaacgataagcctaatgaagaggctaagacagaagacgtagtcgattagagcaacttttattaaatagtgcttatacttaaaatcgcttgattaatccttaccatacctaaagttaatacctatatacaaatttagtccttaataatttcatattcagcaggctcatcgccatcctccttacggacagtctctgcctcagcttcattcttctcacttgtgatctgtaaatcaccatcaacaaggtcaaccttgacagttgagttattggtaatctctccttgaatcaatctaatggaaagagggttcagcagctgcttcttaatgactctgttcaaaggtctagcaccatacaatgggtcatatcccttctctgtgagccattccttggcagcgtctgtgagcttgagctcaattcttctatcaaccaatctgtcttggacttcactcaatctgatgtcaacaatctttctcaaggactctctcgagagtctattgaagaccaaaacgtcatccagtctattgataaactcaggtgggtagttctgtttcattacctgtatgacttcattcttagtcttctcactaacttttccaccgacattttcaagttctgtgtcagccaataataaatcttggccaagattggatgtcatgataatgatagtatttttaaagtcaatcttgtgtccctgagaatctgtcaagttaccttcatcgagaatctgaagcatcagtttggaaatgtcccgatgtgccttttcaaattcatcaaataagacaactgcatatggtttacgtctgacagcttctgttagttcacctccttcttcaaaacctacgtatgaaggtggagctcctatcagtctcgacaaagagtgtctctcctgaaattcagacatgtcaaacctcaccacagcattctcgtcgttgaataaaaattctgccagggacttagtgagttcagtcttaccagtaccagtaggacccaaaaacataaagcttgcaataggtcttttttcgtttgtaagaccagctctttgaagtctgactgcatcggcaactgaatgaattgcttcatcctgacctataactctagacttgatggattcctccatgtataacagcttgtccttctcacctttcatcaatgattgaaccggaacacccgtcatttttgaaacaacccaagcaatgtcatctgaagtaactgattcatgaagtaaattggtggtcgtttcagactctccttctttgactctttgagcagtagcagaaactttttgctcaagttctggaatcttggaataccttagcatggatgcctttccaaaatcaccttccctttgtgccctttctaactctagtttcgattgttcgagttcttccttggcagtcttgatcttctccaagctattcttttcatcttcccagacctgagtcaacctttccagttcttcctttttaagtttcagctgttcatctagcttatctcttctttctacggaaatcgggtcagtttcttttctcaaagattccaattcaatctggatggtcatgatttggcgatccaattgttggataacatcgggcttagactcatgttgtaaacgcaaggcggagcatgcttcatcaactaaatcaatggccttatcaggcaagaatctgtctgtgatataacgattagaatacacggcggcggtgaccagtgccgagtcagttatacgaacaccatgatgaatctcatatttttctttcaatcctcttagtatgctaatagcatcttgtacggatggctcattaaccaaaacactttggaatcttcttgctaatgcagcatctttttcaatgtattttctgtattcctcaattgttgttgctccacaacattgcaattggcctctagccagagcgggtttcaacaagtttgatgcatcaattgaaccttctgctttacctagccccaatagtatgtgtagttcgtcgataaacaggataatgttgccatgggcctcgtccagctctttcaatacagctttcaaacgctcttcaaattcacctctaaacttggcacctgaaatcaatgatccaagatcaagggcgacaacttctttatccttcatactttcagggacctctcctttgataattctctgagcaagtccttccatgatggcagttttacctgtaccagcatttcctatcaaagctgggttgttcttagtcctacgagacaaaatttgaatcgtacgacgaatctcttcatccctcccgataacaggatcaagctttccatctttggccaattgagtcaaattgacaccatatttttgtagagcaggcaattcttcctcctgctgtccattcatatttatttgtgggccgccgctactggcaaacctaatggacatcggagttcttagtcgtaaatgattcacattatgtctggcaaagggaatcttcggttgaaccggtctaacagctaatgtgttggagcttgtccgaagactcaatgtcgatagcgatgaggccaacagtatcctaggaacttttgccctcaacgcatttagtctcagttggttaggcttgacagtacgtgctttcaacataatctggtggagtgattatgaagcttctggtactgatatatactgaggagatagtaggtcacgtgatacaaaaatgaccgcggaaccttctggaaaggtcagtgttctacatggggaagtcccaaacaaaatccacataaaaagattagatatttcacaggtaattcaaggcctttacgcttaaggcgattagtggccgaaatcgactattaaattatgtacagtaaattatgagatctaatcacccaattgaaagtttttgttcagctttaggaagagcctgacctttgagtttctctaagtgttgtttccataagaagtctaggggatcttgatcgggttctacccactcgaatccatcacctccacccagccaatactgttgcatcatgatctcttgctcaggttcattgggaatcatctttctgtcaaaaaagttttgaattatctctttagttgcgaagccttcactcccatggatttctgcatccacttccaagactttggaacacatcattagctcatcattatgctgataccaataattctgtaaagtacctggcctccatctcaatggccctgtgtcttggctgatattctttccagtaaatgcgagtgatgccagaaaagatgtgtttccaatgtaagcgagaaccatggcgtagacttttcccagactgcccacatcagcaaagaatatcctagtaagaacctcaatggcaccaatgagcccgaaacatgatccagcgtatctaatcaaatacgatctcatcttcgacttttgcgtactaatatatcttgaatgagcagtcgtcaggtctacaatcttcagagctttgtctacctctccgtcccaaagaaactgccgaaacggtatcatagcgtcttctctgttgatactcaaatctttgttcttgtcgtagtagctttgtatggaacattcaatattagcaaaggacggtttggtcaaccagaattttcttagtatatttggagtgatcttcacattaggagcatcaaatatcttttctatcagactatcaatttgctctccctgtgagatctttcctttcattatcgagcaggttcttaacatgtttaatacatgctcctcagagacattctccctctctagtatttctttcttgacaacttggtttagagaggaaacactggacttccttgcagaataggtatgaaaagaccgctggacaccagcaaatctaccaagtctggtaaacatactgaaagcttcttctactggatatctgtctaaacactgagtacgaggggagggtcaaaaaaatgatagtactaccgagtcgcgggtggacccaacctcctcccgctcagaatctttcaactcatcgcatcattacctaatagctcaccagctaaacgtcgagattcatccaataaatgggcgtgatacttccagacgatggtaagcaatcgggaggccaaccaaatagaagggctaaagtcctgagccgatttttaccaccagaacatcaaagaccttcaatcggcctcttcctgggaccttttactccagcagctgataatgagattgccctgtggacttgcattggcgctcagctctttagtgggctggcattgcttagaatgagccgaagatttgttttttcgcccgatcaatctgtaagaaggtttctctttaagacttttcataatgtggtaggtgcagccctgatatttgggagcggattagaagggactaggatgcttctacctgaggatccttggaaagaagaagctagaaaagcaagaatattggcccaattgaaaggtgagcccgttagttggtggtatggacccaagagttttattccttctggaaggttagaatacacaaaacagatgcagtttcacaactttgaagtcatgcataaatcacccgaaaaaatagcccgagctctcatgattaaggacaaactcaaggaggaaacaaataccctttattcgtccattcatgagaaagcggaacaacagactattcgactctctaaagatctacagaacaacgttcccctcaaaggggtaacgtcatatgttcctcaatttagcacttcaaatacggacaccaagttatatttgaaaaatgttagcttgaagacccatgccgacctggaaaaggtctgggcagaacacaatccttgggacatcctggaagagaaaatttctccaatttccgtaattgcactgccaaagtttaacccaattatatctgaggttgaacctgacaagcagcaaccatctacgggtgatatcaaatacattagtgacagaaaataatgacttacataggaattatgtttccttctcacttgcaggctcgctcttcgtagatttctccttgcagcggtatccttctaccgcgcaaaagattgtcatccacatatctgctggtaaaatcaatctcctccagtaccatacccaagacaactaaaggatcaagccagccacatgaacggaaaacatctacttctgcaagtgcttctggttcaattagttgccgcagttttggatacccaagtcggctatattgattggctagtcacctctactggctctttcctagatttgtcgtcttgcttgtttaactatgagcagatatattgtctaacagaagccaatgatctaataggattggactctgatgcccaaataacgtacagactccacttagatggtccagatcagggaaaattgactaagttgaataataaaaagtttggatctgtaagaggcaactatttagacattttcaatgagaagggccatcttttgcacacagaaaagttcccctctcctattgttgatgtttatctggataattcattgttggcagttgacttagagggcgttgtacgtgaaattgatctttctacccactcttccaaggaggtggccacgttgcaaagtttagcttgtgctatgttttcaaaagtagatgacaaggtgaccattgcattcaagggctccaattcagattttgtgaaaattgccatcctggaagataaagtatccaccataagtacaaatatatcctcagttgtacacattaagaataacttgttggaaactgacgaaggcatttacagcatcgaaggatccaccgtcaagaaaattctagatggaactgcctacttaaccgatattggggcaataagtgtcgatactgttaaaaactccgtgagatctagtggcaactcttttgagccccaatccaaaattttaaaagtccacgctgaagatgagttcatcgtcgtgctgacagtggatgaggttttagagatagatcttgagacttttgacttgtccagcgtcaaagaaaactcactaactgaagagtatttgaattctgttgactacgaaatctttttcaaaaaccaagaagttcagttgataattcaagatagatcagctagagaactgattatcaccaatggagttattcaaaaagtccttgatctatcactaaacgacgtagttgattattctattgtgacacttcaaccacaattaaaagctatcgaagatgaaataatagaagaagaaaactctacgtttttcaaagcttacacttcccgccttttcaatacattggctgccctcaaggagaatatcaagaaaagagaatttacttcattattccaatatgacacctcaggacaagatcagtcttttgggctggacaaaagattggtcattggttgtagtcatggaaagctatctgcctatcatctacttacaaagacaccccaattaagctgggaaattcaactcccattgatagatgaagtttccagttttaatgaaggtgaagtttccgtacttagcggaactacagttttcacaattgatgctgaaaccggtgacatcttgagcgaaactgtagcaacagcagaagacccacagaaagaatttgatatcaagtcagacgatcgtaccatctctggattgaaactgatcaataacgagtatagctccacttggacatttaaagcgtcgccagaggagaagatattgaaagtagtaaggcgagaggatgataacagtaatgtggcatctgccggtcatattcttggaaacaattcagttttgtttaagtatcttttccaaaacttgatttcagctgtacttctcaatgaacacacaaatgacatcagatttgtgatactcaatgccatcactggacagcaggtctactctgatgttcatagcggaatagattcaaacacaaatgtgaatttaatctatgatgaaaactttattgtcgtctcttattttggttccgatccaattcctgaacaacatattgtcgtttatgacttatacgaatctttgaccccaaacaaaagagttgaaccaaaagatggacttgtttccaactttgacacggatacccctatcccccaaatctcgtctcaatcgtttttgtttcctagtagaatcaacttcattgcagcttctcgatccaaatttggaatcgcttcaaagtggatcatctcagtactggagaatggacaaatttttgcaatccctaaagttgttttgaatagcagaagagttgttggaagagatcttactagcactgaaaagcaagagtatggaatgtccgtttattctccatttatttcgttacctgagaacattttcaccatttccaacattagaaatttggtgttagataacaacagcaacactctccccagtggaaagccaatactgaccgttgaacctacaggattggcctcaacatcctttgtctgcctcataaactctttcaacgtgtattgcactcaaatttcaccatccaagaaatttgacatgctgagagagaatttcgaccaatataaattgcttttaagcatttttggtctgcttgctatagtacttttggtcaggccgtacgtctattccagaaatgtacagaagctgtggactacgaaaatttagagtatgtgtcaatccttctggttgtcattatgcgcgacatgcatatgtagtatttaagatctcttatagataaatgttctggaagaatgatttattcctgaatgcgtggtattagtagtggaaaaaggtctatatttatatggatatcttgctcgcatgttatcgtgaattgtcctggtaagaaccatggttgctccaatcccgttcaaaaaatttcgatttcacagatacgatcgttacaccgctgggagtcgatggctatacgagactcgataccactttaacttctggagttacaacctgaaaacctgtgccggtcttttaggagtctgtatttatatcactatgattctaacaatgaactttttgtacgagaatggcaccagaatggattttcctgtggacgttgagttggatccattcttcctgaaagaacaactgtacatgcaattgcaggcaacttattttaaccaaacaaacattgttgttaacaaaacaatcggcgtaaaccctttctaccaaactatgcccgaggcctcccagttgagttctatcgacagaatcgcaatgctaactgagcctgtggtgagggatgaaaacattcacgttccgaaacttcctctgaagttaaactattttgactataagactgcttcgttgcagcagtcaatcatcagtacattcaaaggaagaatgggacatttaaacaagtttctggaatacaagataaccactcagtattctctgagagttccagaattgacacatcaacctacagaggtaaagatctctgataagggtatcttgtacgagttagtgtggaatggaggcgatgaaaaaaaggtggaggataggggcagtgctgcagagtattttcaatccctgggtgtccctccagaacatttcttgattttcaaagggagtaagacagcaccggcacacttcaatttcagtaaaccacaatggaccctgcatgatttgggttcacacatgatccgggagtactcatacttaaaccatgaaaaaacggctgcaatgcaaacattggctgatctcatcatctttttcagtaagcaacgattcaacttgacggttacaaattatgacttggtggtaaagagtttggaagatagcatagaaaagcatcgctcaaaaattatactcggaagggatctttattttttcagtgtcatcggatgtgttggaatctgtgcttcaataattctgatcacaattcttcttgatttcctgaacagatcagccagtaaaagctacctgaaaactctatgttgggggatcagagtagtccaaatattactgagtatactgtgcttgtacggagtttcagctggaattgtttatacagctctctttactcaagcaattgaaagcgttgacaatgattcattttcagaattgagcagattattgaattcgttggagcttacggccaagttcaaagtgttgaaaggattcacgaattggttcgatttcttattcttccggctgcttagcaccgtattttcctttgtcattccaaccttggctttcatttactttctgcaatgcgaattccacgatttgcaagttcggttgaattacaaaatgatcgacaaatacagctattacgtccacaaggaggcggccagaagccttcttagacacgatttaagagccatggacaaagaagatgatgattatgataatcgccaaatatacttataccaagacaaacagaaacggtttcttccagtgtggatatacttgaaaaatcctaaacagtaccaaaggatcatcaatgaattttctaaagaccgtgaaaaacatccaatttacaccgaaatgcaattggaaaaaaatatcctcaattatagagtgttagccgcagactacaaactaaaacctggagaagatatcaggagtctgccatgctaacagtatcggccatctcttactatttgtcactgagaactaaatatttgtatagtaccccatagatacatgattgtcgcgcctttggatggtttgtactgagattcttaagaactctggttcctacttccaagtcctttggtatgaacgaggctgagccactagacaaaacttccctgaatgaagacaagattcaggattccctgttttccaatgagaacccaacaacacttactggatctgaggaaatcctgttgaaagaaactgaggatgcggagatcgacctcaatctgatcgcaagatttaaacatgcctgtgtcattggtgacctgaaaaccgtgcaagatattctggagaatggattactgtcggtggatgaacttgacgacgaaaacttgacaggacttcactgggctggcttgaacaatcggtattctgtctgcaaatatctgatcgagaaaggcgctgatctttctctcgtgggtggtgaattgtctgcaactccgttacattttgcagctcaaagaggtcatgtgtacattgcagacctcatgctttcacatggtgctaacgtaaccgctaaagactctcaaggtgccgatatcctacaggccgcagttctttcgggtaatgttcttctggttatatacttgctgaacactcaagatcaatgtaacatcaatactcacgataagaatttgctaactcctttgcattgggcaagttatagaggtgatgctttgacggtggacatcttgttgaaacacggagctgatgtgacaatggttgataataaaggattcacgcctttatactgggctttgactaggccagatattagaatcataaagattctggtagcatatggctcgagtcttcatgttgagaccttggaaggacagaaaaatgccttcaagattgcccaagaaatggaaactgaaagcttactgctagctgccttaaagcttaacgaccagaacccagatgggtctccaacaaaacactatcttacggaaaaacaagccaagagcataacattttttacgccgtatctagtcctatttgccgctttacacctggttaagttccagtccagtctttggttgctcaatctggctatattggttgttgttgcgtttgctgcagtcaaacttcttaacgtatttgcgtttccagtctatctacgagtccatggccctcttttgaagtcaccttatcttgcaggaacattttcagccaccgctttttgggctatctttacttggctagttcgcattctaccgtttactctctttgagagttttgttatcaacgtcatatttgcagcaatgtccggcttaatgattttgacattctataagaccttgatgttaaatcctggatacgtcccattgcccttggaaaagtcggaaatcaagaaaacgatcgaagatcttctagagctacacaaatatgacactcgccatttttgcatcaagagtttcattcgtaagccaaaaaggagttgctactcagagtttcaaaaacgaactgtggccagatatgatcatttctgtccttgggtatttaacgatattggggtcagaaaccataagccttttattgccttttcagtctctcttcaagtggccattctatgtttcataatcttgaccatagagtacttcgatgaaatgaagcttacgaacgagaaagaaatcaaacatagctgctcgtttcttggagaagatctttgtaaaggttatcgtggagctccttttacttttaacgtattggtttgggtgacctttcaatttatttggttgtctatggttaacattgttcagttcatccaaattttcaagggattaactactgaagaggcaaaaaacttcagtaacccagacagaatgaacaagccatgggagaactttggttcagtccctcccgaattttggaatgacggtagcactttggaccccttagaagtggaaggaccggactttgaaaatagtcatgaagcttgtcaatctcccatggaaagaattaaaggagggttcaacaaatgctttaaattggttggtatagaccaattactaggaatggccagagaggtggtaaagaatactcaccgtcaaaggtacactgactttggatggaaacagaacatgattgacttttggtttttgcgagatgaggatgaaggattgtcaatggaaaccctatttcgaattccaatcaaaggtgagggaaatctgaatggtaaactggttgattattataccctatgggagcttccaggagaaaacagtgaacccgtgtaggtatataggagttccttacagccggcccaatctcattacatacttttacttcatctgaatgtttctatctataacctcctcgaaaattaaatttataagtaacagccgatacacttccttaatagaagatcctacaatgatagggaggagagtattgggtcaggtacccaatgaaggggaattatcacctacggccagtcctaacggtgctgaatcccttagctgtcccatatgtaatgaaaatatgatcaacttgggtcaactcaaccaacatctggacgatactcatacgaacaatgatccctcagaatccgttaatataggaccgtatttagagaaagatttgaaaaattggttcaggacaaaagttgttgatagagcgaacagtcttcatccactgatcagctctaaattgaatactatggatgttgtggataatatgggatacttcacaataagtgatagtgccacaagttcagctcccaactcgacaacgaattctagaattagctctcctggcttggagacaagcgaaatatctaggtcgcattggaagaagcctaaaggtaatgacttttgtcatttgaaagaatgtaagagaagactcaatattaagaatggcatagtcaattgcaggaaatgtggctttttgttctgtaatgagcatacctactatagaataaaggtaaatcaaaccctgcagtatgatccattaggcgggcagtttgtgagatgttgtatcacttgctttacgaataagccgttctttaataacttcgaaggattcgctcttgatgataccaaaactttccaggagctgagagaaaagagactggaatctgatagattaaaaacaatagtcttggaaaaacgactacgaaagatatttgcatttgtgtatgatagggataatccatccaaggtaaacaacagtgaagtgacaaactatgtgaagcaaatcatccattggcagactgataatgaactgaacaattgtccgctatgctttaaacagtttggaagatttcttatgagaaaacaccactgtagattatgcggtgaaattcgatgtgacgacggttgctctctagatattcccatgaattatctgaaacaattgtttgatcaatccccggaaactaatgaacagtatgaccaaaatcaccccaccgaagacgacacgatagtgtttgataaggtatccttaagaatttgcaagttatgcaagaatagagtgttccataggcggctattcactcagaatagatcatcaagtacaggcatagatgacctattgagtaccattcgcctggtaaatatatataaggaaaaaatccaccaacttcttcctggttttgaagaagatcttcagcgattacaaaccattgactcagcctccaattccaatcaaatattgcctaccaaggagctggaggatgatgaacagtttctgaaaatgttggttgagaaacgatacaagatcatgagtgtcttcaacaagattgataaaatagccaagggtttaaaactgaccatcgaccagaatgatacacttctctccctaaaaaagccgctagctgagggaatgaccatcgatcaattaaaaattgcaagatcgatatacatgcagctggcctccttccttcaagagaatatgttgaagcttcaaaaagttcctaatctgacaaacaaacccagcaccgaaaacgaaggtttgagtaagctagaaattagagagtacagggacaaattgatggtacttcaagaacagcactatttaatcaattcaatgatagatgattcgaagaagaaaaggaagtttgacgatctgaagattctagacgaaaacttagcagacattgagacagagattcaaacaatttcaagaaaactaggagacgattcattttagatggcgtatagataacattatgggacctacaaactttgtgcattatttatttcagcctgctgatcctgattcatctgctgtatgacgggctcaaagatgaagtttgggttgtactcccagctattaatattggacaagaagtctggaaaaatttcgttagtaggtcgttgctctccttgattaatactttgattgtagacgttggggtaatttatatccacaggattcccattcgtgttgttttttgggttcctgttcccattttcatactcgcctgatggtgggagaccgaacgactgtctattcgaattggcttcagtgtagggcgtaaaatgatatctttgattggccaaatcactattcatagttgttgacaaataacttaaatcgttgtaactactgttggcagtgctattgatcttgttaaactggctcccattaaatgaaaagacattatcacctgatgatgcgtttgtagtgtcagatggttcagggatcaaaaattcgttcagggaaggggttattgtaggaccttgcctggggtttagcaccaacttcacattgtcttggttttccagtttgatagatgctgtttcactgctgttactggaatcatttatatcatcgtccaacaaagttaaatcgactgttgttctgtttggaagcccaatctgctcaaaaagtttgtgaatgtttcttagcttaatgaaattatctttcgcaacatgattaccacaatttgccatatacttgagtagttcaacacctttatccaactgactgtatgatttaccggtgaaaatagccatcattaatattaggacggaagagaagcagaaatgagtgtcccagtagtcaaaaatgggcaatccttcaatctttcgtagttggtacagcaggtcaatggagtggcatgctgctaagatacaccgagatgtaatctgtcttgtttgctctgtttcaaccaagtactttttgaaaattacaagtacaaggggtctggtggtggtaataatgtactgattgaacttcaaaaaaagatgaatcaaaggtctttttgtatcattattgttactggcaatatccctgttcaactgaatgaagtcttccttcaaatttctttcaaaatgctcttccagaagctttaaacaagctagagtgttgtttatgatatcctctgtggtctctcggtgtagcatgacagtgttcttatctccaaagtaagacctcttcgaatgattgtagatgagagaaagaatcttaccggcaaatttgcctagctgcacttgcctctgcaatatcgtgccatcaaatccatcacctaggtcaaggaaattctccgtaggtaattcaatgtcagtttgatcaaaagttatatgctgcggtaatcgtactctggaggtcgcaaaagaatccagtatgaatgttgtccaccatactcgtttccttttctcattgtaaatgacatcattattggtggtgttaacatacttcgtatgaaggccaagaactaaacacaacctcgtggctaatcctaagtaggcatatgatgtagtgattctgtttagggattgtgagtaataggcaatcaaaaggcaattctggatattcgtcaaacttggatcttcttcaatgtagtttgagatttccattgcctgtttgaaaaacctcagacctggggtgttggaatctagattgttctgttgaaaatataattgcttattgatgacaaaatctgggtctttattggaaaccaacgaataataaatctgctctccaattgacaatgaaagcaatagttgcacaagaagtaactggttgtccgtggcaccatcttcatagagcttgtaaaaatgggggacaaaaattgaatggtcgaagcagtatagttgttgactttgaaagaaatccaaacagagttgggaaattttcagtgcataagcttgggacggcagaattaaagaagtctggttatcaataggtttcttgaactgagaatctggcaggtagtacttgctgtgagatttcaagaactttgaaaccttattattcgactttgcattaccgtcattatcgccaaatgaaagagaaatggcagaatctagtttcatggacaaatcttcaaactctttgccagaatctgcagaaagcgtatcgctttggttattctttcttcgttgttctgctccgatgaatgggatcgacggagtgctgcgagcctgcaggtattgcatctcagtctcatcatcagtcttgctgtccacatcactcttgattgagggattgtaaacggaatcaccattcaggttagagtccgggatcctatcacgccgttccaattccctcttgatctgaatgctattgctatctggttctttgacgaggtcaactatcactgtttctaaatatttgattcgatccgtcaacttgtcaagttgcgactccaagatgataacctttctgtctttattgggatagctacattctgagccctttctggccatgatacagtttgaacaacttggtttgtcacctgaacatttgattttttgagctttgcaacgaaggcaggcgtaatgtaaacgaccgataacacccaccggtgtggtgtcaatctgctccttcaattttattctctgcacagggaaaccttgggccatagtttcagttcttttccatcagtgagtaggagcaaaaaatgtggttttttcgttactattatcttcgaatcccaactgatgctgtccaatgtggggactagccaggcaagtcatctagatatgtggtgttaagatcttttttcgggtgtttgctgtgcatatggggagtcgtgcgcagtcggatttcaactttaatctcacttgatgtttagtgggaatgcgcatttggcagtaaaccggcatttgtaaaacctcactagactgccaattttgcgtgattaaaatgactctggaatctttaatatcctctggcgtggaactgattgagcaaggaaattatctaaaggcaattgatcagttttcccgtgccttgcagctttctgattcctcctttaaggcttacctaaaccgatcaattgcttaccaaagaagtcaaaagcttgatctggcattgaaggatgttgatcaggcaattcacattgcgaaggacctgagacaatcccaagaatatatctctgcatcttacttcagaaaggccataatattgtatctattgaagaattatgctgagagctatcagaatattctgttggcacaaaagtatcattgttctgacataacatttccttcctggaaatccaaaattgaggcaaaattggactcagagaaatccaagcccgttcaatcagtacctgactccagcaaagctgaaaagccttctgcaaatgaaaagccattgcaaccaactaccccttccattgcatctaaaccaagaatcgattggtatcagaactctacagaggtcaatatctccatttttgtcaaaaaaatagacaagtcatcactaaaggttgattttgctaaggattccttagaagtttcttttcctttgcctgattctggagaggattacacctacaaaattgaaaagttgtttgcaaagatcgacccatctcaatcatcatatactgtgtttggtacaaaactagaattaaccttacaaaagattgaaccaattcaatggaattcaattgagtttgaccagcaacgacaaccatcaaccacccatgaagagtcgactctcgcctacccttcctcctctaagaaaaagattgattggtcgaaactcggagatgacgaagacgaagctaaagatgatcaatctccggatgctttcttccagcaattatacaagaatgcagacgatgacagtaaaaaggcaatgatgaagtccttcattgaaagtggcggtaaatctctttcaactaattgggataatgtcgaaaataaggacttttccgccgaagcagaaccataatccatatttctaaaatgtttctaagtccatattccatgctgggagtttgttctcagtgtctagttcgtcttcactggagagataaactggggtttggtctttaaatctctccggagagctgaagacgtttacatttttggacactaccagttggggtttcctcacctttaaaacatgttttggcttccccattctatttgctcccctggaattgacattaatattaatgggccttaacggtcctggcccttgcctcgctccaggttgctttgacttgtaactatctttcaaattcaatagttttccattggtattatgatgagttctaaaaactcctagtgtagaatttgagcgtatgactttattcctggtcggcgtggttgctgtgcttgagtttcttctgttcccgtcacctgatctggaggatgaaggtgctgatttgttcagtctcctcgagggagttctctttatgcgactcttgaaaaactttgattctagttcgttgattgtttcccaaacatctacaccatcaacgattatgctttttccagcctcttgtttatagttctctaattgcggttttaacacctccaaaagtagaggtatatgcttggtgattcttgtccgtatttgctcttcccttttcaaaatcttgaacgaatctcttgataacaacctggaagaatctttacagctttcttctaattcccgcttttctttgaccaactctttcagtctctcgacattgttcagtatcggtttcaactgttcaaccttgacgtttaggttttcactaatgtacagttgatgtttattcaaaaggtcctcgtcaagacgtgtgctctctgacacaaagtactctggacactcgttcctcttttcctcctgagtgtacatcaacaaattccagtaactttcaatttcttttcgaagaatactgataaatttagccgcattcttcagtttcagttcgttcaatcgttccaactcgtgttgatagttttctatactcgattgatggatgttattattcgaaagtaaaaactcagtaatatagttggcatcaacttcagtgtccagttttgcccaaaggctttggcattgtgacttcagttcagcaagctttttttctcttacatctttttccttcaagaccaatttcagattgcattctaattcttcaaagtccgatagtaacagatgtgaaatagttgaatcgttgaaaaatgcttgaataattaaaagggatgatactgacaagtcttctttcagtaacgaagttacttcgggaagtttctcatgtagaattgtggacctgatggatactagattttgaatcaatgagtcatctggaatatatccgtttaagacctcaaatgttgacatgtattttgacagtttgttctgaaagagatctttgattttatcggtggcatttccaattagtgccttgatttcgaaattgagattagccaacagaggaatgctcatgtgcttgaagtttgtatcctcaataatataatcgacagtgttcatatccagattcccgtttttttcttgaatcatcattgtgtcctgcttgctgggtagttttgaaaggtatttttcttcaaattctttactgcatggcaaatagtccagcaacttgtaaaaaataagtagtctagagtcgaacttttggatttgctgcaaaaactcgggcagaatctctgaataaacaaggtctattttgtctcgtaagtcataaagtgtttttttgggggccaacaactgtcgaaggtcaatctcctcatgaggatgttcattgtgttttttgttgaaatctagaatgaacttggtggtaagaagatcagagttccacacaaactcctttgtattagaaagctggcagttcttgattatgttgtagattttggctgtgtttttgagcttaacgttgagttcatagtttatttgtttgatgatagtttctgtgttggagatgagattctggatggtatttgttatggtctgctcgtctttgcagtcgttggaatccgttccaagggattcccggagcgactttagccgtaccaagtctggcttcaaccgagatagaaaggagtctatattggtagggtccatgtcattaggggaattagttgaaaaggtaagtttagttggctagctggcgatgttatcgtttgtttatattatttctcgaacgggaaataaataaacacaaatgttgggacgagaagcgatgggcagcgtagcagggggaggtggtgctacggcctggcgtacatgcagaaagggccccactaggtcaaaaatactattcgatacatttaccaggatttcgtcgtaggcgagccttcaggggaaacataataatcatgggtacctcagtaccttttgattttcagcatctctgcctccctaccaaagaccgaatcccgtgctcgctgcattgttaatattaatcatcgattaccaatcaccctaactcatacatcctctaacctagcaagccacaatatttcgacactatttaaagagattgattcctccattgaatcgaagtagactggtgcacaacatgactacaattcccaaaacccaaaaagttattctctttgaggagacatctcaggacctgagtgttcttcagtacaaagattttccggtacctgaaatctccgccgatgaaattctcatcaagaataagtacgctggagtcaatttcattgaagcatactttagaagtggattatatccatcaaagactccctatgtcctcggaagagaagcatccggcgtagttgtcgccaaaggtgacaatgtcaccaagtttaaagttggtgataaggtagcctatctatcgcctagcacttttgcgcaatacaccaaagtcgatggaactacaggtatcaggattctgaaattgaaagacgatgcttccgaagaagatttgaaattatttgggtccgtcttggttcaagccctgacagcgttgacttttgtatatgaaccctacaacgtcaagagcggcgattttattctcatacatgctgcagcaggtggtgttggtcaattgttgacccagcttgccgcttccaaaggcgcaaaagtaattgctactgcttctactgatgctaagttgcaaattgccaaggagctgggtgctagctttttgattaactcttctactgaggatatagtagagaaagttaaggagtttaccaatggagttggtgtaaatgctgtgtacgacggaattggaaaggctacatttgaggcctccttcgaatctttagctccgaaaggaacgtttgtcagtttcggtaatgctagtggcgccgtccctcctttctcgattagcagattagcccccaagaacattgccatactaagacctcaattatttggatacactaataccccagaaacctgggaaaagtactccaaagaattgctaggcctgctttctgacggtaaacttaaattctccattacaaaggtttattctttgaaagactacccgaaagctgctcaagaattggagagtagagctaccaccggtaaattgactctcgagatccctcaatgagcagatcgtaagtgtcgcggcctagctagcctgcccagccacaaatagctgctactaaactatttagctggacttaaataggtaatttatttgttaggtaatgagattatcgtatgaatgtctgttttctgtgttcttggttttggcataccatttaaagggcaccaaagccactcctccggcatgtgtatttgaatgtgtttcggtagtctctaattcatgccctaaacgtgaaacagacactgaatgtctttgtgctcagaaggattctattattggatgcctcgttgacatatgcaagcccctagatttctcgggtgccagagatcatatcaacgaaacatgtttgaacctgaaggaagggaatcaacatcgagaaaagtgtcagttgagtcatgagcatgacgattcgtgtgggggtaatttgtgggattgtgagttgaatcataagcataacaatacatgtgccaggaataatccatggaattgtgatttggagcaccaacataatgagttttgtgggaaaaaagacccacaatgtgaactgaacgaagatggaatttgtagaaataattctacctatacagaaaacaatcttgaagtctcattacagcttgaagactggaactcagatcccgataatgaaagtcttgaggatgtctccgaagattcaagttccgatgaggaatccacttgttctgatgaagcagattccgattgtgattctgagtatgatccgtatgaatatgaaccctatggatacagaaagagagatatggacaagcccatatctaagagcgaaagaccattactcaccaggagcaaaaagcaacttgataagcaactgaggccttctgcaaaagcagctcatgccaacccaatatatcccttcaaagacaagatacctatccaatcgctaccaaaactcaataaactcaattctgtttcaaacagtgttgaaaactcccttgaatctctcctttagagaattaattttgtatgtcataggtatcagtcatagtaattgctttctaaaatcctttaagtgttcgacaaattttgtgagagctccagctagagcggaattgcgaatggttctctttggtattaaagaactgaactccttcatattctgtttagagtaagggctcaatctgaatgacaaataagctatgaatgtgctcaactcttccttattttcacatacttcataccataagtcatttttacgagtgagagattctgtcactatcactgtagaagcccaaatgttttccacacgcactgcggccggaagcttggtatacattttgaaatggcctgcactttttgcaagataaaaggttccaactgtgcctaatcttaaaatctcaaattgttggacagggtcaaaatcatcaccaaaattctttcctgcagccaactgagccaaagaagttagcaatttaagccgctcattggcagacaagtcatcaagtccctggttgagaaaaggtttatccaggttgaagccattcagttccaaaccagaaactgagatcctttctgataataattgaaagtactttgaatagtcacctgagtcaagggtactttgtggcatatccaatatcgaacccacaagaactccatatacaattttcattgtttcactggcatttcccagaggatacgattgtgcgagagatagttgtgcaatattcgcaagtgaagaaggttcatccactgttagtttgttgttgagttgtaacccggcttcaaagtcctgtggactcaacggcagatcaggacgtatttgctttatcactccactaatatatagaatgtctctggcaatacttgtgggccgtattgggtaacctagtgcaatgggatgatgctctaagccactttccactgattcggcgatcgataatatagcaggatcccatggattgagattaagatcttctttggtacccaaatgaaaagaagatttggtagctctgttcttgctgccttttggtctacctcttagcttcttcacaaccggagtgactgatatccccatttcaagaagtcttttcttacttggacctcttcctcttttgggagcatcatctcgagcagttgtaattcctcttgtgacaatggaattataatcttctaaaataatgcgaggatgattagcaggatctgaaggtataaattcctccgtattcttcgatgtgtcacttttgtctttgtaattttcgtttctatcatcaatcacagttacaatttctcttgatgaggggttctcaaatattgtcttgaatcctttcagttgatgatttgttcttctgtctctgatcagctgaggatttttaccaccccttagcctgaccttgcccccacgagaaccaggcccaataacaggtagagagtcgagacgaaacttagagataatggactcgctatagttatgatctgaggagctttccagtggagatgatacactagaaagattgggtctatttatcgattgatctttggaagttcctggatccattgaaacaaaatcaagatggctatcatttgactccgcatcatatcgactggggatcggtatatcattttttacatcattgaaggggcccggagtacgttcagtgacattggacgaaccattgagtgctttgagagccaattctgtcgttgtcattggttgatgcaaatttgaaggtaaggtcactatgtttgaaggttcttggctatcttgatgccgttgttgttggttatgttgttgttcggcttgctgatgtgctacggcttgctcaatgaaggaggcataatcatcaggcctgccaggcgatccagcagccgccgcagccattgctgctagctgtatttgttcagcctctgattgattgagaccaacctctgttaccttggggtctatttctggatccaagggcatggagtcagctgaattaattggggaaaaaagccaaaaggagtaactagtaaaagtcgattaaagaagaaaaaacaggcttccaattcaggggacggggaaatgaaagatgtctacagtagcaccccgcctagggtattccatctgccttcggagtaatgagactcaccttccaatcactaattcgcgggcttaggataccttcccagcaccacatgagaacgtgaagaaatttgttcataaccattacctgatataaaaaagaggaagatggatcacctctcctccacaaaacaatttatagacgaggcgttaaaaacagccgaacagggaacactacccaagggagaatccggtcatatttcaggtcatgactcggatcatctcctcgttcccgagcatatgaatcttcaccaatttcttcctatgggcgatgttggtgaagaagagtcgcatttgaccgctgaaaccattggatgcactcggtgtaagaagcagtttgagcaagggccccgcaagtacaagttatgtccttattgtagaaagttgcaaagggaaagatcaagacggtggcaacaaaaaacaaaagaaaaagtcggtgtttgtcggcgatgtgggataacaatggaccctggtgaatcagagcaattcgtactgtgtgggaaatgtcgtggttcgttaaggacgaagaagaggcatagagctgaagaagggagatgtgtacattgttccggcgagaacgaaaactctgcctacaaagtttgcagtaggtgtcgttctaatgataaagagagacgaattagcctggagaagaggggcctctgtaatcggtgtgctactctgttaacggatttggaaagagatcacaaagtgtgtctgaaatgtcgaaacaagaaacgatactgcaaaggcgcgggccgtaagtctctccacgagcaagttgatgtagcagaagctgcggctgttgctttggccaatggcactaaaaacttaagtccaagcaactccaacttgtcgtctaattcaggagccgcctctcttcatctgcctgatgggatgaccgttcaagagttccttctctctgctcagcaacatttgggaggtgggacaggacatctacatctattgcacccaagatctacccatgatccattaagcatgggtgatgcgaacaaagtgtgtttgaaatgtggaatcggcatttccattgatgacgtaaacaacaacgggtcttccaatttttgtggcaagtgtcttgagagtgaaagcaatttatttatgaattccgagtcatccgctcaacattgagtgaaaaaatagaagcaggttaatttcacttgcaaaattgagagattttttggtcttctgcctgtcaaaacaggtaataatgtgagacttttactatgggatatatccgttcgcgcatgcagaacctttcactgaatcggtcggtgcggagcacaaccggttatgctggatataaagctagcatggtttcccttttgtaaggcacccgaagtggtgctgctaagtgcttactaattggtttcatttacctttgtggctcctaactccttctattttgttttacgaaggatcactcttgacaatgatgaacgttaagcgaagaaatgatgcctgctattcccaaggaggcgaccatagccctctattaagctcagtcaagtccgctttttcaagagctatgcgtgaatactatttgatgtactattatatgtgtccatttgaggttatgtccacagacgaagcagtaattctgcatatcattatgacctgcttattcctactagttggctactccttggttcatctactggatctagtcgtagcattgactaggcgacttgttacacatttggtgtaacactgtatatatactattacgacttgacgagtttcacataataatacgatttaatatttatcaaaaaaaaccatctgaggccatctaagtttggaatcatgctagtaacaacttcccttcagaaaatgcgtaatcgattgcatgttcaacaggctcatcaaataaataaggtagcagaggaaccactgccaaacctatcccaacaggaccatacgtcctcaaagcgtgaatcttggaattcttgaatatataactagagtatctcaccgaggaatggattgtgaatgctggcaatcccatggatgcaatactttgaaacaggccccgcttcaccattaacactttccaatccaggaaatctggcttctctgtataaatcttggcactagtaggatcaggttcaggatagtcagatggactcgaccatggtttcaaatggctggaatattgaccattttgtttcaaattggctttccatccctcgtaagccacatctcccaggatataggaccatgagatagcatagcaggacttcaccaggtatggatgtgccactggtcggaaactttctccaatatcagaagtataggccacatatctatgagcagctagtaagattgttctcactctgtttgcataagcagcgtatcgaagtccagtgtccgtggtttccttgtcgttgttcattggaggtggcaaaataagtggatggaaataacagtaaccaataattcgaaccccagcaattgcaaacaatagatcgcgctgtaacggtgatttgaatttgtctgcttgacttcgcggactttggctatcaaaaagatgaaaatgtttggatctctctctgcctgcaaagatgagaatacaagatcaggagaacattctaattatccccaatgaaaagttaatgcaaactccagcaattatagcagtttttgtccttttattaacgattccccctagatcgagtctcatcaagaacagtgcgaatacgccgaggaaacaacccaacaatgtgccaatcaaaagatccctattggtatctggaacgtggttatttacatttacagctgctcctgcaggtgcatttgctagttgagtgttctggttcctgttgttcaaaacgttggagaattcatcgaactcattattcaccgtgctgtctatccaattatcctccaattcacgtaaatcttcattctcgccactaccgtacatgctatggaaagtgctcctcaactcatcaacgtcttgcctgctgaatccttgagacaataacctgtcaaatccaactgcggcttcttctgtgctcttgatgggctgttttgtatcccattgaccttcgtcagccagttcgtccgctgtaagtgtttcacctaccaaacagtgtataaatatctcctcattggtgtgtggaagagaatcaaaatcggtgttggctaggatcactttcccttggtaaataaacttcaagcgcttattgcttatctgattatattgactcctcacatacgatctcagctctttcagactgacctgaaagtttgatggaacctccaaatcaggcaattcatttgagaatctgatcttgattcgaagtgtcatatctattcagggattgattatagatgtgagtgtctcgcatgagctgatgccctaagatgggctctgtaattatatggtgcacgaccctatctatataagacgattggaaagaaaattttagctctttgtgcggacaaccagtacttttaccgtgttgctttgtttctaatagggctattgtcagtagttcctctagggatttaagtgtcaagtactcggagagattaatatcacatttggtcatcttaacgcccggttgttggttttgctttacatgccagcaagggatggtagaccatacatctttttatctttgattcttctagttagagattgtaagagtttgtaggagagcgacgtgttcttgattcttcttttctgtgcaatgttgctgagacaatgttgctgagaccgactgtaggatgaagaagaaccataattattggctattccaaactttgaaccgtgagttgaaaaagccgaaaaaatataaggtttcttcgttgaaggcaagcacaaacgaaatgaacaggtgagtggatcctgtaatgcggattagagagactgcacatcaatctttgtagactatagcgtagattccccttcacctatctgatgtagctacttttcactcgcctagcgcgaccaaaagaattcaaaaaaaatttaacctccttatcactttcccttccacagtaatggttcaaggtgctcaaaaactggccgtaaagaagaaggcaagggtcactaaacaacagatgaacccaagaaaggctgctccaagaattatcaaagctcgtaatcagaccaaaggaatcaaattaacccaaaaattaaacagaattcactccgcctctttagttgcccagacagaaagactagttgcttcacgtgttggtcatttggaattggtaaaaggatctcgaagacaacttgaaaaagctcaaaaggaaaaagataagaagaaaccaaatgcagctaaagccagtaagtgaagattctctgtttgatttcaaaacagactcccaaggatcaggtaagctcactgaaaagcgttctatttccggagacttggtgctcggttggacggtatcggacgaaaagtttcgcattttacccgtgattaaagcctacagcaacgatcagtttagcttgaaggacgacgacgatggaatcaaagagtctaatattttgctatcaagaagacgtcgtacttaaaagccagagtatattgtatattaaatgaatcgtatttttcattgagtggctgaacttgtagtctgccaacttgttacatcgatgcctgatatttgatttttccgcctagggagatagataccttgaggggtcctcctagtttttccctcgtaggctcccaccgggattttgcgcgacctgtcggagaatatcttgcaaccatctactcaatcaaccaaccaactacgcaccatcatgttttccctggcagtaggagcattgctactaactcaggcttttggatatagtaacccagcaatctctcagcttaatggagatcttcatagcaacaagatcagcgctgaaagtgctatactcaatctagcagattatctcgacatcgatgaagattatcgtttggaaccagatactgttctgctgcctgaattacagagatcccccattgatgatgagttggtgataataattagtggcgttgatgactatgcagacatcttacccttgcaatcatctgttgatgttggatccggtgagatttccacctttatacagttcgtcaatggtatctccaataaatttgatgaaactgtttctagattgattaagcaagacgttgctaagagagacagtgtgattaatcatgaccttaatgggttaaagcatgtgttggcatcaaacgccaatgctattttccgagtggacgctttgtctgactttgctcgcactgctggtgttgactctgagtcttataaggctgccaaggaagccattaccaatgttctccgttctactggcagagaagttttggttgtcaccacacccccatttgattttgctcaagagataaccaaaagggaagttaagggtaccttcaattcgttctcatgtttcaaaacccaagatgcctgtatacaaaataccaacacttgtagtaaccatggaatatgttctaaagttggggattgctacaaatgtctttgcactccaagtaaggatgccaaaggttctaccattagctggtctggtttcaactgtgcaaagaaagactacgccgtagaattcaatcttttcctttggtcaggaatcatattggtagctctgttggtagcaggagttaagttgctggtatcaattggtaacgagcctatgccaggtgttctgcttgccgccacctcagccaagaaagctaattaaataaaaaaaaataaaataggaatcagattatacacagatttatttaagagccattctattatcgacgattttagtaactttctcactgcattccaaggggccatacgatctgaagtccctagccgctttgttcaactgttgatctagctgcctcagttcttcctcattttcacattggtcttttttggccaaaagaacgtcaagctcattagtttcccagtattcgccgatgtgagcaatgtaatcatagttgagaataaatttgccgttagcctgtagcagcttgtccagtgtatttgactttgcacctttgtcgtcttcagtaggcagaggagtattccaaccttcgccatctttcaattgcactccaccatagattatcttctcaaaaagaccaagttcttttgctttcaacaaagaacccactttctttgtctgatggtcacggtatcttgacttgtaatcttgaacgctgaccttgcgtgctcctgtccaaccaattttcctcagggtttctttgtcgatcggagctggtgctggagtaaaaatgtgtagaatatcaaatgaatagggtctgtagaatccaaaatacagcaataattcaaggaacccaatctttgccacatggaaaacaaaaaagagtgattgggtaaatttgctttcctccgtaagaagttcatttaacagaagatcagcaaaatcatcgtaatgaagtagcttggcaatataagcaccagctttaagagcttggctagtcaaactaatacctggtgtaggagaaataaaatcgggcaaatcggtgtacagccaaagcaagaatattgattgaatcaccaaaaaagcagtagaattaaactcccatttgggaacaatcaattgtcctggccaaaccttgtctccaatcttgtcactcagtgcaacgttgactaaatatttcttgttggtggcatcatcatcaaaaagaaggccacctgaggcagtcaaaaatccgggacttgtagatacctggaatccaattggtcttaagttttggaaacaagtgggagccaaagtcagtgggaggctgtcaaagattttcagcagatctttgaacgtagaattagtggaaacttgaaagcaataatctttatcttcttcgtcattcattcggatgaaaatctcgaccaatccttccacttcggtttcctcaagattgttaatgatatcttcgtcttctgtgctcattctgggttaaactgatgggaatatacgggactgtactgttgtgcaacacagaaagtagaggggggcgggataataaacgttggggagatgtccttgggtggagcgatggctttcacgaaagtttggggaagattctcgcgcaatatcattcaactgaagcttcttgcaaaaaaccaagcaccaagcatgggatcaacagagagaacaacaggagctgtgaaagaaacaaaggtctaaaggttgtcgtttgttatgcgaactcttacatatcaattgaggccgcttgttgttcctttcagttttctcattcacctccaacgtgaaccaaaccgttctcattatcactgttgtatttttttcgttttttggtcctttaaacgctcctaaacaaaaaacattaaacaatgtccagcccatttcttatggcatctcgttcatctatatccattcatagttccccgctcccactgtggcttccctcactcttctattacttggagaacccctgatctccatctcgcgattattgaacccgtcggccgggtttacgtctactgcatcgtataaaatcctctgaaaaatattcagccgagaaccctatctcagtaatgacacccataaaaactgacctagaagctgatagagttactgaactggagaccttacttagaccagctgtcgagttgatagctcaacatatcaaagacactgacgagaacgataaaccaattggcccctactatcccaacccaagagacctctaccaatcattaaagcttgaagcagactttaatggtggcggaaaggacgatgagttagtaattcaaacagtcaagaaagttttagactcttcggtaaacacatggaatgcagggttcatggacaagctctatgcttccacgaacgtgatcggattagtaagtgatctcttattgagtgctttgaatacaaactctcatgttttcacagtatctcctgctgttaccataatagagaaatacactgctagacagtatgctggactttttggatttttaggacccagagctggagggttaacttttccaggtggatcctggtctaatgttacttcactccagatggcccgaagcagcttataccccgatacaaaagttaaaggtaacgggaatcatcattttgctgtatttgcatcatctcattcacattatagtgttgaaaaagcatgtatcctgttgggaattggggctgagaatttgttcaagtgtaaggtggacaaaaatggttgcatggatgtgacagatctcagagtgaatattgaaaaatccattgctgaaggttacactccgttatatatcaatgccacagctggcacaactgtttttggctcgtatgactcatttgaagatattcataagatagccaaagaatacaaatgctggttccacattgatggttcttggggtggtaatgtcattttcagtgatagggagaaacataagatgaagggaagccatttggcagactcaatcactgctaacccgcataaaatgttgggtgttccatgcacatgttcctttcttctagttccagatgtctctatattccaacaggccaactccttgaatgcaccctatttattccataataaacacgaagatgacgatgaaaattacgatttagcagatggaactatgggttgtggcagaagagcagatagcttgaaattttatctctcatggctttattatggttctgaaggttataaggaaagggtagatcacgccttctccattgccagatattttacttccaagattgtcaatcgtaaaggtttcaaactggtgggcagtcccgaacctgcctgtttgcaagtttgtttctactataatccaaaaaatgatttcgaaaatgggtcagaaaacacaaacgctactagatacattgccacagaattgcataaacatgggaagtttttggtagactattcgccaaaccctgatgatgttgacaaccagcatggagagttttttagagttgtttttaattctccaattctagatgacaagacgatagattccttgatagatctgatagaacagactggagaggaaatcgtttgaaatttgatgatatttacatttagacttttttatttacatgattataatactatctttcattatgagtgttcaaactgtccaatttttgcatttcttcccttggatcaaaatcaccagtgctaagcttctcgtattgttcatcgtactttccagtacttaacggtgcatttccccttatccgcttccgcatgtcaacaatacctctcttgcattctaaaaaggttgacaattgggctttgcaaagttctggtagatcttttgccttgacagggtctgtaatgcaatcttttggagtattcctctcaatcatcacacatggagacctctgaaggcatatggcaacctgcttcaactgatctttgcaactttagaacttattagtatgtgtccctaaactaagctaatcacgagcttgggagatattgcttaccttgctaccatgttgagttctggaatgaagttaggtatctggtaattcgtttcgtgagggtcagcgaaatatctatgaaaatgctgatgtaagatgaacttgacttctctggcactcaaattgtacgccttctaattagtgtataaaggttaaatttagttgcttagaataataagtagcttataactatctctctttcatgggcaagtcttaattccttgaaccctttggacataccacgtatatcatccacgggccaaacctttagtatacatccttcgcgaacgatgatcattagagggtgcccgttataattcatcactccaccaaacagacctctcggtgctcacatattgcccatgaattttctgccaggagaacctaataggtcaatagaagctgtcagaagctgcaattggaatgatgtgcccataattagctactgttcaggaaacaatctaatcattttaaccaacaattgcgcacgagttcaaacgatctatctagacaaagacccctatagtgtggatattaacaagctaaatggaaagattgcgatcactttggacaatgaattacacatatacaaacctgtgatcagcaattattttcagtataaaagatcaaagaatctggcagatcttcgtattgagtatcagcatgaactgacagtgactaacgacgaagactcctcgaggatcaatagcatatgttggagtgaccacattgacccaactgatgatgaggacagttcgaatcgatttcttgatttaccagatgatctgaacacggaaacaagctgtgaaattgttgtcggatcgatggagagccttactctgtggagattgtactataaaaataagagggatcacgcccacatgacgatttccgctaggaagctatggtttaaagttcagccgtctcctatctacctttgtaaagtatctccaagttctgatttgattgtcagctgtggtatttatgatagcttcatcaaggtctggttcagagtttcctacggaattgtgaaatctgaatttgatttaacgtatttgaacaaccaagtacatgttagtcaattacgctggaaacaggaagtcactgaagcatcgagtaaccgtgaccatatgcacacattatactccattggtgtagattccaaaatgagagtctggtctatttttgagatcgatggtattcacagcttctactactctggttcggttgatttcaaagccgaagatgaacccagttttattttaaacattgatggttccattacgaaacgaatgattgccgacctcaagagaaagaaaaagcaggtgagtgagttgctcctggaagaagatctggagctatgcatggtcatttatagtagcgggaaagccgagctttactctatggaacatttaaactctttacctgctcgccctttatccattgaaaagttacctattataaacggagggatactgaaatttggcgaaaactgtctacccaaacccttcctcctcatctacttccaagagcttactatttcttcagataacaatctcaaactagtgctgcatgacttgaataaatctactataagagacgtctctttaggcaatgattttcttttggacgttgcaagatcaacagaccagcctacatcacacactgaaaaagaaaccctagttccagttggaaagctggatcataagtttacagggcatatgaagtccattcggcgtttgatacgctcaattgatggttcgtctgttctttcaatcaccaggtttaatgagagttatctttggtatcccattcgcctttccaatggtgttactctcagtaagaaatgtacaattcgtgccaatattgtagtagcagtgattctggcgaaatcagacattgttattggcataagcgccggagaaatttctgtgtggagtactgcacttgtgccgactaagactgctaccaaactcaccagccttccaatcgatgaggacttgacacctgtcagtttctttttactaccagaattcaataggggcaataagaacctattccatattattgcaatttacgatgtaaacaatgtcaaatgctggaaatttgatctttcctcaaaagaattatccaagatcaccattgcaaacattccctttagcagccctaacaactctgaaatacatctgattcaacaaatcgatccggttggtcatagcaatcgttttacccgaacccccaaagatattttgtcgattgtggacaaagatggatatgtaaatatttttggaatcaagtttgaagaaggacgttaccattggatccgaaagttttttttccacagtaatacaccaaatatgacttatatcaaaggatcatctctccacaaagttgctattgtcaactcttcgaagaaagttctctctatttgggattgcaagaggaagtttctagaataccaagagactttcagtgaggatcttgagatcaaagatattgattggacctgtacagactatagccaaagtatactggcgatcggtttcaataaacatgtgcttctgttcacacagctaagatatgactacacaaatgagactccatcgtataagcctataaaaaacatagatttgtcatctatgacaactcatgacattggtgactctgtctggctggaagatggtacaatagcaataggatgcagcaatcaattttatgtctgtgataaaagcctggatatgaatgacgctgttactcaagacctcattggttcttataatgatgcccatgtggaagatatatttgaactttgtgcttttgtcaacggaccattgcctctgtatcatccacaatttgttattcagagtttttttttgggaaagtacacctttgtagaaaagttactagtacagatgtacaacaagctacgagaacttgatctaaatccagagttagatgcttcaattgagttgagcagaaactttgggtccgaaaagatcagtgattacgttagagaccaagagaatttttctacagataatactcctcaagtctccagaactccaagtgcggtttttgaccaaaatgatttgggagaagctactagattgaagcctgatgtcagtaaggttctactaagcaaattggtgaagtataggcttccatttcttacgggacatcaacagattactttagccagcacaattgagatccttacggatattcttgaaaagtatcaggacgttttagatcccaatggattgaggttttttctagggtacaagttgtttttgctgaacagcacaaaggttaaccaagtttacgatagtattactatgcgagacgtcaactttgctttacatagtgacaacaaagacgttttgcttaacatgatccttgatcaacaaacgaatagcaagaataaattaacttggaagcttgcagaaagattcaaactttcgtattggattcccaactccaagttgcaagagttatttgaaagcattgcaagaaacgaatttttgcagtacagcattgacaatgacggtaaaagggatccgtcgacttgctcgatattctatctagccttgagaaagaagcaaatcttgatcggactatggaagaacagtattggtcatccagaacagagtaaaatgttgagatttttgtctcagaattttaaggagcaaaggtggaaatcagctgcattaaaaaatgcttttgttttaatgagcaaacatcgttatctagatgcagctatctttttcttattgggggattccctgaaagattgtgtgaatgtccttgtcaagaaacttgaagacgttcctttggccatagcggtcgctcgagtttacgaaggtaatgaccatggtccggtactgaaagaattgttgactaatactatcctagtcagcagtgctgtcaaaggagacagatggaccacaagctgggtattttggaaactctcagatcgaaacagatctattcaagctttgattaagaactgtagtgaactgatagaggatgatcaaattctcagtgagatttcaaagagtcaacgcagtgtaacaatcaaggatacgattatagaaagggtcatggatgatcctgtcatgatgatcgtatatgatggactacgaaagaagcacattgactacttcaaggggctcaccaatatcaatcctagattggagtttgagtttattctacgagtagttgccatttacgaacgtatgggatgcgatctgatatctttgtatatcgtgaagaacttcaacttcatgaaaaggacagagatcataacgcacatcattgagaaggaccagaaggtaatcaagaacggaaataccacacatgttgacaacggacatgctcaattggaacaagctacaaagaacggaaatgttgaagtttcgcccaagattgaagaaaacaattctgccattagttcgacctctagtgaccatacgagacgtaaatctgtcgggttttccaagaaattgcaaccgcctcctactgaattccaagaacccgatatgagttctttcaattttggattttaggaggtggatgtcggatgtattatagctatcgcgtaacgcatatgggacttaagtttatccttaaaaagcgtagttaccctttaaaccaaccttgcttgttactagggccatgtcacaagactgtaagttgattgcttgttttctttcaaatgactgcttctaactgaactcagctgatccaatcctctcccgtctgcccctggtagcaatccctgggaagtacacacaaccaaaacctatcactctgccctatgagttcatcaaactaccagatcagttgaataaaaacatgttcaattctaagaaggaccggcttaagagcttggtttctgattgcaacgatttggaagaaaaattgaagcttctgacgagatctttcaacgacgatatttctgaagatcataaagggtataatccagtggcatatgaccaatgggttaaggagaccaacagcttggccccagggtattttgatgatcagcatcatttgttgcagccaaaaaagcccaagcagatccatgataacacaagtacaatggacaatttgagtcagcactttgccactactacattgagtcccaaatgaagggattggaacaatgtgctggcattcgatcgaggattaggggtaatgaacaaagcggcaggtagctgtttgaaattgcaagtcgatggaccacaagttaccgaacatctgtttctacctctcctacaccccactaatactccactcatatcttcgtgcgctacccgattttcagcatctattgtatcatatagtcatcagtattttagagggaaaaaatagcctcctttcactccattaaagcaaatgacagagcaagtttatgggtcccttggatcagggttgttagacctttcggataacctgaagttatcgattgccactagccttttttcaaaagcttgcgttttgcaagataaagatgtaactgaaacagtgttactcaagactaagagtgggttcgagttgtttgaaccaaatgccatagttcgatatctggcctcatcaagaattggattggatgctttcaagcgctctaatttgtcccattttgaagaagttgtactttataacgttttgaaatctggtaaatctttgacagaaccgcttttggagttacccccaattaatacatcatccccagaacaagtcatcttattttcctctctttacccaattaaagattcattgccaaaatctgctaatacatggatctccgaatttgcttccaaagttgagaaagctgttgctcatgctatctccataacaaagcttgagcgtgcaaaggaagaaaataccggagcttctcatgttgaagcagaatttgtgaaaccacaagatgcaagtattaagccaaagccaaatgaaaggaatatcttaatcacatcagctctgccatatgtcaacaacgttcctcacttgggcaatattgttggatctgttttaagtgctgatatctatgcccgcttttgtaaagctagaaattacaacacattgttcatttgtggtacagacgaatatggtactgctacggagacaaaagcactagaagagaacgttactccaagagagctctgcacgaagtatcacaagatccattctgatgtatacaaatggttccaaattggttttgattattttggtaggactactacagagttgcaaactgagattgctcaagatatctttatgaagctttacaataatgggtatttggaggaacaatctatgagacagttatattgtccggttcacaatggattcttagctgaccgatatgtcgagggggaatgtccaaaatgtcattatgaagatgccagaggagaccaatgtgataagtgtggtactcttttggatcctttcgaattgatcaaccctcgctgtaaacttgacaatgcttctccggaacccaagaattctgaccatatattcttatcactagataagttggaacctcctcttcgtgaatgggttgctaaagctagtgaagagggaaaatggtcgaaaaactcgagaacaatcactgactcgtggatcaaagagggactgttgcctcgttgcatcaccagagatctggtctggggtacaccagttcctctagatggttttgagaagaaagttctatacgtttggtttgacgctacaattggttatatttctatcactgccaactacaccaaacactggaaagaatggtggaaaaatccagaccacgttgatctttaccagttcatgggtaaggacaatgttccttttcatactgtcgttttcccagcctctgaaattggtactggagacaaatggaccatgttacatcatctaagcactaccgagtacttacagtatgaaggcggaaagttttcgaagtccagaggtattggagtgttcggtaacaatgctcaggattcaggtatccctccttctgtatggagatattatctggctagtattagaccagagagctctgattctcaattttcatggggagagtttgtctccaagaacaacaatgaactgcttgccaatctaggtaactttgtaaacagattgaccaaatttgttaatgcaaaatataatggtgttgtccctgactatgacgtttccaattgtgagaactatgaagttctggtgagggatgttaacgcaattttgaaacaatacttgattgacttggaaggtgttcatttaaggaagggacttgaagtcgccatgcaactttccgccagaggaaaccaattcttgcaagacaacaaactggacaactctttgtacaatgacaagcctgccaaatcagatgccgttgttgcaattggattaaatttaatttacttagtcgggagtgtcatttatccttacatgcctgagactacaactcagatcaatcaaattttgaacactgcaagcttacgcatcccagacgagtttggacttttcatcaaagcaggtcattgtatcaacaaggcccagtatttgttcaagagaattgatgagaagaaagtcgacgaatggagagctttgtacggcggtaagcaagtaaaatagataaatgaaattgatagactatataatgaagagatattagtcttattaggaactcaatagttaaaggatggaaatattacaaatttatgctaacccaacatactacgtttacgccctcttagacgaacatcttgcaaccttctggatatttctgtaaacttctttgacgccgctgcttccctgaaagtcctctcatatccttgaagtagccattcattgtacgacttggaataaatgggatgagtactgatcaatgctcgctcaagaacatacaaatcaactgcctcgtcttctgccaataaagaatacgagcttagaccaaagtctatgagcattggctcccatttatcgttatgctgatccaagatgatattggatgaggtcaaatcaccatgaactatgtttgcaagatgcaattttgcaacagcacctcccactttggacattatgtctttgacttcatcatctaaagcaatatttggctcattcctttgatcttctcgttcttcttgggatttctccttgaaccatagcatgtttttcaacgagcttgtctctccattcggtagcgttcctccaacggattccatccatatgataccattaggaccatccaccgctattaatttgggagctttgattccaagttgatatagtttatgaagcaatctggcttcactctgagttcttgaactaactatctgaagatccagtgtggggtgacggtatggttttcttggtctatactttatgataaattttgtagttggcgactggtttgactttggcagaaatggatgggtttgagtttcaaaaactattgcctccgccccttgggatatcacgttcagtggtatgttattcaaaagctcttgagctgtagttataagttgaacactcatgaccagacttttgaggtgtaccgtaccaccaagaaagacttgattgagatcaaatgagtgtttcgaggaagaaaataatatctggagaacggtgaagagcagtgcctgactggaaaagcactacagttagactgttaaatgttgagcaatttccataaaactagaaagagttgaatcaatttatcttcttgcccatccattcgtactccgtcttaatcatggccttcctaacaaaagactttatacttaccacgaataaagaggaataccccaaagctttaaaagcaaaggctcagacaaaaaaagatcaagcgaagctgctacaattggacaattggaaagaagaggtgatctccaaaactcttgatcacagatatcaaaaggaaagtcatcttttcttaactaaggaagagctgattaaattggtggaatggaaattggagaaaggtaaatttcgtcctactcttcggaaactggtgtcttctaacgacgagactgtcgtaaagcaggtcacaggaagaggatatgatatctttattgcatatattcaaggaaaagaagagtttttgacgtcagtcaagaaatctttggacgagttttgcaagttgaaaggtgttgggccagctactgccacattgattctatcactattccccagtgtaggcgacaaaaaggtagttccatttttttccgatgagtcattcatgtatttcaatgacattaaaattaaatatacactaagagagtatttggatatctacttaccaaaagttgaagctataggagaagaaaccggtattaatgacttgtctataattgaaaagttcacatggaccctcttcatgaacggcaaaactgactcaaacacctcaaactcgaaaagagcatctgaagacactgctgctccaactaaaagaaggaaataaatcattatatacaagtaatctgatagtcactcttcaattatcactgatcaagttgtgtttattatacgagattccctgagtatgtcgttcgtttggagtatagctgataggcagatatttatccaatatcatgttttggctcaatgagtacaaattggagctgatccagtacaacgacaatccaacgggtgcttgtgtggagattaccatgagaaaggcaatactaaacctggacaagttcattatcgcatccatcattgttggcctcaatgatactttctttccttgagctgagctactcctcatctgcagtgtcttgttgttccattccaagttgattagagcgaccgatcccaaaactacgggaaggatcatatacggatcgggcaccgtcaaatcatgtagccagaaaaacccttcatgaatcaaagagctatctaggggcttattaccttgctcaaaactatgccaacctgttaggtttctaaaagtccaactcaatgtcacccaaaggggcacttgaaagacaggcaaaatagcattcttccatatttgtacaccatggtcacggaacaacttcttttgtctcttccttgactccttcgctgccagaatcataattttttcatagtttaacttggtggcttcagtaggaaagaaatctatggattctctttgcagtttctgtgagatggatgcctgttgggccagcttgagtcgtaatagaggtcccatggcagtgaccagcggtcgtaagacgctttgtttttgtaatctttttcgttgcaagacggctattggaagggtgaacagtgatctcaaagtgaacgtggtgatggggatcagagcccaccatggaagtccagaatactggtgaattagttgaagatttgttgtagtaaactccaaggtttgctgaaccacttgaagggacatgcatcttctggggatgagacggacgacattgggacctatcctttgtttaaggtgtggtatcctcctaaacattgaatgttggtagtttagaggacgagcgaaaggaaattattcactgaaatttaatagtgatagagcagtgattgacattgacacggagtggttcccacacgggaaacctattagtcaagaggttgagaactttgcagcccctcccacatagcctttaagatttattattgccacccaaaacagaatagaagatgctagcactacatttataccttacatggtctattccccaattgtaaacttcacaacacatcaaaagctattaaaaatatgctcatttcacttaaaaatacattttcctattaaacccttctatcctaatgactagtcaatcacagagccatctcgtggcctataatagacaccatactgttccaaagctgctacgatatcactgggtaaccttccatcaactcgaacggcgtacagacctggctgaaatcgatctactctgagccatttagcaacccaggagtgttcattatctccaacggccaccaaaccctcaaaagatgacgatgtgcactcgttgacggtagcttgatcactgtccctcaaattcaatactgagtcgcagttaggacagccgttttgcatgaataccctaccaggcaagacaataccacagagcatacatgctctttctctcacacctttgttagtggacatctcttaacaactcggtggtgaatggtgagaggagtgaaatatggagatttcaaatggaaaatgagaaagggaagtatactcgaaaaaggtataattacaatatagtctattaaaaatcacgttaagaattaaatatgtcatgggcacctaaatacatagcaaccgtggattacaaattcttttggtgctcttcgatgaattcttcctcagaaagttccgagccataaggaatcttgaagaacttgtttctccagaaaccgtcgtcctccaagacatcgcgggaaaccagcttgtacttaccatatcttggtaagatcttagcccagataacccaatagacaccaccggcgaaaaagacaccccaggcagcaacacagtgaatccagtaaggcatatcgttgtagacgttttgaccaccagtaggaggaatgtatggggctaccaccaggtacagagaggcaagggcaaagaagaaagtcactacgattggtgacttgatgacaggagtccattctcttcttcccttacgggcttcatagtgtaaccaaagtaaaccgatggcaacaaagaagttaataatgttaagtgggtatgaaatcaagttcataacaaagttgtaagcatcacctgctggtggggcaacaattgtgatgacacagatcacccaatgctcaaacaaaccggtgaacggagagttgaaaggtctttgagaagcaaagaaagaggagaatggcaaaacaccctctcttcctaattgttgcacaatacgaccttgagagaaaataacggaaataacatttcccaaagcactcagagccacgaagacagaacaagctctctctgctgtctcaccaaaggcaattctgaaaaagtgtgcagcaataattctacctgaagacctaataacgtcaccaggtacaacagcgaaatatgcaatgttaacaaacatgtagatcacacctagagagatgacagcaattggagcagaaatcttcaaagccttaacaggatttctaacctcagaaagtgagtagttgacgttactgtaacccacgaaggcccaaatgacgttgtaaagggacatgacgataccatatccagaaggagaatcaccatcaaaggcgttgctgaaggcaccagtgggttcgaactcagaattgttgataccaccacctagtgcaacccatcctgtaaccgaaataagaagcacaatggcaactttgaagaatcctaaagtgttcatcacaaaaagaccggccttaacattcaaggtgttgatcaaaaaggcaaaagagacacatgcaataccaatacctctggcagcccattcagttggctcaacattagcagcgttcaaaatatactcaccaaacaccacagagttaccagaagcccaacctagcagaaccacatacatggcatacatacaggtgaccagaaactttgggttcttgtaaacgtactccaagtagttcttctcaccaccatttctctgcaacaatctagagggataagaaccaaactcagcataaacgtacaaaccagcaagggcgataatcataccgacaacccacaaaatcaaagtaacaccgacggaaccactcaaggttaaaatggtactggtaacagagaaaataccggtacccaaaattctgttggtgatcaggaaagcggcactgatgagaccaattcttctatcacctttatccaagacgacaagctcaccagcgttgacgctctcactgtcggtatctataggtgcaacagcattgacgtcctttgattctttattatcgagggtctcacccttggagtcgttcgaattagaactcaagctaaattttccaagacccaccattgttaacgttcaagtgaaaaaagggcaagtggggttcttttatataaaaggtacacagccagcttacgtagcgtcggattgtgtcaaaaagaaaaaatactgtcttgaaggcatcaatgatcaattgaaaactgtggcttgccaactaaaaaaaaaaaaaaaaaacttccaagacagacggcattaattcggctctaaacacaaatggcctctcagatgaagactacgatccagaaattgggccagagtaacgagaattgcaacttgcaagtacaatataaagagagtactaacgattcttcactcacttatcagctggagataattggggaatatctaaaagtgatgtcagtgattagagttttagattcgcactgcaaagcagccgctgcttttttctttttttcacgtatttttttttcttttttcctatttaagacaagtcacatggttgtggaagatgccatcagttgcccaatgaggaaccaaattgtggttcgagacaaaaagggtggcacctgaaatagagcgaactacgtgattggtaagaccacgtccaatttgacactaatttaagggccctaccacaatcgtgacaactttaattggatcaaaaacatgttgctttcgctcatgtggcgtatcaccaagactttcagtccctggacgtggcaattgtgcagctttatcaactgatccctagtttaactcaccgacaacgtagttgttgcctgtttacccagggccatcttcatagtaaacagtaacatccaacatccagatgtcgggagtccgatctacgacgcgctgcagtctacgtcaccaatttttcatcactaagcaatcccggtagctccaccagccatgcgtcatcgtccacttggagtccgtgtcgttttccactggccatgatgaagacattagtcctttggacctaagactgagcactgagcactcgccctctgattttctctgcccagtctttggctgtatggaagtttacttcataatctctcgtaaatacttcgcgctcgagaaaattctctcctgcatgaccaagcgggtatcacacacttctccacatccagtacctcaacacaaaacgttgctgcaccgggcatctctagccgtctaaattgctctctcctcctacagcgaacgacccgcctcccaccaaaaggtctcttccgcgcagacgaggttgtgtgcacgcaactctgccactatctccgcccctctctccccctctaccaacttgatcacgccttccttccaccaaaacaaaaatttgacatgacgaaactttccaacagttgaggagtaatgtttgtggtgccacaaacattccacaaacacagtaaactacaactgttcctggccaattgactcaacctcacctacctgttgcaagctgtcccgagcagctccggtggaccttctaggcccgtccccgtgccccttacacgttctaattcactcagcctctcgtcccctttcaaaattatccctaaaaaaaaaggcctcgccacgtgatataactctagaattttctccgcacgtgtcggaaacaatgagcaactataaaatatactcttttttctctattcttagtcatacaaacaaatttggaaaattacatataattccggttagcccactttgcaacttttcaagattttttctttgaaaggtttttcaacttgactctccgtttgcatttcaactttttatcctttcacattctttatcatgtcggcatttcaggactattgcatagtgtgtgacaggctgtgtgtccacaacgaaatctactgtagtgctaagtgccaggaactggactctacacctataactttacaaggaaaagacgatatccctcatgaccattacagaacaaagctggaagagaagaataacttcaactacctgtcgcccctgctgtctggcgcagtggtttccaacgacatcaaccatctcgatctaaatgacattaactccaagtccaaccaaaggagtatcaacatatcaactccctcctctaggcatgtgaatctgatatctcagtatctagcaagctctgcatctgtcaattacaagaagtggctcaacaataccaatctcataagtcattgaaatgaaatttcaaagaacactcaaaagatgaacggaaaaataaaaatcatagattgattctactcgacttctggtaaagtacaaagtcatctgctacgaagatagtttgtttgcatatatgagggtttccctcataaccctgtcgaaggagacagaaggaaatgaaaaaaatgaaaaatcgaaaaaaaaaaggttataataggataatatatataattaaatagtttacgaataaaagaaacattgcatacggattcagctacttatactttagattaattactcttgaccaaatccaacagtttcctctacagctagtgtcaacttttgtttcaagcttccataatccttgtagggcggtaagtctaccctgttgaaacaagtgtgagatttgggtaattgattagactctccagctttttcaatggtgaacctacgaggaccgtctgatccctggagatctttgaaaccgttgactggaatacgagatgttcccgttgtgaattgtagtaaacgggctttttgctccttgtcccattcagtgacacatttccagaaccattgaatcacctcatcactctcctgatatcctctatagtcggtatgtttcttccagtcttccacgtcaacatctgcgataccaccaattaacaactctaactctctttcgtcaaacacgtttattagttcttgaggaatcaattcgttgaatccgtccataaatgccttaaattgttgctcaacccgtctgtggatcttccattcagttatcaactcaacatactccatcttgttctcttcagtgacttcaatatctctaccgccttctttcaagtccacagtaacgatctctccaaatctctcatcctctgcactaaatgttaagtctaacacatcggtgatgtcattttccaatatccatttcagtgatctgtaaaattcagcatcaactccctccacgtcttgcagaattaccttcttatgcaaaatcatcttatataaagcaccaacaaagaatgcatccaggaatcttctgtggaaaattcccaatccgacaacccttccaatgaacttgaagtaattaagatgctcagggttaattccagagttggggttgatctgtaacgtgtaattgtcgtgagtagaatattcaaacaaacaatagaatgggttaaacatgtcatgagaaagtaaaagaaaaattctctggaaactcctccgtaatccagaccttcttctccgtcaaacttgatcatcaaacgcttcttcaagtcctcaggcgattgacgcataatttcttggtatgaatcctcaaagatatgtgatcgtctcaccttgatatggcattgtccaggtaagattctaagtgctggctgggatctaaagtagatcacttttcttctgaagtcacgcttgtactgcggaacattttggtctaaggacgaaggcaatcttggatcatcccaagtagtggtcttggtgttgtggtctacaaagtagactcttgcggtgttagtcagcctcatttcccatccactaggcagtggtcccaactgcgacacaggttgctgctgaacagtagtgttgggcccaacacttcggatatactgctgccttctagggtcaacccatgtggtagttcgtgtattatggtcgacaaaatatggccttccctcagccgtcaaccgctgttcccaacctggaggaagctctcccaatccgaaagtggtgtatccatttgatgccattgacagggctgtttggttgtttgaagcattgacagaaccgctactgctcaaattgccaacagtggtcgagctggagttttcccctggaagtgatctatccatgtgttgccttcgttctgcttcggtagcattaactctttggttggttctatcagcttcggattggtccaaagcgggtctagtccaagtagtagttctactgttgtgatcgacatagtaagttcttccaaagttatcagttctgcgttcccagcccggaggtaaccttccgtactggtcctcgaatgaagaatactgtctattggaggcagaaataagccctggagggttcgatcctgcatcattggcggaaggtccaggggttagcagctctgcaggaggtccatttggaggagacatgtgagaagcggctccaccctgccttcctcgacctttatgagagagagtaatgaatacctccccgcttactattaggttatcatttgatttttttaagggccttgtgagggtttccgattgactaatatcgttctctaaatcgataacatctccgatccgaaggttaatgacacccagaaacccttgatccttcttcttgaactttttctggtcaaaaatctgaatagcaagtatcgagttctgtgtgcagttgaactcgaagctctcgttccaaaaaggatgtaacgtacgttttgcagttgaagtagattttgtttgagcaccgtcaacggtgattacagcgaatgggtctggtgaccgaaatacgtctctcttgtataacccatcggcacccaccacttgaacagtgatcttcatgggttgtaaggcggacatcacagtgtgtcgtttgtctctagcggtgaatctctttccaagtgcagtttaaaaaagaaaaagactgatctatattaactggaggattattcacctaaactcgagtaatctagtctactgatacacctgaaaggttagtaataaatcaactaaagttgagagtttgttgatttgcaagcaggggaaggaacactcgaggatttctgggagtgtgtcacagagatctctacaccagaacaggcttagaatggaatagagcgggttataaccggtaattaggcaagttaggtggagtacagggtgagcaaggatactagaccaatcggagggagtcagaaagttggaagtagagaagagtaatctattagagccatcttgggtgcaagccgtggaagcacttttgaaaaaaatagatcggtctagaatgcgtgctgtgagacaattaactcacaggcagttattggcgtctccggctggagcaaaacaagatgtaggtcgtattttttattatttaagacgattcggaagccctttgtgggtaaggattctgatatgaattttttggaaatttcttcaaatttcaattgtgaaattccagtagttatatataaatgattgagaattgctcaactctccagtccttgagttggtgaaacagtgaaatccgtaaaaactaacaataaaaaaattatatacataacatattatagtgggaccttttattcaccttttagccaccatgacacaatccaccaatgtttcatatttataacttgcctaaccactgataaattgccctatagtacaacattctctatgttgttttccaattcatcacgtcagagaactttggggtaaagcttaatctcgcgaaaacctccccaagagatggctggataatgatcaccagaccactttgttaccagccattacatccagccattcacctcttatattaatagccactctttacaaaaagtatgtaggagaaataattttgttttccccccttacagctaccgattatgagcaagacgttccatgacaagcaaagttatcttgacaattggacttttcaaaacccaagttcagactctctgggttcaagcagctcagagtcgttgctagatagagcatgctccacaggcaatttaaaacttctttccaattactggaaagttcccagttcagatgataactacaattatttgactgcttttgatgtgcacaatgataagcccactgtcgctatcgcttcaggtttgggaaactccaatcttttgatcggaagtatgaaggagaatactggaatatcttccaaatatcatctaaaccaccaccagtcaatcactttacccaacatccactcattgaaatggttaaacaatagctcaccaggcgattttgacttccttttatcgggccatgtcagtggatatgtgaaccttactattatccccgacaaagaagattgtgatttcaagtctgccgaaatcatcaagcgatttaatcacgagaaacatatgactactaaagaccagatccaatcaaatatcatctcgtccttagagctttctcccaaggcttggaaatcttgtaacttgaactccatgttcaccgtctacaaggacaaaatcttcatgtgggactgctctagatctagagctcctattttgatgaaccactctgcagggtctgcatctttgcacccatcacctttcagggatggaattttaggtgttgctggaaagtttgggatagctctcaacgacctaaggattggcaaagacagtaacccttcatactttgtgcccaaaatcgcagatagacagattccagaatcccagttggtcaagtggtctgatacagactctaacatccttgcttcttctcatggaaatgttgtcatgctgtgggacgtgagaatgaatgatactcaattggctatcttagaaggccacaatgacgaagtgacatctttagaatggggctctaaccaagatctttactcaggtagcaaagatggaggaatagtgcattggggtctggacctcgatctattacagcctgttacgaaacctgccacatgtaccctgaaagatggcctgagctcaattcgtctaaaacagactgaagatcgttccatagtggaagatcttgtaagttcaattaattgtggtacatttatcccggcttccaactccaatattgttgaattggctcaaattaaattgaacggaagaaaaagattattaagtattgacgattctctgtttcttggaatgcatgatacccttgaactaactgagagaatgcccgttataagcgaacaagaagaagacgaaataagttcttccaacactgtgttttcgaacccaaacacgccacaaacgtttttctcttcttcagacactctggtgtctgccaaaaacgagcagctcaactttgatttcaaggatagagctttttcaaaacctacaactaatacagaggatacgctatcgttgaagcagttacctgatctgccaaaaagtctctacacagtgcctcaacaaaaacaacgggatactctcccacaagttaactccatgatacccgaagtagtataagtatgtttctcataaacctaattatagtacaattcagattataaaaccgacttatatcctagctagagcttcgtaactagggctagtatttatataatcgtcgacgaaatactgctcaatattcttgtgtaaccagagtagtagttggttcaaagtcgtcttgaagaaatctaacgattggctatcaatctttgtctgagaaattaatgacggcaacgtgactagtaatcttaaaagatgtgttggcccgtagattgaagagtagtctagtggttctgtggatgtgttcatcaactctttcagttgtttgcgttcaaattgatacaacaaaatggatgccaatgtcgtgttgaaatagacccgtaggccttgaaagaaatcaagcgtattgtcgtagaaggcactatgtttggccactccctccaaaacgaaagattgataagtgttgcaaatatccttcactgggtgccgtgaaggaatgtcaaccaacttgttctcttttgttattctttcccaatcatcgactaaaagttcctttaaggcgactgagacagaaatttcgaacccagcatctttcgtttcctgtttcaataactccggtagtacacagtcctttatgcgcttaggtttggctttcccgttagcattcttttcctctgagctcgctgctggggttgcgattagtttagcctttaacttcggtgttacggctttttgaggttttttcagtttttgcattgtccgatttctaagatccttttgtagttgtaaattatctgtgctcagtaccagaagcctctcaacagtaacccattcgtcccatttaggcttccaacctttataatgcacatagaagcaggtctttcccataaaagcttcaggaaaattagagaatcccttcgagtctatctcttctttgccctcgggaccaacaatactcgtagaatttgcttggtgagtttttaatatctttgcctcatagagtagaggtccatgatatgccagacatttcccatttatctccaattttggcgggtttggttcctccattggaagtaaatgtgcgggtaaaatgtatgaaagagtctgtgaacgcgaccaaaaaacatgtcccttgcgtctactgtgatatttcactctatatagactttacaaccattctacataaatgcacttgtaatatacattaagtaccagacttgtgagtaatggatttatatatagttggtggtttgctgctttgaaatgacgttacgtttcggacccaagaaattaactccgtagtggaaaaacctaccagcagcaacagtatgaatgagatctctcggtagtttcagcctgttggcgagcataattattagatccatagttagatccatagttggggaacttggaatcagttagtttcttatcagtcctcttcctctgtgggagattgctaacaggagtaggtctattcttcttgggctgcgagtaaccatttaggtttgtcttcttgttggttgcccagttccaccctttcccatcattaagcctcatccaatcgtatcgaaggtctaccgatggagcttgggaggacgaggaagctggtgcaggggtaataggctctataccttccgtctcgattcgcaccacttcattcatcaacccaattaaataagcataatcaggagtatcctcaaacttaaggcttcgaacatactccatataccggcgaaattgtggtggaaaccctgcacatatttcttctaatggggtatttcttttcttctctcctatcttttcgtacttttccttgttgctgttagccttcaaaccttgccagggcaattctcctttcaaaaaataaaggaaaacgtgccccagactttccaaatcatctcttctggactgttcccttcctaaatgcgtgttgatggacatgtatcgagcggtgccactcaatgctttcttctctctatacggaatatgttttccagtgtttggatttctgtattgcttcaccattccaaagtcaaccaagtaaatcaagttatcctgacccgttccttcataatcaccaatgaggaaattgtctggtttgatatctctgtaaatcaacaaattatcatgcactaaacggattcgttcaatcatctgacgagcaatcatagctactgtcaagtttgagaactgtcttccgcaccaatcaaacaagtcctccaaggaagggcctaaaagttgaatgatcagtatgttatagagcccctcgttgccaaaataatacactttgggtattccctcatacttgaccacatccaggttctcatcgtctgtatcttgacctcccagcgaagtttgtccttgttgatatcttctatggtattcaatgcgactgttgagttgtttataggcagtaaattcatctttcagttgtggaaccttggtcttgcgagactcaaacttgattgcaacaggctgattgttccgtaatagatcataccctttgaatatgacgccaaacgaaccttctccaatcttgacgtcgattctgtagtgtgatgctacaatgtttggagattgggctgacatggtttatagttccctgcaatatcgtactctacaggggatgccgttctctctacagggtttagttgtgtttgcgcgtgtgttgtgggcccatacaactaaaacgttgtctaattaattgtcgtttgaaagattggttgtggttccaaggagggcgggttgtgctacatattcgtcgtgtattgatcatgtctacgaaagatagtggtagcgcggatatgcgagaggagctaaacctaacggccagccagagtttcaaatttcaccagtatttccgcttacgaaggccggaaaaacgttcagaagaaaataaaagaaaacttggcgcactagcgtaggaagtttcagattaatcaatttttctatctagtctatcagagtaattattgagcgggaacgctaattcctcctactctcaatgcagcggccaggtccttgatcaggtcattgacattctcgattcccacacacagtcgaaccagatcctctggaaggtctcgttcagcacgggtgtcaggatcgatcgaagcatgcgacatttggcatggtagggatataagtgagttcacacagccaaaggataccgtgatactccaaatcttgcacgcttctatgatcttgcttgaagtctcaacacttccagtctcaaaggagagaactgctcctggacccttcgccatcgacttgtgcaattcatattgaggatggtctggcaatgcaacggatctcactttgagtcctggaacggtgattaagaattgagcgatcttgattgcgttttcctgttgtctctcaatacgtaatgccaaagttttcaatcccctcaatagtagccagcaatcaaaaggcgctagaccacacccggtagaattgatcacaaagtaaagatcctgggccagtttttcactgttggtggccagcactcccgacatgatgtcatggtgaccatttaggtatttggttgcactttcgtactgaatatccactccaagatctgtcaaaggagacatcagaactggagacatcatcgtgttgtcaaagacgacgatacagttgggattgatttcatgcgcatgtgctgtgatgcttctgacgtccaccaccttaatcagtggattcgttggagattccaaaaaaatcatacgagtattctttgtaatcttttgcttcattagttcagtatccgtggtatcgtaatggttaacgataagttgttttttgttcttcaagaatgttagtaatcggtgagttccaccatagagatcgtcacctgcaatgacttcgtcacctggatccagcaacctgactatgacgtccagggcactcattccactggagacagcaaatgtcgcctttgcacccataattcgacttaaataattctgcaacgtcgttcttgtcggatttccagatcttgtatagtcataagctcccatattactaagagagtcctgcctaaacgttgcagtctggtaaaggggagggttacatgagttgtactggtcctcaaatccgagacggactaactctgtctcaatgtcgaacttttcctccatttcttcttagtcccaggagtgaagtttttgatctaagatgaaatttatgtattaatgggattataatatacgatgcgatatcttctgaacgagttatcactcattatcacgcaaaccggggtttcattacggttttgggaaatttcggcggaagtgcttgcaaaatcgggcaggatccgcgagaaaactcgtgagcttatcagggagaagtcaactttttgctaagtaccctcgagatacaccctcggttatgttcctagatacctcggatctttatgcttgtggggtttggtttggatgggatgccctggatcgtgtgccaaccagctcgatccctccttccaatcattgtgaagtaaaataatccaaaaaagtactagctagtgaagcacctttctccataaacatcatgtctctattaagattgttgcccaaggctaccaagcctctacagcagagaattgtcactgtgactcctaaaagattctctcacatgatctctgttcacagagacacccccaaggacaaccctgaaatcccatttgaattcaccaaagagaacctagagagagccaaggaaatcattgcaaaatatcctcctcaatacaagaagggagctgtgatgcccctcctagacttgggtcaacgtcaacttggattcacgtccatctctgttatgaactacgttgccaagtacttagacatgcctcctatgagagtttacgaggtcgcaacattctacaccatgtacaatagaaaacccatgggtaaatacaatgttcaagtctgtaccacgactccttgccaattgtgtggatccgatggcataatgaaggctatcactgaacatttgcaaatcaggccaggccaaacgaccccagacaaccttttcacactgcaagaagttgagtgtttgggtgcatgtgtcaatgctccaatgatcgctgttaatgatgacttttacgaggacctgactccagaaagaaccgttgagatcctcaaggggtttcaatccggcgatatccccaaacctggtccagctgacagacacagctgcgagcctcacagtggacctaaggttttgacaaacgagactccttaccatgtcaaggactttattagagacgatctgtaaatgattttagaggaatagcacgaataaaggaaaaagcaagaaaacatcaaatagaataagagaggaaggatgatgaccaagactgagaagacgaagaaacagaacgaaaagatagaaatgccagaggctagtgcaactattttatcatttatttatttattaatcattgaaagtaactcgattgactaaatacaaaattgtatggcttttagtaggaaaactgtagaatttcctttacaggatgtaataggaagtaggtcacttttttgcctgatgatacttgatctattaggggtctataacagtaatcatgatctatttttttgggagtgctgaaacaatggatatcaacttttcagtaaggatttcattggtgtcttttatacttgagtattggaacactgagaaaagaaagagaaaacccaaattattattggccaagatgtgtgaattgaacccatccgtttcatatgtttacaataaagtgtcaaaactgacgtaactaggccaaatcgttacgcatcgtgaaccatcaacggataaacctcaatctttagcatctgcctttcattcttaacacagttttgattcacacatgatcaactcgtcgtaccacggaatcatcaaaccaatttaaaaatcagctcaattgtatgaaagttctcatcccgtgcctgaaatgctctctctcttgaggttagactgactaccaaatgataacctgataagcatcaaaagattgtcgcgataaagtatcgaacccttaatagataagtgaaccaaaatagactccatggtcgctgaaaatgatcagttgacgcggctaaggccctccttcccatataaaataacatcctggatgtttcttaaacagaaaatggaagtgtcgttgaaattctctaccgtggatgatccaatatgaggagtgagaattacgtcctgtctttctatcagctctctgctaacagcaggctccttggcatagacatctaatccggcaaaagacaattttccagatctcaaacctgccaacaaatcatcctcattcacaattgtgcctcgtccaacattaatcactcgggacctatgaggaactaagtcaattatctccttattgtacaaattttcagtctcactagtaccaggaagtgacaacacaactagatcagcaacaggggcagcttccttcaaagaagcataatactttactggaaacaacaactgggcttcttgctctgaagaaagacgagttctttttacatagctgatgttcattccaatagcatgcaaccttttggcgattctggaaccaatggaaccaaatccaacaacaactgcatttttcccaaagggtgtcaaaatgggtaaagaatcacccaatctatggccaaaggcataatcagagctgtctgtcgagttcaacaccaccttacccgtctgtttatccagggaagcactttgaagaagacttctagttttgacggtgtgcccagactctctgaaattatcctcaaataccttgaagtatctgaaagattgcaaagtatggtataataccagatcagcaacctgctctgcacccaaagatggacaattgtacagcttgattccgcgtttagccagctgctcactaccccacccatcgagtccaactgaacaacttgtgacaagtttcaatgaatcaggcaatgcctgcactatatcctcggtcaacccacccactggatggaaccctaaccaagacccgtaaattgccaccactttggaaagtttcccctggagatcttccagaagagtttccttagatgttattttataatggatacactcaaactgagcagaaaactcatgaaactctggcagatccctgttaggttctccgataaacaatacttgaggcttagacatgactcttaataaaaacagggaagtaatttgcgaattgatcccctcctttatgtaattgatggtagagatctaggggaaatggcgtttattttttttcgtttccttacatcattttggtctgagatcgcataaataattttaactttgatcgtttttaacttacatatgtgatattcatttatatctactttgacttgtgtatctaatgatggtgtggttttccggatcccaaaaagttaagcttgtagacggaaccgcactcccaacatcttgcattcttctcagtggtgggcttcaaccattcgatgttatgagaatcggctgggacaccagtgcaaccaacatagcggtagtcatcataggagtcgatcaagattgggtccttcatggtaccctttctgacagcttccaaaggtgtttcgtcgaaaacttcgataccttccagtttacctagcaattcgtatctttctaaaccagtagcttgttccaaatcggtgggaactgttcctgtcttggcaccaggaccaaccaggttctcaaggccttccacctcagcaatggatgtggcagtcttgaattgctttggggtttgttgtctcaagatggaagcagtggagaacagacgagatgctggtctaacacgaggtaagcattgacgaagcactatagatgttagtaacgtgatactttaggacaaaggcctatcagattaaaagttcatgtgtgctgtcaacctgtggagcttggggtgggtgtggaacttactgataaataatttccttgtggtatcaagtgaaaggaacagttaagttgagatagcttaaacagacgaaaatcatcctatttcaaactagtgtgaatatcgcgcttcctcattggttgatgctccagcagctctgctgatgtaatatctgacgtaatcaatctgatgttcaggtgttttgactcagaggtgcaagggtgtttatttgagattctcgaactattgtgactgttgtgatgaaatataccgcgagctccacgtaattgcgagatctaaaggagtttttccttgcaaagtcttcgcgacaccttgtaaagaaaaaggttttgttcctaatagtcgcacgtccttatttttttctctctcacctccggcacctcacgacttagggcacacgcgcgttttttggcactccctccctcgattcctcacccaaaattccatcagtttgaaaaatatctttctccatcaaccaacaaccaacatgcctaaaaagagagcttccaacggtagaaacaagaagggtagaggacacgttaagtttgtcagatgtttgaactgtgccagatgtgttcctaaggacaaggccattaagcgtgtcaccatcagaaacatggttgaggctgctgccgtcagagatttgtctgaggcctctgtttacgaggagtatgctcttccaaagctttacaacaagctgcactactgtgtttcctgtgctatccacactagaattgtcagagtcagatccagaagtgacagaagaatcagagctcctcctcaaagacaaagattcagcaatgacagaagagtcaacccagctgaagctgccaagaaggctttgtaggtgtagtgtaattcgaatatgaatcatcagttattggaaactgtagagcgtgtttcttttaaagggaacctcacattgactcgtggtattgtaagctagctcagttctggattgttagacagttctaatgctggtcctaacaaatgagtttttctcgcaccttcgtaggcggcctcggtggcccccaagcactggccctcccattccgatcctcccactacacctttctctcgcacggctatcaccccatctctctaccgtgctccgcctttgcccttccacaaataatctccgccccccgcgcccaccaaggcatccaacttagcgaacgaatatttctcagacgggggagagacgttacctatcttctccagcaacgtaaactcaacacgaaagggagaatggaagaacacaactggaagttttcacaatgctttggtgacaaaggtgatgtggagacaattacagaagccgacatcatttcgacggtggaatttgaccataccggcgattttctagccaccggtgatcgaggaggccggattgtgctattcgaacggaacgagagcaagaacaactgtgaatacagattctacactgagtttcaaagccacgatgctgaatttgactatcttaagtcattggagattgaagagaagatcaacaagattaaatggctcaaaagaagcaacacgtcgaacatgctgctaagcacaaacgacaagaccatcaaactgtggaagatctttgagaagcaaataaagatggtcagtgaaaacaatctgagtgagaactctaacttaatgaacacagggaatgagacattgtcggccgccaatataagttccaagttgttgtcgatcaacaacttgaagctgcctagattgaccttacatgataccatcacttcagcacaacccaagaagatttatgccaatgctcatgcctatcatatcaattccatcagtgttaacagtgatggagagacattcatatccgcagacgatctacgtatcaacctgtggaacttgggtattgctgaccagtctttcaacattgttgatataaaaccagttaatatggaggagctcacggaggtaattaccagtgctgagttccatcctgaaaattgtaatcttttcatgtacagttcgtcgaaggggaccattaagttggctgatatgcgagtatcgtcactttgcgacaactattccaaagtttttgaagaatgcattgaccctacaaaccacaatttctttacagagatcacgtcgtctatttctgatgttaagttctcacctaacggtaagtatatcgtatcaagagactatatgacagtgaagatttgggatgttgctatggaaagcgaaccactcaagaccattaatatacatgaacagttacgtgaccgcctttgcgatacctacgaaaacgatgccatattcgataagttcgaagtccaattctctggcgacaacgactcgatcatgaccggaagttataacaacaacttcatgatttaccctaatgctgtttcatcttcgagcaagaccgtttccgaaaacgagatcgtgctacaggctgataagtcagctttcaaagccaagaaattaaacagcagacgtaaggagccgtcaaacggtctttctatgatgcgcaaggagatgcaattcgacgatatagacttcaagaagagcatcctcaacttgagctggcatccacgcgagaatagtgtcgcaattgctgctacgaacaacctctacattttctctactttgtaataagacgactccacatcatcctaccaaatatcaaccagtaaatgtaaaatcatacgctgtgaatttatcttctacttaaaataataaaaagggatcatgcttactctttgacgtgtctgttgacatctgggttccagaaaagagttttgtctccgtcaccccagaagaagtcaactcttctgacattctggtatggatacgcttttggccattcttcatcagataagtggcggttgtgggctctatgctcagcgtgctcagcttcaacgaagtaggtgtttacggcagttagggcaatggcaggaagggcaacgaagtaagagatcttcttccacaatgcagtggttcccttggagtggtgatagacatcgtccaagtgcttcttgaaagcttgagctttagctgggtcacccttgacagtggtgaaaccacggcgaccgatagaactagctgctgttctgaacatggtttgtgtttaatgtggttggtatgatagatcgcttacctatttgatgtgtggtgagatttttaaagcaactttttattggttctcacatagtggtcaaggcacgactcctactgaagcactgacataactcaaacgacccaggaagtctttctaaatgagatcttcaacgacattgttaccttctagttggtttccgattgttaaccatcccggtcttacattgtgttgcttgccaaagatttctagtttgcgtgcatgttctcccaccattttttctaccattacatataactcgtctggttttcgaccagtttctcttgttgaggctagaatgatgtcgtcgaacaaccctctttgaagccatgtgcatctgcccttgatgcccactaacagatgttcttttgagtggtttagccaatgacctgtacgtccagtacagatgtttcgtcccagttgatttgtttttacccagatcagttcgcttgatacagtgtaaccattttccagtagccaggctctcccgatgctagtagaccttactgtaacccaaagtaaaaagatgccctcgtcttgtatctgatcaactggaatcttcagtaattcagtttcattcgattcaatggaatttgtgtgaatgttccaaggaggatctgctattatcgcagcaaacttacccagtctgttgaaattaagctttcttacatcacaattgatccactgtgccggcagctgtttacacaatgtcttgctgattggttctcctttggtgtaactggctaacacttcaagtgttgggctattgggaggagggggcttattagctgctagggttggaacagtttgatagtagtgcagatatttgcaagttttcagcttatggcatgtatcaaggtacgaacagtcgcccaatttagggtctgtatgcgatttgataatcggtacaaaatggatcttggtttcaagacactttagcaactgggtctttcgacttcttttcagagattcggcacatctatcgatatcgatacctgctaaaatttctgcatgcttggattgattgcagatttcgaatgttggttcttctttggtctcttctttcattttttcgttagaaagtcttagagctcctgatggtttgcaaagcagagacattaactcgtttaattcagaatctgctggcctgtactctaacagttcattgagctgttgcaaattgctttttttacgtggttttttcttgttctccttaagatcggttgatacattcagaccaggcagattttcctccaggatttccaatgctagacagttgatgttttttattctgactgaacaattataagacttggactgatcctcaacatcagtaagtgcttctgcatagaatttgtagatatctgtatcgaattcgagtgagttcgatagtttgttgactctgattagccccgccagaaattcatgccatcgtagagtgctttggagacgaaatagactagatacgtttccttccaccggaaacctcaatagtgaatttccgtatccgagaagtaaaggcaatatcgtttccattatcaactttactgtacaaagatctataaagaattacatgggataaacagcctatatataccttgttaatttgatgtactatttgacatgatatttcaactggaaatcgatgataaccggaaaatccccaaaaaccttacgatgtcgacaaattgaacaattctagaagctatccggggtggatgtttcaccagatcaactatacaataatacggttaccccatactttcttgatagagtttagctcaacaagttcatttaaggttgcacctctacaccaactatgatttaccgaggaacacaaatatgtggagtttactgcttgaactctagtcacacatctcttgagggacaaagtaatggggttattggacttggagcagcaattggccttttatagggcatatcattgtaagttgtgtgccattgatagaagaacaacgaaattcgttactaaccgcgttgcctagtcaataaggtgaatgtagcaattcacttggtatttgtaccaaccattctcttcagcactgtggggttcttatctgccattcctttgaatcaaatcaccccatttgatttatcaggagtaccattttttggaaagttgtataacttgggtgcctttttgattgcgtcctttagcatctactacatcttgttggaccgactgggacttgtattgaccccccttttgcttttgataagctactccatcagcactctgtatgatttttatgataaaagtgaggtggtaaagggctctctggttctttttggcattggatgggctgttcaattcgtaggtcatgctctatttgaaagaagagctccggcgttgttcgacaacctggttcaggctttggtcctggctccatacttcgtcgcatttgaagttgtgtttgctcttgggttcaggaaggatctccagaaaaagatgaataaccacgcaggtaagctgatgcttgaatttcgaactagggagaagggtcaccctgtcgtcgaaaagaccgactgattgccctatttgttctatttatttaattggttatgtagtttgagtttatggctgaatgatcttcattttaccaacagtgtagctggagcctgttattgttcaatcctgtaattatcagatccaatcaaagtcgtgcattagcgaataccatcttgattccagcattgaaattgagctctgtcctcctgtcagctttgaaagaaccctgctagatttgttcattcatcacagctaatcttactttattataagcaagcaccctcctcttggtttgtggtgtttgattgttttgatttgtcagtccctttttgagataaatttttgattgtttatttccgacggactgcaacgccagattgggaaatttgaatcattctcacattttccaaccatgacttcggtatttttgggtgtttatagagccctatttgattaccaagctcaaaatgacgaagaactaactgtgcatgagaatgatctactatacgtattggaaaagtccgaaattgatgactggtggaaagttaaacaacgagttatcggagttaatgtcgaggaaccaataggtctggtacccagtacttatattgagcctgctacacctatcgggtcagctgttgcactgtatgattatgacagacaaacagaagaagaaattactttcaaggagaatgacacctttgacgtgtacgacaccgacgatcaggagtggatcttggttggcctgaacaatatccattttggtttcgtgcctgcaaactacatacaaatttctttgggtacgacggcacctgcttctaacaatccaccaatacttagtcccgccagcttccctccacctcctcaacggatcaacaactcctctgttccctctctcaaagatgctgaaccagcaagaaatctagaggacgataatgcttatgaagaggaggaagatgtacctccaccaatgccaacgcgaccaactgccactacagctacatctaatatctctgctcctcaggactctgaatccgaagaggaaccttctagtagtagcagaaggccaagtggccgttcaagggcggatgatgattttgtaaaaggagactatttcacttgggatgttcaggaaattaatggccgcaaaaagaggaaagctgtcctgggtatcggaaatggtagtatttatgtccaagcagagggacattcttctaagaaatgggatatcaggaatttgacaaatttcagtaacgaaaaaaagcacgtcttttttgactttaccaacccctcggcatcctatgaacttcatgcaggctccaaggacgcagcagatgccatcctgtcaattgttggtgatttgaaaggtgcttcttcaatgcgtgctttgaaagaggtgaaggctgcatcttctgccccaaaaaccaagactggtaaagtcagttacaacttcgatgctgaaagtcccgatgagttgtcgattagggagggtgatgttgtctacatattgaacgataaagaatcctctgagtggtggatagttcaggacgttaatactaacaagaaaggtgttgttccagctagctacatagagttgattagcgggggtggatctactttagccagcattggctcttctatttccaaaggttctaagaaagcttttggatcctccagaaaacgtaaggaaaaagagcgtaagcatttggaagagcaacgtgccgctaaaagagaaaccgaaagggaacgtcaaagacttcgatccaaggaagaaagggataggctaagaaagttagatgaaaaggaaagaaggaaaaagcaaaaagctactccacaggatgaagaccaacccgagactagcaaacctaatcctcatagagtgcgtacctggattgacagttcaggatccttcaaagttgaagcagagtatttgggagttgttgacggtaagattcatctgcataaaacaaacggtgtaaagattgccgtagcggctcctaagttgtcactagaggatttagagtatgtggaaagaatcactggaatgtcgttagaaaaatacaagccaaagccaaaatctagtggttcctattccagaccttccaaaaagccatcctctagagaatcttcaccaaaggagtccagccgctccggagttaaacaatcagttcccaagattgatcctcccaaagacccagattatgattggtttcaatttttcttgggttgcgatattgatccgaataattgtcagcgatacagtgtggttttcattaatgaacaactggatgagagtagtttgcaagacctcactccatccctactaagatcgctagggttaagagaaggtgatattttgagagttcaaaaattcttggataacaagtttggtcgaaccaaagctcaagaatctgctaccaatggtggtttatttaccaagagtgatggtacattgaagaacaataggtccactgatgttctaacaagtacagttgtaacgcgagaaactttaagtcctactaaggccgaggctaagagcaaaagaattgatgacgaagcatgggctctcaaacccgctgccgaatctagctctcaaatggatcaattctccagacctgtcagtgcaatgagcaaacaattgactggatccatacaagatctcgtcaacttgaaacctttgggggacaatgcaaacaacgcttcggtagcccacaaagctgaaacaccaaacactacccaggacaaaccttctgctcctgtcttggaacctgtgaagactggagctgcaaggggacctgtgcaagcgcaaccaacaagtggtggtttcgtcactgcacaacctactggtgctctagttgcaatgcctacaggtttcatgcccattacgatggtgcccgtaaagacaggaggaactatagctcttcaacccactggtggattcgtttcgttgcaaagaactggtggggtacttccgcaggttacagggggacttgttcccgttcagactggtgggttagtaatgcctcagacctcatttggtgtaactccaactttgcagccaacaggagggattctacctgctcagaggacaggtggattggttcctgttcaaaggacgggggggctaattcccgtccaacaaactggaagattagttcctgttcaacaaactggaggattgattcctgttcaaaggactggaggattagttcccgttcagagaactggaaacttacaacctgtacctacaacctcttttggaagtcaaccaacaggaacttttgtgcctcaatcttcctttggtaatcagttggccaccaatttgaataacccgcaaaccacattcggctctcaaccaacaggaggtttccctcagacatcatttgcacaaaatcagtttagacaatcgacaggaggtttccagcagaccccaattgtgcaacaaacagggggattcccccaatactccgctggacaacagacggtaggattccctcagaactcttttggacagcagacaggaggaattgcccaaaactcatttggacaacagacaggaggttatcaaacaggttttcaaggaaatggatcgattccaatgccccagtcctcattcggtgcttcaaatctgggattcaatggtgctacgcagcagaactacaacattggcatgggccaatctttgccagcagcttctatccctccccttcaaccctcttacacctcatcactcaatggaatgtcaaacatgcttcagaacgtaagcatctctcagcagccacaacaagcccagccaatgacgacttttggagcacctgtggcccagcctccgttacaggctcaaccaactggctttggttttggtaactcgccctatggaggtcagaacccactccaatctcagccaacaggtaaaagagccaacttatcagcagctaccgcagacaacccattcggcttctagttaggaatgtaaaccccattgaatagtatcagctcttcagtttccccgacgcatatgcttacataattttcgtttcccttgacttgcattttgcattttgtacataagatcgcgcatttttagtttacctttctctaaactttggaaacctgatctgtaaacaaacctaaactaaggctttcaacatcaatttcttattgtttgaagttatcgttttgtatggtaattaccaagaagggccaaattgattttcaattagtaaaatcatgtcacaagtagcgcctcaaagtggcactcagcccactgagcaggagaactttgacttctggattcggatggcaactgacaacaagatcacctcaacgaatagctggaattttgcgttgatagactactttcatgacttgacggttttgaaagagggaaatagcatcaattttcagaaagcttctgcgactttagacgggtgtgtgaaaatatattcttcaagagttgattccatcgctacagagacaggaaaactgctgagtggtctcacggtcaataagttgaacgaaaagcaaaatgaagagaatgattctgaatcagatgaagacccaatagagaacacgcagggtggagatgataggaacgaaaataggccaaaagccaagaaacgaaacacagcagcggtcaatacattggttgaattttccaaattacagacaaaatctatagatacagaactgactgttgatcctttatttaagaaagcgctaacggattttgatgaaggaggtgccaagtccttattgctgaacattctgaaaattgatagagattgtcgaatagttttcgataccagtagtgaacgaacaatccagacaaatgaagaaacacagccgctagatatgaactcgaatgacagcatagaaaacaaagaaattgatgtaaatctactgcggcgctttctaccagataatcttgataagcttcacctttgtccgtcagcacctgaaatcgaaaaagtactcgatgagggagcggcccctaccacactattacaaagaattgaggaagacaatgctccagatgaaaatgaggacaattgcttttcaggaccattgatggacatggatgataatttcaacgagattcccacaattgtgcacaataacatcacttcaaaatactcactcttctcagggaatgaagagtcggggcctaatatcacacttaacagactctttgatgaaaatttcgtttccagaaccgtggacagcgaagataccagcaacgttcacgaacacaacgtactggatcattttgataatatgctgcgtaaaacgtggatgggtccacaaaatttcaagatagcacagctacagttaagacatgaaagaactcctcaacctgtcaacactgggataccaacagaagattcaaatgacttgcatggtacagtgaaacgaaggaagaatgagtttaccattgattttagtactgaagatgacatcgaagatatatttgagtcttctgataaccttcttatgcccaaatcaaactggttttctgaaacacacaatttactccctgatgacaagaatttcacgactaagagaatgattcacctcttcaccaagtcagataaggtgataaatagtgccttgttccccaagaaaaagaaaatgcaacaacgatcatatgaagatgaatatcagccagcagacgaagaatattttgctagcaagtatgccgaagccaaaaacaacagagtcaaaaacttgattcaagatgatctaaaagagatccaagaatcttttgacgatcaatacgtgggcagtcctcatggagatcgccagtaccaagaaggcgaaaattttgacaacgaacctgatgactatgctgacaataactttaatgacatggatgaggccgcggaggatgacttcaaccctagtaacctttcttactccaagaaaggaggatttggttctcaattggtaacatctgtggggaggttcagaccatcgagtataaattttgcaaaagtaagcaaacgtgttgatgtgaagttgctgaaggacaatttatgggagacattaacctgggcaaagagcaatatatttcaaaaaccttctcaaccctcccaaccttctcaagagaatgatgatccagatgatgaggaggagcgggtgatttccgaggctgaaaacgaacccacccattctgaactaaaatttaccgacgtggtgaaacaaatgacacaaaaatactccaacgaggaaaagaatgagatatcaactagtttctgtttcatttgccttttacatctggcaaatgagaatggattgacaatagagaactcgggagatcaatcagacttgattataaagaactaatgacatgaatattataaatggatgcactaaataaataattactactttaccattcttgagctttatttccgtaacggcttctcttggtacctctggctgggacgattagtttggatcctccttcaaggaaagagaatctatctcttctcatctcttcgtacttgttgatgaactcctctttttggagagtgattccaatatcatccagaccattgattaagcagtgctttctgaaatcttcgacttcgaaatgttctacaagaacttccttatcggggcctaaaatctgttggtttggaagatctatggtaagtttctttccgcttgtagcaacagggtatagcttagataaaataatatcttgatcaattctgatagggagtaatccgttcttgaaggaattgttgtagaaaatatcaccaaatgatggagcaatgatagatcttataccaaaatctttcagggcccaaggagcgtgttctcgagaagaaccacatccaaagttgtctccggtaacacaaaggatgctagcagatctataaggctctacatttaaaacaaagtcagtttcaacgtctttaccctggtcatccttcacaaaacgtaattcatagaacaaaccagcttttaatcctgtacgtttgatagtctttaagaattgctttggaataattgcatccgtgtcgacgttggccttatctaatggagcagcgataccctcaacagttaaaaacttttccattgcagctgcaacagctggagctgaagtttttaggggagtttcttgaacggtgtgatcaggtggaggtatgtccttaatttcatcttcttctagttcatccttagattcaccctcagccagaggcttcttttcatgctcgtaaacagcgtcctgtaattcagcatcctcttcactttgaattgcaatcttgggttgactcttgtcttccttgtattcaaactctctgatgtcaacaaaatgaccagctataccagctgctgctgccatggcaggagacatcaaatgtgttctagatctagcaccttgacgaccttcaaagtttctgtttgaagtggaggcgcatctctcttctgggtccagaatatcaggattcattcccagacacatagagcatccggcctctctccaggaaaacccagcctcttcaaatatcttgtccaaaccctccttttcagcttgtagtttgatcaaaccagaccctggaacaaccagagctagtttaacattgtcggatttcttgtgaccttttaccactttggcagcagctcgcagatcctccaaacgagagttggtacaagatccaatgaaaaccttatcaatcttgatatcctttagtgggacattaggtgttaatcccatgtaagataaagctctttccattcccgacttcttgataggatcttcaaccttctctgggtctggcacagatgcggtaattggcagagcgtcttgaggagatgtaccccaagtgatagtaggaacaatatctttggccttgatcacgatttcatagtcaaatttagcaccttcatcagaatataaagtcttccaatagtttagagccttggtccattgctctccttttggagccagggggcgtccctcgatatacttgaaagtagtctcatctggtctgatcataccagctctggcaccggcttcaattgccatattacaaatagacattcttgcttccatagttagatcttcaattgccttaccagcgaattcaatgacactaccagtaccacctgcggtaccaatcactccaataacatgtaaaactaaatccttagaggtgataccttcgtccagctcgccctcgatggttattctcatgttctttgattttgcttgaataattgtttgagttgccagaacatgctcaacttcagaagttccaataccaaaagctagagaaccgaaggcaccatgcgtggaagtatgggagtcaccacacacaaccgtagtacctggcaaggtgaacccttgctcaggtcctacaacgtggacaataccttgacggctatctttcataccaaaataggtgacatcaaagtccttgacgttttgctctaatgtcttcacctgtaatctggagtcatcctgcttaatgaacttgtccaaggtagttaagttttttctagaatccgttggaatgttgtgatctactgtagcaagtgtgcaatctttccttctgactactctaccagcattcttaagaccttcgaaggcttgtggggaagtaacttcgtggaccaaatgacggtcgatgtataataaataagagcctgattcatctttgtgaacaacatgatcttcaaagaccttgtcgtataaggtctttggattttttatctctccagtggaaggcattatgatttgtaccgtttgtgttccctttaagaattttgacgggtcaaggatcaaatttatatagttttttctgtataggatgactaaactttgagtgctccgctaccggcccggtaccggcaaaaattaattcaaccaatgaaaaactggctcgatgtaattacgctcggctagcagttagtcgatgatatacacgaattcatgctaaataatgatatagatttctctccttggaatcacgttccatgtattctttctccaacaaagattcaattctttgcttgattagagacggcggaggactgaacctgttggccaattgttttattgtctcgttcatcaggttgttatgcgtaagggtctttcgggccttcattattctaacaatggccgcatcggtttcgaattttctatccttgttaacctctgtcagtgtagaggacctctgttggtcattttccagcttgcttgctgtagaaacagtcaacaccttgattttgatctggggcgactgaaacttctcatttatctgaaaaatatcttccggattgatttctttggacatgggtcgtttcactagtaaacgagtttttggggcaacagatatggacagtagctgccttttaagatcattctcaggaatctgtaattcttggtggatctgcgcataggtatattgggccttgtaatcggtagagaataatgcaagtataattatggcactgtacgtgggcatgttgacctcatatgttttacggccataagtcatgcgcatatcaacagtgccaaaattaggagcccagttgaactttcggttttgatgcttttgagcatagaatgctgcgtattgttccttaaggttgaatagtatctcggggaactgaacgttggtttcagtcaaaggtaatggccaaatcaagtgagttaacacgttaacatccatagaaaccttcttattgttattcaacgggagtatatcatcctgctgtaactgtacttgaaactgcttcgattcctctttagagatatttatatctctgaacatgctggacagtttacttacaaaggtctcgccagcaatgcttttgaactttgaaatcaagtttctctcaatgtcataagaattagatttgggatttagtagtcttttcgccaagtggttcttgtagtatttttcaaaaacatccttatcatggatgaagctgaaaatggccactgctttagttagaatctcttcggattcattttcagacttctcttttagtgactgtttgataaaatggtcaatgtatagggataaatactcggatatccgtttattggcattgagtatcaacgcaaacgaagcatcgatagtcttggcgatatggatgtctctgttgaaacagttttgcaaaatcctctcatacacatccctttgggttaaaatggattcaatccaaatagtcacaaagtgagtcgttgccttcttcttaggagtatcaggaccatctgcaatagttttacttgttgactcgtccaatgcttctccaaacgaaatcagtaatcgttttaaatgagttctcaatatgtgatactcttcgtctattctcccgatcaacttgtagagactattcaattcaaagacagactctgcggcaacccacttgctcaaaccctcgttctcaaatgctaaaacggcttctatattcgttgcaatcaaagctttgtccattagttctaccagcttcggcaacgttgagagtggcaagtataatgctgttctgttttgttcttcttcgatgagacgaataatattgttgatgaacaacgacccgttctgttccaacagaagttcggagctaaccttttcaaaatataacctactgtcttccaaaaaatcgggttccacatatgtgtcatagtagttacctgcctcgtctggcaatgattcaaacataaaaataatgttcttgatgagaaacttatcgacaatcttatttgacctgatttcatcaattgattgcaataagagcccaatgattttttttccaactatattatcattcggtaaaatcacgtagtccctgaacaattgtaaccctatatcatagatcagagggaggtgagcctccttgacgtatacccggtcaagatacatggcaaagtcactaatcattctcattgatagtagatgatcattccattcggtactcatattctgcaatagcacagctttgtcaattttgtcgtcttccataaactgagtcatcctcggtcgaacgtcattctcgagatgacttttgatagaattgtagatattatcgtacaagaacttcccctgttttctgagaaccaaattgtacgtttttctgtacaactcttcaaatgacaaggtggacgcattcttttggtatatctgcttgatcgcttcatctaactgttcccaggatttttcataatcaacttgacttaaaaaggcctataaggttagcacacatttcctaaatttcttcgttttgatcatgtctgcctaatacgcaccttttttggcgttcttattttactcttccgtatttcgtttccccccagcattacaactagtggcaactccaaagtggctcagttatctaggagatcaagcgatcctatcagttggaggtaaatgaaggcgcgccaacactcaatcgttgattaggtaactccagattgttcttccgtttttctacttcacctcgcaagacaaaacagacaccgctttaattatcttccaaacgccaagatgtcgtctgatatcctggatgtcctctctatttctggacgatcgaatttgtcgaatcagaagaagaaaatcaccaaagatggacctacaaaaaagaagaaacaaaccgctatgagtcgagagttgttcaatcttattggccaaaacactcctcctttagcagttgaaaagaccgttaagttcaaagaaaagctgaatgtcaataataagcctactccatggagctatgtggaatttagtaacgatgctcgtgaatccaaagatgggttgaagttgcatcattggatcaaaggttcatcagagctcgccaaaaactcgccatacttgtttgaaaaatacaatcaaaagattcaaatcccctcgtttacaaaagaggaatatgatgagtttttgaaagatcttgacttggaatgccgagagagagaaaaaagggataaggctttgaaagaacaggaagcaaaggaagctgagaaacttgagaaagagaaggaaaatgacaaggagagagtaaacggagatgaacttggaaaagaagaggacaatgcatcagattttgtacctaagaaagagaatgtaaatgaccaaatattaccaaaaattgatgaaccgcaaactaacaagaaagacgacatggaatcaactgaggatgtttcaaaatcagattctcaggaggtttcaaaggacgtcaatccttccgaagaagtagaagcatcgtgggactacgatgaaacagttcatttatttcaactctgcgaaaaatgggatctccgttggccaataattgttgatcgatatgaatatgacgagagatccatggaagagttaaaggagaggttttataaagtttccgagaggatcctacgacacaagtacaggaatgttacaatggatgataagacttcattactagttcaaactttaagctcgtttgacaaaaggagagaaacagagagaaaacaatacttgagaagactgctatccagatctcctactgagatagccgaggaagaatcgttggttatagaggcaagaaagtttgaattggctgcaaagaagatgttaactgaacgtgcttccttgttaaggctgttggactctcctcagtctactggttccatttcccagtacttaacttctcaaggccttacccaactttacaatacgttaatgtctgctgacagatctaagaggagaaaggttgaaacaccgacgcctccccagattcctccaggtgcgtcgtcctctttacaccgaacatccatggaccttaaaaggaaagctgcaaagaagattggtccgaatgccctgttggaaaatatcaaggccactggcaattcagtgcctcccagcggcaacgctccacagagcgctgctattgaacttataaacacgaagatgactccagaagaaaaagaagcatacggaattaagatccaccaagagaagcttcagcccggtgtgagcttacggtccgccagactacctacattcaagccagcaactcaagcgaaaattgttgttgtactgaatgagctagaagttagccctaagcctaccatccccacagcaaaagttgttgctcagtatgataacctattacaaacaataaatgttctactagaaactaagaagcaggtgaacaagctggaagtagagcttaaccttctcgaagggaaggaagaagataaagaatcatagcaacaactacttgatatattaaaatagaattgtcattagtataatattagtcattctatggtaggatggatggtattttaaataaactgtgtaatttctgatggtggggaaacatcgacatcaacattttgatcaagttcccctaatgcgatttctagtcttgcaaatgccatttcgcattctattttttgatcatcaataaggagttctctggtatcgaacttcatcgaatctttgctttgacttaagaggtcagatgtttctgaaatcatatcactggatgcaaatagatatgtattttcaacttgtatacgctcataaaggtactccctgcgaaccgcatactttattaaatcacaataatccttttggtcttgatatccagcgaatacacccagtaccacatgcagaatttcggcaatatatctaagcgatgaaaactcataatattggtacttggagttgcgaaagttactcaactcactaaaggagtactgcagcttgcagagacaccaaacatcaggttgtgttaatgtgcatttttgaagaattatctcgtgaaggaactccaacaataaagagactatgacccaattcaaggtcatcttgggaattaacttcacatggatacaaatcaataaagaaagaaagtaatatctcgagtttctgtaatctttgtgaggagattcgtagtttgcaaataattttttcatctttcgaagtagaccatgcatgtccgcttgccccattgaatgaattagctctttctccaagaatattattttctttaggtctgagttctgttctaaaaatgattgttcgaactccaccacgtttaaatctggggctttgattccaaatgcattcctcaaaaaacagaaacgtgaattgtacctgagttgaagagacgcctttctgttcaaaaaagatattagatcacgatgcatagaaacagttgctatatccgattcatggttagtgctgtggagttgataaatcgagtcaattaggatatccataatatcatccttgttgactttctgcaggaagacatgattcagaaatgcccgtccaaattgacttcttaaattatcaaaaacaatactggataccagaaatatgtcagcctctggtatatgtaagaagggatttatttcgttaacaaaaggaaaaagcatgctgtcatttctgggtacatgataagcaatgcatttcaaaaattcttgggaacctgtttgaaacacttctttactgtcgccgtacctcagtaaagaagtgtagaacaccaactcgtattttcgcaattcttcaactgatcctttgcatttccagtccaaataaagtagctttccagaatcaatttccaatagaacgctgatcttcacatacaattgtgtaagtaagaaatactcctctttcgtttctcctagttttaaagcctctgttatgtcgttcgaaatcaacccgtaaaacttacgtttgatccgatctctcagtttgaaagacatatcaccttcatcgtactcatcactcgaaaaatatggttctaaaaaggtcaaaaacagctcaacaccaagcgatatgaatacgtgatctggaaacaaaaatatgctttcgattgactcaattactcgataccgtaatgagttttttgttaaagaaaagtatcccttgcgaacaatggcggataactcgttgatcaaagatttgggataaacaaattttgttactcgggaagcatcagtgaatcttttgaaaaactgagaaataagatcaaaggagagcggtttcccaagagttagattatgttcagttactctcgtgatggcctgagttatcatttgaattgagttttgagttttaaagtcaaaagatgcatccagaatcgaaagccagttctgggtaaaatcaatgtgctcaccaaaaagccatgtcattgtaagcagcaaattaattctattctgaagaatctgatggttatcatgtttgatcattccaattggtacaattcgatctaatgagtttagttctaattttccaggggaggtatctttgaacaattttaaaagcctcaaatataaaaccatcgtactatctttcactaacgcctcgggactgactacttcgttaagaagctccaaatttagatcatcacagtcaaaattatcaaatttgttggcagaaatgatcttataagccacagatacaacatcaaaagtgattttccatcccttcacttggtgaagcatgtgaaattgcctcaataagttacttggagtgtctcctgaaaaccacttaaggattgcaaagcttttacatagttgaaagagtagtgaccagttttctggaagatcaagataagtcacaaaaagcagcgtaatatcactgctgatatccaaagtctcttgaggggaagaccttaggcgactgctgagagctctattaatttccatccagaatccaaagggatcatccttagttaaaatggtatgcactatctttagtgtttcaagatgagtgtcatccatcttgatatgttgatggaacttgtggatcccaaacgctattatagcttcaaagtaacattgcactattttcttgaaagttatttgcaaactgagcgtagctcctgactcggatccattaaattttgagtaaagtttgaatgtttgccaaaacaataagctcaaatatcccagggtagtaatagatccagtagttggaggaagtttgtccgccaattcagatagtcttaaaaatgtcttgagcaatggcttagtgtctgtttttgagtttgacaagtaaagagtccactctaaaagacgttttaaaccttcaacaaaacacaggtaatcgatctccatcagatgtccccgcttaacgattgacaacacagagttgatgaaagaatttatgttgctaattgaaccttctttgtctagcaaagaaagcactaaaatgttcccttggatcttaagctctaatttatcactatccggaccataataaaaggtgggttctccaatctccaaggtgcttctcattaccttggagttgagaaacaagtctgattgtcctgtattggttatatcattcaagacaataggtgccattatatccctggttggttgtggtaaatagaccacatcactgacaaaaggattcatagtaattagaggttccctattgtattcaaatctgtcatcctttacaaatttcttgagatgccctgcgctgcattctaatacagactgaccctgatttttgaaactcttagttatggctgattgcttctttcttgaattgataaaagaacgctgtttgactgtagtggtgactgaatgttgggctggaaaactttttgtcttacgtgatctacgattcgttatgcgtggtgaatgccttgaagtactgtttctactttttgttttgtttgcagtattatgtccgtttgagcttctagtcaacataaaatcaatttcaggtcgattatcctccagtacatccacattatcttgagtgttgtaatgcgtcagatccacagcaggcgttagatgatcattgtagtcattagaatccacaaatggattagtattgagctccaaatcagaattatctgaaatgtaagcatcgttgatgaaagtagatatagacggctggttagtctcagtttggtttatctttcttttcttcgagttcatttgaatactcttggtagtggctcttttgatggaatcgtgataaaatgaggttttgaaataagatgctggtagaacacctttagtcatgtcattcaagcttctgtattccctccctctgaagacagcttttggagaactatccatctgctcggtgtcagattcaaattctgaatcatttccgatcagtgagctttgatcagtttcattttgcgagtattcggagtcattctcagactctgatactaaatgttgagtaggtctttcattatttgaaagccaatcaaaaaaggttggtctttgcctgtacaactttggaaggttgtcttcacgttccattctttgatatttttgttggtacatatggtccagaatatcatttatctccttcacggattttcccccttcatatagctcgtctaattgatcaccggtcaataagtgtagtagaacactgttgtaagttgtatagatatgtgtctggctgaatttacgagatctaaatcgagaagttgaagtcgatttagctacctccggcgagcttggaacccgatgtagatctaagtcaattggctcagtatattctgatggttcatctggtgggagttcgtaagtgtcgtgttccaatgtgtttctatccctaggggcactgcaattttcttcagtggcctctaacctaggttgatttatgctgtttctatgttgtatcggagatgaagtatcaaggtttataataggtacattcaaatccacctttagtgtgtctctttggggggatcgtgtcgtggggtaatcttgtttctctttactatcgtggccatcctcttcttcatctgacgtcaatctcggtatgtcatgttgctttttatgagtatcaattgtttgaagtagttcgtaaaatcctctcgacgatttgttattagcctggtaattccgaaagtcaacgacatattggtcgaaacttgatttcttaaagggatgtcttttgacttgtttggcctcaaattttattctcattctgtcataatttctggaaagtttctgtgtaatttcttcgtcgtctagtccgtcatcctcccacttttcaaagtcctcttcggtggctagccccaacaactcggccaaatctttggtaaacacatgccgttgagagaatgtccttcttcgtaggttacgcctccttaactttggttgcgaaacatttgtgggaagctgtatcctctcaatctctatatcagaatccggaataacttccatcctccatgggtaaacaactatcgctatggtctacctgattgatataaatctgccaattgatgtgaaggaacgcgagcctttctcaattatttacatgtcttgctcacgtgatggtctctgtcctagtactatactgtcaacttaggattatatgcatatccttgcttcctcaagatctgcttcacccaccgggtcaacaacaatgtctgatacaagcaatggacagcgacatagcagtcactacagtgctaccagtgtcttggtgaatacaaagcgattggtcgagaccctgacccgctgggctaaaggtaccagcagcgccgccgatgtctctgatgcttatgttcagttaggtaatgttttcaaactggcctgccgaactttccagcaagctggtgtagatatcacgaacattggtgacattccaagagatctaagggttattttacaggctgctatatatgaggagcagtcccaacaaacattggataagtaccttccagatatcagaaagataatcacaaatttgatcacaaagttgaaggaaaaacaacaacaaatgagagagattgaagactcaaaaaatttgggtagaaatctttctgctcattcttctcagcggtctgtgtcgggacctcctgtaagcaaggcctattcccaaagaagtagcagtagcgctgacaattctccacagtcgaaggatcctttggctaaattacagaaagaagaatcccttaaaagacgagcatcaagaagattttcagcctatcagtacgccaagttagccaattttgttccagaaagagaatacccagtgccaaatcccacaggctcaaagtcgccatatcaggaattatcaaatccaaattctgcggcgagatcactttctaaatcacctgaaagtgtaaaatcgtcttctcggtttgcgtcttccaacgttccagcgttgacctctgaagtgggtcaaactaattcgccttctggtagtaagtcttctcatgcgcccgatggtgaaagagtccacatatatttgaagcttcatcaagaaactaagaaagcgaacatatccataccaacttcattgacttccttgcggcttttgttcatacaaaagttttcctattcccctggtactgatgcatttccagatatttatatagaagatcctaaagttagtgttagatacgagctggaggagagctacctcggtgatattcaagagggcaccattttgtcccttaacgttcctgatccaactactatattaattaaaggattggaagctcaactaagttcattgaagttacaagtctctgaagtgcaaacgaatgtcctttctgaagtgaaggacattgtcgctacaaacaataggaacccatcaattgctgcaactgatgattctagtagttctaaaactatggtgaatggtgctgctttaagcaatgctgatcttgacgaactggtttcaattcgtcaagacctttctaaggcaaaacaggtatactcagataacaagaacaattttaccaaaaccgttcattctcttttggaaaagctgcaacaatttcaaagcgcaaatgtgtcatcatcgcactctgccaaccgaacgatcatgataaatagccaggaacgactctcggtcgaatgtgaaacacttcttacaaaaactgatgacttgcaagatatcattgaaggtttaaggaaggacgtgtctacgagaagagccagaccttccaagaaaaatttgcagtacgtgtccaaggagattgaagaagctaaagctgatcttaaaaaggtgtctgaatatattgctaacgagaaagaaacttggaaaaagatctgggaatctgagcttaacactgtttgcgaggaacaaaagttcctcaatcttcaagaagaacttgtagaagatctgaatgaagatttagctagagcgtatgagacgttttcacttgttgaagaatgttgcgaacaattggaaaaaacaccagcatcaaaaataacacctaatctaccaattccggagcctggtgaaaatttgaacaatgtgaggactgcgttaatgtctgaagttgagctactgcagcctgaccatcaaaacagagttgaggctatagaaagagcagaaaggttaagagagaaacagaaacaattgactatggttaacgaatttcaagaagaattgggtggttttgtagaaggccaaaagttgaaaaaatccggaggaattgaagaaacagaaaagattcgtaaattgaaagatgaacagaatttaaaaggaaattacggttatctttgatttttttctatatctgtagactaccttcaatgttcaaagatctaagatattcgttacaatctttgcagaatcgtttaaccggaaatttcctgaccttattcttttttagaagaagcattatgttatcccaagcacattgaacagttttccattgagcttcgggggggttatagaagataatttttggtgaaactcggaatctgaataatgtcagcaatttcgaaaatagcttttctgaataaaatgggggcaaatttgaaattggaaaatccgtggaaatccttgaagttgtgagctcttgtaagttgattgaaactccacaatacattagttcgaacgtttgggaattatgatgggctattgtcttgtctttattcgtgaaggcattataatcagggaaaccaaggcttgctcttttgcgaacatcgtcgatcgttgtccaagatgttgagagtattaggaagtcgtctgcaaaacgcattagtagagagttctcatcgtccaatatattggcgaagtattcaaggaccaattgatcgtaaacaacgtcacaaaaggttgaagaaagcgaatggccttggaaaacacctattttcctttggtatgttccagccttactcactaatggttggtccaaactctcttttatgatctctaagagcgcagttctgtttagttttgtgactttattcctatgaattagcccatctggtgttctatctgacgataaatttacatctgtgaatagtttttgagtagagtataaccgatttggtgtttcgttgtaattgtaagaggatgacaaaaagaaagttctctcgggtagtattttttggcaacattgaagtatcttctgtcttggtaaactgtcaaaacaatttttgatatcaaattttattgcataaacttgaggtaagcattcatggtgccttaatagcttctgtttgaaagtatacactgtcttgggtatttgggaaggagatattttcaaaaagtcggggcgtaggtcctgcaatattttagaggttggtcttaaccgcgccatcatatctaggatgaaatgaatgtcacgagatgctgacgctgcaataggtctgaaatcatgtttcttgggcaaaattcttagaattgacttttggcaacttggatttggatttgttgcttgcatttttgcaaacgttttggaaaaaagagaatcggcatatggctttgatatctttcgccaaactcgtggatcatagtataatatctcagagcttgaagctctttcaacaacataaaaaaagctcgcaaccaaatttcgaagaaacgttttgaagagccactcaataaaatggaaaaaaacgttttgtttgagtcgaaactcttgtttattgcatggacgatttcctgtttggggattatttcttaaccacgttatcgaattcagtttaattctgttggcaaagtcattaactgaaaaggaatcttccttggaagacaggagaaacttcgatatattcttaaaggccatccttttgttgaatttgtcaccaaatagttccagtggaaaaattgtgtcgcaaatgacaagtacaaattttacgactttcttcttttctagtgcatagtcaaaattatctgaacatctctccctctttggtgaacatatcgagtcgtatatatacatgtacttgcagcgggaatgtttataataaattctgttgcacaactctctggccttttcaagattaggatcaaactcagatcctctgacaagcattatccttattaattgtaagggagtctccggaattggcgataacttttgcctaaaccgtagtaaatttcgcaaacgaaaagtctgagaattccttgagttcttgttcgaaggtacctcgtccagagggccaaacaattgtataaaagttgaatcatgaggcatgcaacctttgtagttgataagcaaatcaataaagagagggctccccatggactcgtggagaattctccattcacttgatttcagcacattcacttgaaagctacttgcctcgcagtaatactcagccccgaccgattctccggctttataaccaattgaaacacaatgttgtttgtttgctttgatcaattgcttgatgacataatctatgatctcgttatggctcaattgatcaagttcgttgtccagtctaacgttaatgtccactgggcaatgctccacttcaacattcaaaaatcgtttcaattggctactttgaaatcccctaagaactatatccctctcatcaagccaccttttcagcaacattagaattagcaatttttgcgtaacatatggcttgtttatcaaattggcgtcttgagaacaatctctcaacaagataggcgcgttacgtaatcgctgaaatttattatctggaatattttctgttgttacatgacgacacctacatgaaggaatctccacacaagatagactttaaagatggaatatttgataactgtttacaaaagttaattaaagatgggatagggcaggaaaatatgaatatgcaggaagtctgggttatggaaatcaacccaaaagactcctcaaaggtgaatggcatgctaagggaactgaaaaatttccatttattgcctttcctaaagaagtttcaaaaaaggacagttgaatctgaaacaggaaatagcactgtgttggatgttttgatcggagaaacttcaaaactacaatcagaggaggaagtgaatgcattgcttaaagtagacggaaaactacgaagggttaacgttccgtcaaactatccaccaacaaaggaattatgtactgagtggtcaaagatttggccaatcgtttggaagggtaacccgatagttcaagagttgaatagtatacggcttgatatccaggaaataagtgaaaacttgaggaagataagtgagctatcagtttctccacctttgaaagatgagttgccaattttcacaatggtagccgatcgaaagggcaaggtcttgactatcaaacaggatgagcgtaaaaatcatcaactccatcatagtacaatgttagcgatcagagatgttgccaaattgcaacagaacgaccccaaaagttatctcttgttagactgtgttatatataccactcatgagccgtgtccaatgtgctgtatggctttgctgcactcacggattgaacgtctcgtatttttgaaagacatgaccactggtggtttgaagtttcatgagggatacggttacggaattcaaacggcttgcactttaaactggaaatttgatgcttaccggtggtgtggagacgaaatccctgttggtatagtggatgatttggcctatgcataaccgtctctcattgacaatccatgatttttgtttctacacttttcagcgactccactacttcatcaatagaatctagaaaatcaatattaccatacttgaggtcactcagttggtccaccatattttcgatttcgccaagtttataatcgcactgtttttgtaactgatcaatttcctggtcaaatccctcttctacagatctcaaatgatcaacgacattttccagagctgaaataaaaatggtcttgttaatctccatatctgaatctctcagaatatctacacttgacggagtatcaatggtacctggatctttgtcaaggctggttttgattgcctgcaggtccgtattcttctggtctcggagcgattcatagagcaagttaatgactgaaggattcagtccccggcagttcttttttgcaagtccagtgaatttgtttctgcttattatatcttcaaaagaagactttgagagcagaaactccttcacaatgtcagacattttggtgatcaagatttgtttatgagaaagattatcatactcgcgtattcgtatttcgatatgtgttatatatttatggtggtttataatataaataatatattttataatacagtgctaacatagctcacaatctcaagccgtcatcgtcatacttacgacgggtggcccttctcttgtttctatcctctccatgtctcatactttcccttttcattcttctgatatttctctcacgttcaatctccctcttctcgatctcccattgagataagaactccacccgtggagtccatttttctccagcatccttatcataacgtaatccttggtaatcagaagaaacatcatatatatttggttgcttttgatagcactggttgtatctgggaaggttatgttgctggaatatgttcaattgggggttctcaacatactctttctttagtttgagaagctgctcatggatagctacggagatggcaggcttaaactctggcgctaatcccatgtcactaacaacatcatgggcaaactgttcaggagtgtatgaatcattgtttagatcccattctatttgatcttcatacagctgttttccaatattgacggatacctgtatcacgcagtgtttactgtcgacaccatctttagggaattgtaatgtcacaaacggagaaaattcttcaatttggttgttgatttgagtctctatctgctgaatacacgagtttggtaattccatgtcattacagaatatggctgcaaatgattcaggagtgatcaaagtttcgttgatattccatagaaaacaatcttgaatcttgtttccattgtactcaatgttgatcttgatgggtatcaccagctcgggtagtgaagagttatacaggatttgctggtctgaaaacgtagttccaaccgtgggcaccgcctccttaccttgaaaattggaactcacgttgatatgagagttggagttattactcctgtttgccatcaatgaaatatcgacaagatcatcgtaaaagtcttcatccttatcgtcttcttcaaagtctcgctcaaactcagcataattaacgaccgcagtgtttcgcttggtagacctgggagctgcagcacttatgaaaattccagtctccccattccgtgttctggatgcaaacgaggaacttagcgcctgggggaatagtggcttttctaaaacaggtgccatgttagctttgacagtttatgtttattctacaagagatacgctaggttgagatttctcaaccctcatggatcaaatcactagtacagaaatttacgcgcctaccacacaaattctgtaccctagtttacctaagagaaccatttttcacccaatttttttcgggcgctactaaccacttggaagtatatttctccgacctctccctcttttttttcttctcttcctcatatcatacaaatgtccttctccgatttctctaaagttgaaactatcagcgaattgaacgatttattggctgacaagtcttacatcgatgggtacgtttattagcattacatttgctccgaaagtttccttgtgcaggcaaattatcgaatgatgataacacttggtccgtgtttacgacgtggcttcaagacccacgagatgatctaaaaccaaatattttcatatacctctgactattactaatttgtccacaaggaaactttgcgatccatttcaaagttaatattttactaacaagtttctttagtacttctccaactcaaattgatgtagtcgtctacaaggctttccaaaagcaagctccaaactttgctagatggttcaaccacatcgcttctttcactgacgagttcgacacattgccagaaggcaacgctccagcagctgctgttgctgctgagcttgctgaagaagaggaagacgttgacttcttcggttccgacgatgaagaagaggatgaggctgctgaaaagctgaagcaagaaagattggctgcttacgctgctaagaaggctgctaagggacctggcccagctgccaagtctttggttactttggacgtcaagccatgggatgacgaaaccaacatgcaagatttgttggacaacgtcaaggccatcaaatgggacggtctggtctggggtgctcacacattcgtacctgtcggatttggtatcaagaagctgcaaatcaaccttgttgttgaggacgaaaaggtctctcttgctgacttgcaacagttgattgaggaggatgaggaccacgtccaatccaccgatattgctgccatgtctaaattgtaagttatttaggtgtatccttttaattgagtaccattatgaatcacttgtattgtaattgtttcttcaggggtaatcctgtattgatcgtacaaatccttcaatgggctgtctatagaggctggtaattaataatagatgtaggctctaagacaattacaatgcttatgaatgttatggacttgaggtgagggttcgttccaatactcaaagctttgaaatttctgcttgacccataggacttattcaaaaggaataagattcaagtatgatgaataactacagaatgatgtttagctcaattgactacttgcttcagtgtgagctgcattgaaattaataaagtactttgtatccctctattggccaatatcctcttgaaaacagcaactacttcaaagttccacaaattccacacaaatattgaataaatcagatagtgatcactcttcactaaagtattcgaattgctcgtatggcacagtggtagcgcgccagattgcaaatctgttggtccccagttcgaacctgggtgcgagctcttttttttatacacatatatttcatgcttatatcagattttctattctttcgtcttctctgaaacattcatgttcaacagagtttttcgacgtagtttctccaatgcgagatacttaagatcgtcactagagtcgtctgtcccagacaatgctcccacgcaaaaagagaatatgaaatggttgggtaaagtggcctctatgtcaaagaaatctgatacagagctgaccaacgaccaaagcactttcaccgtggaaaaattccctaatccaacacaagaatcaacgacaccagagccttatactattgtgaaacgtcccgattctgtggaggatcctttctttacgatctcggtgccagcctccaattatttcctgaactcttcagcattttcgaatctaagttacaatcaacgacccaaagccgaatcttcacagccattttctgatataagggttttaaaactacgctctggaaggggtggaaatggtgctgtttctttcttaagagaagctaaccgttctaaaggaccgcctaatggaggtgatggtggtactgggggagacatctacgtacaaacagcaagtcatatgcactctttacacaagctcagttccagatatcttgctgaagacggatcgagcggagaaaagaaccaactggatggtaaaaggggtagagatgtggtgattgaagtcccagtaggaactcatattcagtggtgtccagatccattggctatcagaaagagccaaaaacaaaaaaggtcattagcattccacatcaaagccgtaggtgaggattacctagcatataaaccggaaaatatccagtttttcaggaacagctatcaaccaggggaaggatggattttcaaagacagagatcaagaatatcacatggcaagagacttttttgttaaactgaaaaagaacatgacagcttatgacaaagagcaaacaaaggctgaacttcataatgacatttttcctcttgaaggcatagatctggatagtccgatgaaagagcctcttcttcttttgaagggaggaaagggaggtttaggaaacatgcatttccttactgatgatataagaaacccccgattttcaaaagttggaagacccgggctagaacagactttcgtgtttgaacttaagttattggctgacctgggacttgtgggattaccaaatgcaggcaaatccacccttttaagagccatttctaatgcaagacctagagttgggcattgggaatttacaacattacaaccaactattggaactatccccatgggcattgataaagaaccattcacagttgcagatattcctggtattattaagggagcatccgagaatagaggtatgggaataagctttctgaggcacgtggagcgttctggcggactagtgtttgtcatatctttagtgggacagaatccaatcaacgatctagagatcttgttagcggagatgacggagtcaagattgcacggtaagaatatattagttgtggcaacaaaagctgacgttgagggaacgaaagaaaagttccagatgttaaaggaatatacacaagagaaaaaaatggatatagtcccgtgttgcgcaatgaaaaacgaaaatattgagatggttattgaaatgatggctaaatgcacaggtaaatattaataatagaagcaccaatataatcatccgttattcatttcctattcttcaatatggaatccaggtaacctgctaagactgaaaagctggaagactccaaccgagagtaatagttcaaagcttgcacaaaggtgttcaagctagactcaaatttcttctcgtattcatttattatatgtttcatcttgatgaccctttccctattcttttcagggtcaaactgtttctcccctagtttagaggcatattggtcgaagaggttctcgtccaaaagaatcagattctttctcaaagacattacaaaagtgtgaaaagtaagcacaaactcgaacattcttctagaaatttgtacaagcgtctcattcattagcaaggaattttgcatcatagtgttcagccacttttgcagagagacgaagtatttttcgaagtcactgtccgcagtacttgcaaaatgctgatactgggtttccatttcactaaatgaaccctcaatcacatcgaagctcagatataaatggaatgcagacacaaattgctttatatttgaatgtaggtatctcaaacgcagtatccattttctaatactccgattgggaaaattgaaacaccaaaacctttggtaatttatttccttccaagacgattctagtagcttttcaacgacattggttatcataacatttcttccaaccagttggaattgtgtaattattgtgtttgtcaatagtaaattgagaggaaatggaaactcaatgtttaacgaaagataatacactaagtaattatccaacgggctaatgacaacttcggcagtgtttttggtgagagttttgttaagatatcttttcaagctgttaaggtcagatgaattaaacacctcttcagcatcaatttgctgtatgttaaggatactttcaaggaaagtatataggttatcagattgaacgttgatattgacaagattaccaactaactttgatcttggagtcgccataagttgaggcctgaatgttttctcaaagtttctttctattttgcttaaagaggcctttgatttgtctcgtagcatatcgctcatagaatgtgctaggaagtcattgagaaacacgccgttggaaaataatagtgtggactttaaggcctccagaatagtcagaaatttgtaacctttcataaacaattctgtgaccaatttatttgcccgcagatatttttgttccacataaaagaataaatcatcagtctccaatgactcaatcttatgattagatgtatcattctcaacgatgtctacaggcagacacctcaatacatccaaatacttcccggtcaacagtactttcctttgtaattccctatgttcgaattgacgaataatgtaattctttcgtagcaagaatttgctgtcgtagttgattagagtgttcttggaactttgttccactatgaaaaactcatcaaaagggtcatcaatttttccaaacgtaagccatttatgtaacatttcgatataggggagacttattctatcaaatgtcttctttaaagcctcaaatcgtgtttgatcacctcttattctttccattttatcctggacaatgcgcagtattatacccccttttattattctagttttgttattgagttccgtttgcatgtacaaggagtcatcatgcttcaagtcttctttgatagttttgagcattgtcttgaatacatcgtcaactgttgccaaatttgatctgtttacctcattgagcgatgtgatgatttcgtacaatgtgcgcattttctctcctgattcttcaataagttgattcaaaatacctattgaaaaatgagggtccatcataaaccgtctttcaagttccagcactatctgatcgtgctctttcagaaagtctctaatttcattacaaagcctttgcatggtagctccataaaattgggaatcgtaaacctcaacaaactttgtcaaactgtagtacatttttccatacttgagcagtctgttggtcatgtctttcaaggtaacatccaggttctttgctattctataatcaggaccttccaaaattgaccttaaatcctgttcattaaagttcttgctgaacctcacgtaatcaccttcgttcccttgtaaacagtacagtatatctcgtactacaaatgcttcctgttctttcaaatcggaaagatcttgcaaaggatatggtttagtgttcacggccgtggtcaggttcacggttgtcggtattattcttttggtttcttgatcaaccagtttcacgacatcatactgcttcgaggggttagtaatgtgcaatccataccaggtggttagaatacggtgaactctgtttgcttaccatttgtgtcatgttgattgatggtctagatgtaaacacggaaacgatacaatagcgcgcgtccgcctgatttccagatctgaagaaccgagactgagatgagtttcgcagtcttgaaaagctcattgtaggaaaaaaaactacagaatggctttaaattatcactagggcgagatctgttcttgttgatgtttgcttccagtgggacgcaggcccactctctcaaagatctgatttggatgtattctcatataacagctacttgatcgttagaaggcatccaacatcttttctacttatctcatcgctaaatatttttttttcttcccttgcaaatcattttccatacactaaagttatggtaaagttcgaagagctgggagtcagcaagtggctttgcgagtcgcttgatgcaatgaagatatacacgccttcaaagatccaagaagccactattccaaaaattcttgcaggttatgattgtattggaggagctaaaacaggatctggtaaaaccattgcatttgcagccccaatgcttacaaaatggtcagaagatccttatggtgtgtttggattaattcttacacctacaagagagttggcccttcaaatcgcagaacaatacgctgcgcttggtgccagtatgaatattaaagtttccgtaattctaggtggtggggatatcgtccaacaggccttagagctacaaagaaggccgcattttgtcgttgccaccccgggtagactggctgatcatattctcagcagtggtgaagaaaccatcggcgggctgagaaaaatcaagtttttggtattagacgaagctgatagattattgagtaacagttttggaagcgacttggaaagatgcttcaaagtgttgcctcctcccgagaagaggcaaacattgctatttacagccactgtcacggatgaagttagagctttgaaagaaaaacctgtgcctgaaggcaaacttcctgtattcgtacatgaagttgagtctgtcgataaagtggccattcccgcaactttgacaacaaattatctattcataccgtcctatgtcaaagaggcttatttgaatgctgtcttggcattggaagaaaacgcagattctaccgtcattgtctttgttaatagaacacaaaccgcagaacttttgagacgaactttgaggaatctggagtttagggtggcttcccttcattctgagatgcctcaaatagagagaataaactctttgcatagattcaaagctggtgctgctagaatcttgattgccacggacgtagcttccagaggattggatataccctcagtggagttggttgtcaactacgatatgcctgctgacccagatgattatatccaccgagtaggtagaacagcacgtgctggtcgtaagggtgaatccttgagtttcgttaccgaacaagatgtcaaaagagtgctggccatcgaagaaaggatcaacaagaaaatggacaagtacgaactggtcactgataacaaagttatagaaacctccctgcacaaaactggtgcagctaagagagaagccttaatggcgatggaaagagaggggttcggtgaaaagagaaagaataacaaaatcaagaacgcaaaacgaaagaacagcagacttcaaagtaagtaaattagacttcatgtattatatattttcaggacatcaaagtatctacagcccaatccacactcaaagttcgaagatccgtgtaagtttgacctgtaccaacaaaaagaattggtattccagtagcataaaccatgttgaccatacttccaatcagatctcctacggtgtcacatttgctgataataaagaaatcaagtgttcttccaggaccgaaagcaccattaaaattctttgcctgctgtacactatccgtaccaaccaatgcctcaccaaccataatgattttgtcaggcttagccgccttcacaaacccttgcaaaggtgccattaactgtgcgtcattgtgtctccttcctgcagtatctaaaagaacaatatcaaatttgttctcctctgcgtattgtatagctcctttagcaattttagataccagatcagcacctccgtaacctccttgaaacagttcaacgtgcgattcatcctcagtaagcttcttcaagttgtttacgtgtactcgcaactgttcgacagcccccgatctaaacgtatcacaagcagtgatcagaaccctgtacttattacttagtaaccagaaggccagtttggaaaggtttgtagattttccaacaccgttgacaccaacaacggaaatgacatatggctttctagcagcctttttgctttgaatttctttcaataggttaatagaagtttctggggtcaataatttgagcaattccttttccagtgcattcctagcagccttgggtatgcttgtagtgacctttgtacctactaaacttttgttaatgcgttcaacaagctttttggcaatttctggagccacattcttattaattaagtgttcagaaagagatttggaagtcttggtgaggtcatcttcggtgacagttttacctgagaataagccagacaaaaaactaaacgctccggtgctttcatcagagacagatttatccctttgtttagacaggatatcgttaatttctttcatatcgcttaccaaaaacttaccatctttagtttttccgtaattatcaccaactaaatgtccaacatcttgattcccgacctcgctagtagtagaagagaaatccagatcagattcctccaaaccatcatcttcaatggggttgccctgggtatcccatcttctagctttcttcttttgagtaagttggggtttctttcccttcaatttattttgggataatgaatgtggttctgaagtagaagtgcttttggcagtttctacaccaacgtttttaaaaagttcttgcttcttcaggttgtagaaactagtaaactttctcagctcttgttcgtcgggaaaagctccagagtcaagatcagctgtgatgagctcctcccaaagcgtttgaatatcttttaaaaattggccctcgtttggaacattgacaagagaagagtggcatgaggtgaagtagcaagtgggctgggaactgctgacatacttgatggtatatccatctagactataagatccaacatcatcatcttcgaactcttcctcgttattgacagatccagtcaaagttttcctttgagaaataaatatatcggaaatgagaccatttacaacccgatcaggaacttttctgtcctcatctttgaaaagaacagttccttttggagtgaaaataagaaattgttcggacattactttcctgtgagttagtcctttggaagagaaatatattggacataccgtagaaggtccaggatacggccccacagcatccgtctagcgcgcacagtaagagtcgaaaactactcagaaaaggaacgattctactgttaaggtaatgtacatagtcttttagggctaaattcaacaaattattcatctagagtcatctcatcaagctcatctaataactcatcaacaccaatttcaggggcatcgtcatcttcatccatgtcagcctcattttctggagctggtggctcatcagccttataaagattaacggtttgtctaagttctggatcttcctccaattcctgcaaaaagatctcgtaatctctttcagccttctcttgctcttgtttagcttgtctagattcgtcattagcgacaatatcctggtgttccttcgccattcttctaagtctccaagctctcttcttagctcttcttgcacttctggagaagtgtttcttgatcagaactacatctagtacattcttgctgtctaattcatcaaaaaggtcactgttgaagttcgaattagccaaaaagtatccatccgcagaatctccaggattcagtaagccaccaagatgcgatcttacatagtattcttgatcattgttacccatgtctgctgctcttgctacggtaatatcagcaagaatatagtttcctctggtctctccagtaggttcaacatcgagcacaatgaattcaattaactctgttctgttgcacagaactgggaaaggatctctgaagtaaacgttggagtttatgtctgctatttgtaatgtgtttggatcaataaattgaactgtattcgaaactttggagcaaactaccagtctggagatagttcctaaggaatgtgctaacttttttggaagaacaattaagtcatctctacagatgggtacaatttcaacagaaaaagtaaacttatacgtagaggttcctgaatgaatatctgcactcacaagttcttcagattttttggatttgacaggggccacggaactgataaagtcaatcatcttggcagcgtggtttttctgtgcgtagtagaagtccagaccatccttggcctccttaatagaaatggtatcaacatgagcattatgctttagaatcaactgttccaagtgcaagaaggttcttttgtgaggaactttttgacgaacctgaacagcggctctccacgtattagcagtaaatgatttggcacagtcaggacattgcattgccattacaacatattcaacttcaaagctttgctgaataatagtgtttgtcatagcctcaccctgaactgttagtttaactttgattcttctagagtgaggctctgtccagataaaggaagcatcaatcaatctgaccttattcaaacctttcaacctcctgagacacaaagccaaaagctctctactttctaattctgcacggatccactgtcctggaggttgcaaaaaacgttcacagttcctacagaacgacacatttgcctcccttggaattccttcggtgatatcaactgtaagttttatacagtcgtaacacatgactagaccagtggtaccatccatgggaacaccacagttgcaacatagcaccgtagcaacaccttgttgctcggtaggctcgagatgagtatagtttgacatactggacctcgttgctattataacttattcagtagagaagagcaaagagaaaaaaaaaaaaaactatgagaatcaaaacaatttgagactaaacccaaaagaagtaatatccttttaagcaagatcttgccaaaatatcatcataggaaaagtgtggttccaaccatactcacaatgtcggaaagaggtcagcccggtggaccaaacccgactatcaaggataaccgactagttatgaacataactacatctgagcctcgtgacctgctgatgatagaaagaaattgtctcagtatggtcaaatttggggttgttctctcattaacaagtattgccatgcttgttaactttggcttcgggaaacgtgaaaagcttgaaggggacaaaaagattctctttacgatatttggttccatttttatgcttctctcgttgctgtcattagtattaggtgctctgaattattatcactctatcggtcgatataccaaagagaaggtggaggtctttaaccatatccctattactggctttgtgttttcgtgttttgtaatgatcttcacagtgagtgtggtattattgactcagagcttatgacagtatcggtactaataaggtgttcctggctggaatccagaggatcagttgattcgttaagattgggcttcgaatcgaaagtcgtttctgctgtgtaaatcgtttcactatgaattagttctgagaattgggactgaggttcagacgaaaattccagctctgatataagatcagaattatgctgttgtgaaggagagcttgaaagaggcaagggggagctaggaaatggtgttttacacggtcgaactttgcaaggtaaattttgaccttctgaacaatacgaagttaagggatcactctctgcatagaaaggactggtagcttccggtgacaatgattcattgccttcaaaaagtatattcagaggcatcaatttcgtcttgcttgcaaaaatggtttctgcttcatgttggggaacaatctcatacttgaaaagtttctctttcggtggaagtccaaatctggccaatttttcatcattgacctttcgatcgttcgattttaacatttcaatgaattgaagggattcagttggtctgtcttcactagtcatgtccttacctttaaacttttttgtgggaacaaacaaagacaaacttggaccacgcatcttgaatatttcttatcgatggatataatcacaacatgtttgatgttgtggatcccgcgagatgagagaaaaaatacaaaccccaaaagatgaagagatgtggttcaatattgaaattctgtcacgtgaaatgtcaacatcagatttctatttcctagttgcttaataaacttttttctgcctaaaagggggaggggagagagaatggttcattctttagtcgacatttacttccatgaggaattcaatgctgcgaatatcaagaagatgtttcaactccagcgggctgctgttgaaaccttctccaactagaacgaggggcgctgtacagaacctcaccgactctttggcttctaatcctcaattatcattcccctgcttagataaacaagaaaagagatcgaaaacactgttggaagatggccctgagcccagttatcaatctatgaaggaacaccatgtccacaaatataagagtgaggatcctatatttctggattatggaggctatttacccaagtttgaaattgcctacgagacttggggacgactcaatgaacatagagacaatgcaatcttgatacacacagggttgtctgcttcatcgcatgcaaagtcaaatgctttgaacttgaaaaaaggctggtgggaagagttcatcggaccgggaaaatacttggacactacaaaatatttcattatctgtacgaatgtgatcggtggttgctatggaagtacgggtccatcgtcaattgatccagctgatggtaaacgttatgccacgaggtttccaatcgtatctattaacgacatggtgcgggctcaaaatcgattagttagttcccattttggtataaaggcactccatgcttctgtgggagcatcaatgggtggaatgcaatctctagcctacgctcatgagttccctgatcaggtgaacaagatcgtcagtatatcaggatgtgctagatctcacccctactctattgcgatgagattttgccaacgacaagttcttatgagcgatccaaattggaacagaggtttctactatgactctctcccaccacacacaggaatgaagctcgccagacagattgctacgatcacctatcgttctggaccagaatgggaagtccgatttggtgtggaaaggacggatccttctaaacagcctgccctctgtccagatttcataattgagaactacctagatcaccaaggggaaaaattctgtctgcaatacgaccccaattccttgttatacgtttccaaggctatggacctgtttgaccttggagcgattgaaagacaaaaggcagaattatctcgtagtcaggctgaggctaaatttaagggagcctatgtgccgtttgaggagcttcaatttgaaccctccggaagtaactgctcacttccatcaactccctacgaagagaagccccgcaaaggaaggcgagcaactcctgaagagtctcgcagagacttgctagaaggtttgaagactctagctcataaagatgtactagtcattggagtcgaaagtgatattttatttcctgcatggcaacaaagagagatcagtgatttgctcacagagggtgctaaagagttaggacttgaagggagtaacatcagacatgttgaactaggttctgatgttagtatcttcggacatgacacttttctcctaagtctggaccatattggtaaaccagtaagtgaattcttgaattagagacgttatttttttttttaaatttttttttgattcaagattgaatcgttgttcgtagtattcctctatttacacggtcttacttgcggactcacccacaccatcttggatgattgctaatctcatggcctttttggccttacgtctctctctgcgcttctcttcaatttgtttcttactttctttgacaaggacacggcctggccatatttcatactcttgcatataacgcttatcaaagttgaattccatgtgaacggcttcatcagttaacccaagcttgcggatggcccagaagtatctttgaggatcgtctctcttcaagtaccggagaattctttgtctctgttgagccaacattcttgcgtttcggatcttgtcaagatccttaggattctgacgaatgtggtccattaaaaagtataatttgagggtttgtacagccgcttgcacttcggaagacccagtatctccaggaaatctttcgaactccttacgagcaaaagcaacagcaagattctttctatcttggttgtttgaattcctcatagataaaacacgaatcactacctctttaatggtttccgtttgagagttggagacactacggacatagtcgttttccaacttggacagtcgtgcttggttaattccataaatgagcttctccacctcctcaaaatcgtaacccttgcccaggacgtctttttcagtaacttccgcccgtattcttgtaatgaaaggattgtcagctcttccaagaactggatcaaccttctccaaagcatccaatttagccaactgacgagccctattctgtttcttcttggtttcggatctgattttcctttgcgcttttgagagtacgtgaaactcaaaagcaaccgaggaggttgcaaaggtcattctctgtgcagagaccgacatgattggcctgaacagggtcaatctgttaatcaagctcattgtgtcgggtcagaagaatggaaagttttgtcgaaaaccaatgttccaaatcgcgctttaatgatttttctttctactttatttctatctaatttatgtttacataagcacatgctttggagatgtacagtatactcaagaatgcaagggcaatagcaattccaataaccttctctattactgtgtgaaagaaaattgaagtgacccaaaacatgagaatccagaatgccatgacgattgcggtggggatcaaaccccatctggaaaaactgggatctttcacgaaaacagatctccattcgaaagccagagaccccagtactgtggtcaagatgaaaagatggccgctggctctgaaccctcccgtccacagacctccagctcgttcacaacttgagtagttgtcgttccttgcaatcagcttctctaacccttctggatactgacaggtcgcgcctgtgtgttcttgtaagcggtcaaataaagaatccccaaagaaccatacttttgtgacaataagccatgttgtaatgataacaaccttgctgatttgaccgcttattattttctggttcgtcttgtcatctactgagaccggcagtatcatcttgtaaacttggaaggtgtagtatgagacaataccaaacagagctgcgaatatctcaaacgcatgccctacaaatatcccatttatcaaattggatggatccaaaagatatcctcccgtagggagggcaccaaacaaaagtaaaagattccttgttaccaacccaagagccaatgttagtggaaaaaacagtaaaacactggccttggggatgtccatgtggtgtttatttttgttaaggggtaaaaataaaaatggatcgggatattattcaaggagcgaccgataagatttattctggttttcgggatcaaatagttcacccaacacttccaaataaaccactttggtcttcaaaagagtcttcattcttctgatgatcccttctgattcttgctcacctactgcttggacccattctggcttaacctgatattccaccacactgactacatttgtcaagtcgcacaagagcaaaagactgaacttctctttaacgtgcagacgaatcttggtgaagtctagatcccactctagcgtggctatcccctggagtttaccattcaccctttctacaatagattttttattctgtatgtggacaagatgcttcctcaccaattttgcaaacttgtttaaatcttggtttagccattgttttgcgatcgattgcagtggaacatatcttggtatggtggttctgtgtatcttccattgttcggttttcgaatgtttctgtaggataatatagtggggtactgtgaactttttctgctctccatcaaatatgtcaaatcgtatccctaagagctcgtcacgattactgaccggaaacatggttactcctaccattctatacaggttctccaggtgaatttgtttgtatgccttcttcctgctcattagtttgattgccgatttggactgtgggggttcattgatgaagttacctaacagggattcaaagtgctcgtgttgaacttgttgcggcaccccttttcgaaggtcgtctagttctctggaggtactattatactgggcttgcagctgggcaatctcagttttcaaagagtttatgtcattgatgatatcatcttgaaaagacattgtggaatagtaaacaatatcgcgcgagcttgtggtctctggtccctgttggagagtgtactcggtctaacagcagatggacaaactggtggccaaaacaaaaacaagaggccgcaagggaatgtgttgagtgaacaatcgtgggaaacaacaggctcccatctttagtttcgttcgtgtgcgtttttatgtagacattcatcatcaccgtagctttgcatcattacataagcaatattaatagtacatattttttccctcatcacagatcagcttgtgttcattcacaaataaccatgaatgaaatcatctctgatgaaaatctacagaaattaaacacagagtttgaggtcctctatttgttgtatcacagaaatagcaaccagcataagactgcagcttggtggtctaattttaaccttctcctgaggaaacttcgatgcatacttactctctcattggatgtccaagatctctccaagaagacaaaattggcgaataaagaggagttgattagagaaaagctctataccattgttcaaatatctcagtacctggcttccaaaacgatagcttcttcttataggcagttttattctgttattgctctgggtcaattcatcacattaggattcacattaataggactcttggctagggtttattgcatactactatctatcaggggagtggaaggaaatgttgggtttgagaaagagatcaagatgcatgtggacaatggtgatattattgttcacactcaagatttgaaccttaaggagcctgttgcatttgatactttgaatgagatcaagcctaagagaactttcaagcaggagaaaagaaagaagagaaagaacgccattgatgacatctttggctgaaaacaagcagtacagttgatagtgaactgtgaatagtgtacaccatgaatagttatatagtaggacttttccagcatgagtaaggtatatagttaaaagtctaaagaaggcttccattttttccccgtgaatacagtttccattactagtaaactgataatataactctgttgtggaatcgattcagttgactcaatgcagaacctggtctcactctaccgtcttctcgaccagttttatttttaaatgttccccccaaggtgcaatgggattggaaacccactttaattttatgaaaaaagccttagatgctgctcaaatcgccttagatgaattagaagttcccataggatgtatctttgtttataaaaacaagatcattgcccaaggatcaaacaagactaacgctacctcgtgtggtattaaccatgctgaaatggaagccattgatgagataatcgccaaatacccaaactacaaagagatattaccatttgctgatctttatgtgactgtggaaccatgtataatgtgtgcctccgcgttgagacagttaggcataagaagagtcttttttggatgtgcaaatgatcgttttggtggtaatggatcagtattgacaattcacagtgacaagttaaacaacaaattagactcatccatataccctgtttatccgggaatctacgctaaagaagctgtcactttgcttagaaagttctatcttaaccagaatgaaaaatctccgaatccgcagactaagaagcttagacagttggacatggagaattttcctcgattgcagtttgaaaaatatttgaccaaagaacaatttgtagacatgtacggagaatctcagctagacgtatatgtgggagaatctgatgagattgttttacaaagacctactaaaattccaaaaatatagagccgttgaggccttagatagtaacatcataaaaaatactaatagtgaaaatcattctttaccactgctcaaggccttctacatcaaccagaccttcatcggaaccgtcgtcatcaaagttatgttggttgtcattctgtggttcagattgagtgtgagactcagtttgtgaagcatgtagctcttctggttcttgttgttcttgttcctgtgcttgcacaggcgtctctagcacttccgcttcttccctacttaactcttctggttcttgctcttgctcttgattctgaacttggtcctgctcatgctcttgctcttcaccctgttcttgatcttgtttatgtacttgttcattcttcctctcttggctcttgatagatcttaaatcgcttctaatatgatcgttattcagcctgacatcatcatgctcaaataatttgctgttaacatccaatttaggatctatacttatgttctctaagttcttccgtagctgagattgctgaagtacatgcagttcatcagttaggtgttcagagtgagggatttcgacatcattccaatgatttacaacactgttgtaataatcaagataatattggcttaactcatgcagatttgtggttatttcatcattctttatccggtcaaacaattgatattctgtgatcaagtttttctcaaatgtatgaaataattcaaaagtttccttgacttctctctccaagaactcaattttttcattcaatttgttgattcggtcattagtctcatttccagacgaataagtctgtccaggcgtcttgcccctcagagaacctattttcttggaaatgaaattcatcgcaccatcactgccggacacattattcccattcattaaatgattcttttctgcaatggctttattcagataattctgtaacatctcgtaatccagcagcttactgtccttaaacttgatcatgttctttatctgtgaaatataatgatccaaatccttcagcgaagttaagtaatgtaggtcaacctgtcgggtgagcttgaaagaatcataagaaatttggtaaatattctcagaaaacgaagtaaattgttgggacagctccttatcaaattgggtatcagatccttcagttaaaatttgatttagtttcttaaattcatctccaaacaacctaaaatcttcagaaatctctgattgtctctttaccactctttgatatatcttatcaatcttgtttatattttcctgaagcttgtttgacttatctgtaatctcttggaattctttagcgttttcactttcataagtcggcttcttgaaagcattcatgatgtaatcagaaaaggagtctaattctccgtttgcatttgctgaagtagtgctacctccaccaacggtgctattaggattggagcttattttcagattctgtttgaacgtattccaatttacgctgtcttccaaaaatatgtgatatatctttgcttgtttcaacaacggatgttttgatatccgatttaggaagttgttaagagctattgatctcttggtggtaaaatattcgccaaatctatcgcctttgatgtattccaatcgttgcttattcggcaaaggtggaatgatactggtaggaaaatcattggctagacaattgtataagaaattgaagtcactgaatcgtcgcctaactttcagtttggttttagccaaaccaggttcgtttgtctcggtttcaattagataactgatgtaaaaattctgcccatctgattccttcaatggctgggaaaccttggatcgtatataaacatctcggggaggtatttgctcattggggttgctatcggagtcattgccacctcgtaccactgtgttcgtagttacaaggtcatcttgttcttgttcttggccttggtcctcctcgatcaaatttatggaagagtttatttgcacttgtgaatggtcattactgtcacctggaacatcgccttcgggttccgttctgtcccattgtatagatgtgaattggtcactcatgctagtattgtcaaatgataaaaatagactagaatgttttctggcccaaaaggtgcaatttcttccagtataaaaagcttggaacaatactcaagctaataatgttgccgtggtataaacactagacctgataggggtataattaagtatagaagcctcggagtgtatcttagcaagttcgtgctgtgtgtagagatgtgtgtgccaccaaatagagtgaggtcagagagtagtgtgcaatcagattctgttatctatgaatatatatattactaagtttatggggtaaacttggaggggtgatgtctggaacagaaagtggaggacatttcgataaacaaaatgggcaattgcacacgtagtaagcattaaacaagtttgcaggaatttgtgaggtaaaacagttgattttattggtttatttttccgtctctaaatctagagcattacagacaaccgactttcaattgatttcgatctatttttcggagccgactgccagcaattcggatggggtggaatcacttatttagcatcaaagagagaggcattttccaccgaaaaggttcatacgattgctttcttagtatactgattcaggttcctcaatgcttttaacattccgtcttctttgactctcagtaaagactcttggtatttagagttagatcatccacaggttacagaacttacttcagaatgacgtaacagtcgtttaaaacggtatcatattctgcttctcaaagaacttgaacgaagtaatcctcttaaattgtagtaaaaactattgccataaactacataagaaaatttcaacaacatgaaataatcaattcaatcgttaaatatgaatggtccactccagtaaagctggggctattggctcactcacttggtattggtatctcgtaccaatcacatcgtcattgtcattcaagacgtcagcctcagagcttagatccaaaatggaactcactaattgtcctggattggcagttactccgaacttgaatggagctttcaacaatatgttatcaagacatgggaatgccaacctggcatttggagtggtaaggtttgtagtgtatgtgactcttccttccacatctgtgtctcccttgtaaaatccaattttatcagattgaatgttaccggtgaaggaaatattcaccagcaacgttccggaagtaaccttctctttgagcttaattgtgatgagctcgttatcaacaatctccttaacggggatttcgttttcagacttgttgacattgtggaagacatgtacgtctttcaattccaaatccttggcattgaagaccacttcatcagtgggctccttcacctccaagtggatgacaatgtctccatcataagtctttttttcgggttggaagttgtagatgtgcaagtcgtatagggagggaattaagtcttctggtagtgttctgggagccatttctttgttaattgagctatgattgttccacaaatcgatttcaggggccaactacctactctatttatacttgttcggaaaagcactcattggcattgctcgtacatcatagcaaccacacaatgaccaatacaggtgattattttgcaagatcttcctcacaccacaacactgtgcaggttgtgcttgccccattcggaattgtaccccatctagattttgcgaaggctttgaaatttatacgacctagagaagaagaggtgctaaaacaagagttgagcttgattgtaagcgatgacagtgtattattcagagaaaatcggcttgccgaagactgatcctcaaagatggaggctgagggtcaatgagctcggacgtcagtattgggattacattgaaaaggaggacttgaagaacgaccctcaaacaccatacgtccagtatctcttgaaaggagatgaatttgaatgtccaatacctgaaaaacctcaatctgcttttgaatcggcccgaaattgtgcagattttttagctttgattcaagatgaatctggagtgtttccgtgtcaatacaaaggaccaatgttcatgagcataggctacgttgtagcatgttatttcactaatacaccaattccagatcatgtaaggaccgaaatgatcagatatgtagtcaatacagcccatccggtggatggaggctggggactacacgagtgggataaatcgacatgttttggaacatgtatgaattacgttgtccttcgattgttgggacttccaaaagataatccagtgtgtatcaaggctagaaaggtattacatgctctaggaggagctttggccactccatattggggaaaggcttggctttcacttctaaatgtgtacaaatgggaaggagtgaaccctgcacctccagaaatgtggaatcttccatactcgctcaaaattcatccatgtagatggtgggtacatacaagagccattgctttaccactgagttacatttcttcctacaaaagtcaaatgcctctgactccactgttgaaagagctgagaaatgaaatatttctacaggatttcgataccatagacttttctaagcataggaacaatgtgtgtggtatcgatctttattatcctcatacttcactgttggactttgcgaacagtattcttgtcggctacgataaaattagacctacatggttgctgaaagaatctaatgatgcagtgtatgagctgattaagaaagagcttgccaacacagagcatctatgtatcgctcctgtgaatgctgcttttaatacgattgttgcataccttgaagaaggtccagagtcgtacaatttcaaacgcttgcaagaaagattcaaagatgtcatcttccatgggccccaaggaatgaccactatgggtaccaacggcacgcaggtctgggacaccagtttttgcctacaatactttttcatggcaggattagcagatcttgatgaatatgaggagttaattatcaggtgcttcaagtttttgataagatctcaattcacaactgatactgtcgatggttcatacagagacaaaaggatcggatgctttccatttagtaccaaggagcaaggttacacagtaagtgattgcactgccgaggcaatcaaggcgatcttgatggtgaaaaaccatcccaaatttgcctaccttggagattacattgatgaggatctgcttaagaaaggtattgatggattattatctctacaaaacgtggggtcatatcattttggttcgttctcgacatatgaaagcactagagctaatcctgcgctggaaaagatcaaccccgcagaagtatttggcaatatcatggtagagtatccttacgtagaatgtacagactcttcggttttgggtcttacctatttcagagaacattgggactatcgccgacacgatattgacactgctatagagaggggtgtcaagttcatctgcgacgcccagcaggaagatgggtcatggtatggctgttggggggtctgctttacttacgcaggaatgtttgcgctagaagctttggcttctgtgaatcaatattatgaaaccaatgaagtagtgaggaaagggtgtgatttcctggtctccaagcagatggctgatggtggctggtctgaaagtatcaaatcctgtgaaactcatacctatgttcgtggaaaaaggggtatggtagttcaaacttcttgggttctaataggtttgattcttgctaagtacccccataaggaagtcatagacaggggggttcaactaatcatgagtcgccaaaagacaagaggagactttgactttgaagctgtagaaggtattttcaaccatagctgcggaattgagtatccaaactacaaattcctgtttcccatcaaggccttggggttatattccaaagagtatgagcaataatgtaaatatatagaagtcgtttataataaaagtgtaagcgcgtagttacaactgaataaaatcctaattataaatgaattttcaagttccccagtttcgagtgtctaacatttaccgattcgatttcctaatcatacactgaccaacaaaccatgacgtccagttacgatataaattccctaactctaggggttcctgattatgatataactgatatttcaacgttcgatttgaccagattgggagatttgaaaaagctgatagaatcatctttgacacacctatttgataccttaaaagaccaaaatgtggatatggacacttctttgctgaccgaagacggctttccaagagatgatattgatatcgtaaaggtgagactaactcgaacgagcattgtaagattacggaatgaccacaagaaaattctggaagctctcaatttgaggttacaggagcattacagtaacaacaccatatccgactcgacttccaaagaccaaggcgatgttgtcgaatcagcaattccgtttgcaagaatctcagaagttgtcagagatagtcctgctgacaaggctggtttacaatcggatgacctcatagtaacttttgaaaagctaactacgaccagtgccaatttgttacagaatatcagtcggatagtcttggagaatgaaaatcagcctatcaaactgacagcaaagagacacggagaactgcttgaactgactctgactccaaagaaatgggaaggtgggggacttcttggctgtaggctgaatctattatagaggggggtgtatcttaatataatggttgctagagggaaatgtgtcacataaaaggttaaccaccatggagagtgctggtaaatgttatcagatctttatcttgcagttcgtattcatcctcaccttccaattcccaatcggtatcattgattaggaccaaaatgcctggccttatacttccgtcttcaataaatacatcctcatccttgcgatcttttaataaatgttcaactagatgctgggtcaactctctgaagtttgagccatcctcaacttgcacggtatgctctcgcacatggccaaatatagcatcaagtccgcccctatttgttagcgtatgctcaaaaaactctcgtagagtcttgtttgtcaggcttacagaaattctacgttgatggtcaacatttttcgttttgtcacttgggggctcctgctatagtgggaaggagagcttgaattaaaagtctgggtatcgcgaaccctttcacatagtttagaatagaatcaatattattcgaacttcctccctcataatcaatagtcccgatggctacactaaataaaccacgttgtaaaaactgtgggggaacagagttcaccagagatattaacactcccgcttctgacctggcgtgtgtagagtgtggtacagttagtgaagaaaatcccattgtatcagaggtctcctttggtgagacagctagtggagctgccacagtacaaggtgcctttgttggctcagatcaagcaagagccaattttggaaataacagagggtctttggactctcgtgaacaaacactcaataagggtaaacgaaggataaagactgtggctgctgttcttggtatcgctgattacatctcggatgccgcatacttatggtttcgactggctctgacaaataatttcgttcaaggaaggagatctcaaaatgtagtagctgcatgtctgtacatcgcctgtaggaaagtgaagacacaccacatgctaattgactttagttcacgattgcagatatctgtttactcggtaggcgctacatttttaaagatggtgaaaactttgcatatctctaacctacctttggcagatccctctttgttcatccagcattttgccgagcagctaaactttgggaattccaagatcaaggtaataaaagacgctgttaaactggcccacaggatggctgatgattggatacacgagggtagacggcctgctggtattgcaggagcatgcttgatgctggcagcaagaatgaacaatttcagaagaacgcatttggagattgcagcggtcgccaaaattggtgaaagcaccattcagaaaagactcaatgagtttaaaaatacgaatgcttctaagctgagcattgacgagtttagaaaggcaaccaacatagaatctaccgctcctccgtcatacacatcaaacagaattaaagaaaaagcaatacagcaaatgataaatcataacaataagtactccgaagagaaagaaacagtgatgaatttcatccttaaagattctgaaatatcgtccgaagagattcgaacttatatcttaaaaattcaaaagcaacaaagggaagacctgaaaagaaaagtcaaccaagttgtatctccctctcctggcgaagtaggtgaaatacaacgatccatcgatgaagatgaagatgacgacgatgaaagcgaggacgaatctgataaagatggcaatacagctaattcgatatataatagctttgaaagacaacaacaggatcaagccaggcttatcgaacttaatcgtcccaagaatcttcacaagttgccaactaccggagatctgttgggaaaaatcaagtctgatccagaaaacctggaagatgtagatgatgaagaacttgaaggttttcttttgacagaggacgaaagtaggatcaaagaacgtgtttgggttggtctgaaccatgatttcctcatcgagcaagagaaacgacgactgaaggaggaatctgataaactggcgggacacaccacaatcaaaagacggcgtaagaagaatatcgacgatgatgggttgggaatacccaagactgaactgactgaatttgcaagtggccttgaccctgccgcactcggtcttcaaagctccataaatagcattggtgaaggttccagtgcactgagcagcgcaaagtccatgttgcagaagaaatcttacagtaagaaactaaactatgctgcagtagagaacttgttctagatggacccaactgccattactagggggttgtaattgatgaaactatataccatatatgtaatactaaataccttgaaaaaccgctggcacgcgaacgacgaatatctatctgctgcgtgaatcttgtagacagtgtgacgcgtacaaaatatgacaatggaccaagaagttaggagaagagaagtcgtacgaagctcggactccaataaagcgctgctgtatacactcaataagaataatcgcaactatgatagacaatatgcttcaatctatactgctagagcaaataagttgaaaccacggctgattgaaaagtgctctgagaaatggaaaggtgaaaagatcaatggcattcccgttagccacacagagaaggtcttgaacatatcttcgaacaaggcgacctggtgtgttggcactgtgttttgtgacctgaaatacaaacccaatattctgaaagatgtcagtgaaagtatgtacggaggaccagtggtcaaaaaagtagacggaacatacgctgatcgagaatccgatcaactcatgctggaagacgagagtggaagaatagcattggatggagaactaattgataagattttattagtcactggctgcatcgttggagtcttggggatggagattaaccctggagttttcacagtggttgacatagtgtatcctgagccaggtctgcaaaaaccgagactcctttccaatcatagaatagccctagtttcaggacttgggataaatggagacaacttggatcttagtcggctggaattactgaaagagtttctcacgggtgagctactggagaaccaggctcaagagtcatcgatagctaagctaatcattgccggaaactcgataaaagttggagatcttaataagattcaccaagataagaaaacaaattcaaagcaacttatgcttcaaactataatgccacagccgttagtcaattggacaatttcattcacgacgtcattcaaactattccggtggatatactccctggtgctgaagatcccgctgaaatcgctctaccgcagcaacctcttcataaggcattttttaattcttccagacagttcgtagggaatcgactaaataccaagactaatcctcaatggtgggatcttgcgggcacagaaatattggggaccagtggagagaatattgatgatatctttaagtatgtggtaccaaatgattaccatgttgatgaagatggttgtgagaactcaagaattaaaataatagaatctacaataaggtggcaacatattttgcccacggctccagacactctatggtgctatccatatcaggatgacgatccatttgttctagaaagcacacctcatgtgtattttgttggaaaccaagctcgatttgaatctaaagatattatcttggataatggcttcaaagtgaagctgttgtctttgccacgattcgaccaaacaggagaagtggtaatcttagatctgaacgacctgtcgaccaacctcgtttcatttagtgtctaatatttatttacatgtatgacttattcatacgcacctgctctgagaggtactttgattagtggtggcgtagagcccttgagaaattttgcaccttgaccgtaactagaatcctgctgaaatgcagcataggtagctgtccgtttggaactttcgaccttaatcatgtctaacaatttgttagataatccaggaataaagggctggagtaatatcaaacaaactctggttacgtccaaggcaacaaatattgacaagtcttgaagacgctcatttgactttaggttccatggttcagtagagttcacaaattgattgaccttgagcatcaggtcgaatatttctccaactgatttgtgtgtagtaaacgttgacatcaaaacgtcaatcttagagaacagttgctgcgcatcgtcaacaatttcatcgtaactttttttcaattctgcagctttttccaaatcaccttcccatcctctttccaaaatacgtttccagacaagattcatgtcttcgttggaaaagctcattacagatctggcagggtcaaaagactttgagatacatctagtgacaacgttacaaattttgtcaatgaataaatctctatgatcgtttagtttcctttctgtgaagtcacagtcgttgctcaatattgaatttgcaccgagaaataaccttagagaatcgacgccataatagtcaccaatggctaaaggatcagcaacatttccttttgattttgacatttttgatcctcccatcaaccagtgaccgtgaacaactaccttttcaggcggagataccttggcagccataaggaatgctggccaatatatgcaatgaaatcgagaaatatcttttccgatcagatgagttccaggccaaaattctttgtaccggcttgaggggtatccgatagaggtcaaatagtttactaatgcatcgaaccaaacatagatcttttgcgactcgtcattcgggactgaaattccccattgcaatctggaacttggtctcgatattgatagatcttgcaaaggctccctttctagctctttcaagagatccgagtaatagttagctggaatgacaaactgcggatttgctttatagagatcaatcaattgagactgaaaagctgatagtttgaaaaaataattttcctctgattcgtagactacctccgatccagtttctgtgctgacagttttgccatctctttgctcaacttgggattctggatagaaagtttcatcagaaacgctgtaccacccgctatgctttcccttgtaaatatagccattcttccaaacggtttcccaaaactggcgtactgtagccagatgatcagcatcagtggtccttataaacctgtcatactgaatatcgcttatttgagccagatgtttgaatttattgcttaagttgtcgcaaaacagtctcggatccgtcttgttcagttctgcagctatttggactttgagaccgtgttcatcagtaccagtagtaaagtagttcggtgtttccttaaggtccaaccatcttttttggaagtcacacagcagcatggaatatagatgacctaaatgaggagcagcattgacgtagaatattggagttgttatgaaatatttggaagcagagctcaggtatgctcccaccatattatattgtctataaaacgtagatggtaaatacagtggttaagtgcgagcgaaaatagttatacttgatgggtcgtctccttttggtgtgatacaaactatttactatataaaacgtagtttcgaactttgataccgattgaagtattcatgtaaccactagcatttcaccatcctattactgagtcttttccacaaaaatagccatcaaggcaaacacactgtagaacatggccaatggatatgcaatcaacatgcggacattctgtaatctcaaaactgacactataaacccagaagctgaagttgtgcaccacagaatagccaaaatagctgccacatacccaggaaggttgtccaatggaacgaaaacggcaactgccgacagcaacaccaagggtaacaaacaatatccaatgacactggcagtccgtatgagatcaatcgaagcgtcttgtgacatgagcttgaataaaatatgttggcatatggtaccgaaaagggcaactccatagatgtatccaaaatgagtcttcccactgagcaacaaaaaggtagcaaatgctaagcagaagagaataggaccagccaagtccgagtctgtcatgatatctgcacttatattgccacgccttggatttaatacggctgccgttttctctttaatatgtttaaaattgatacccaattcctcgagtaatggaggttctcccgggtacccactggtggaaaatgctgccaagaagccctgtgatagtttctgatctcctatggacccactgacattattaaagtccatagatccagaaggaaatgactggaatggcggtggctgctgctgttgttgctgttgtgattgagctgcgggaatttgaaagcctggagctggggagtgtgactggctcacatgatacggtgtttgcttttgctgaaacggttgctccgcagaataagattgttgttgtggaagcgacgcagggttgtattgaccaaactgctgtggttgttgatagaaagacattcccctttttggtatgtaatgccttcagttgtccagatcttagtgaagcttgtgatgggttcaagaagcaagagaaaatcgagggttagagaaaatagtgctagctaaaacgcggtttaaatatgatgatcctcaaaatattctactactctcagtagaaagcagaatgaaccatggaatacaccgatacgcatagagcactagttcaagtatttatggagaacaagatgctcactatacctgacattaaggaagtactgcaggctgtcaatgaaagtgatagagagatatccgtcaacgacaccatcaaacttatcaatgagaaattacattttctccatctggaaataaaatctataacactccaagatactacggaaaccgtgtattgctttgttaacacattaccggacaaagtcatggaattctctactattttcagcgtcacggaaattacaatcctgaagaagctaatcgaaatgataatgctgcatcgttccaatgattccgatgaagagtattatatcagtaggaaagaggccatcatattaattagagagcaatctagtctacaggtgaatcaagcgaatgatctgctccataaattggtggagaataaatggttcgaacgtcgtggtgataaatatactctttctccattatgtctcatagagttgaaagatatgctaattgaaaaatatcaaactagaaaggaaaacggaatcgttaacatctgtcagctatgtgaaggaatagtaactttaggtgtcaggtgcacttgctatattcgtctccatcacgactgtttcagaaagtacaatgtcattaacccacaagaaacatgtcccaatggccacaatcttccgcaaggtatggttggaaaaattttctacgaagtacaagaaaatgaaaccaactcataatccaagttcatccaaccatgcactttcgacctcatcaatcaagtcccacacatattcttctattttggagtcatcgtacaattcgttgtacattaggtattctttctctccttgaggagcaaattcaggtttattagctgtgtttaactgtactttccctcctctgaaacaactggccatgggataatagcccaaagaaccatcatctctggcacctttctttaattccgaagctggcggaagaaactcataaagattctcaaaagcagttccttttggttctccattcacaaaaactttgataaatgatccctgtattacgggaggcttgtatctgtctttatcgggaatagctttctcaccaaacacggtcactgggttcaataaatgatccataggtttcgtcactacatagtcatactgttcgaaaaacagctggttcttatatttaataggaatttcgtctcggtcaatatcgtcaatctttattctgtcagctaattgtatcagtaacccaatagtatcacccgtaccaaagctacccatgaaatcttgaggtctactcaaatgaaccttctgcccagtcagatctctgaagccgtaaccataagcatcgtaaccaactggtgcttctaaagaggcttctcttctaccaaaccccagtctaacgtgggaatctccctcagagtttagaattttaaactccacatataccctgccttgacgtataggtagtgaacctttcactgatctccaacaatcttcagatgtacattgatcacaatcctcatttatgcacattctctgtgatctatcgaaataggaaaacctgcctttataaggaggcaaatctgtagtagaatacatcttggaaagtaaaaacggattaggtcgacatggtttatacttgaaatctcttttattgtagggaatatcctcagttgtgccgcagcctggccctaattgaggtgctagcaatggttgatataagtccgactctttgtagggaacaggtttcagccggggaatttttgaactcattaatatgttcaatgatggtttatgctatataaggttgttggagagattctggtagaaggaagttctagctgtctaggcggagatcgcacattaagtttttgaatttttggcccgctctcccatgtctgtccccttgcaaatgatttcgagctaccctctgaacttctaaccttgaacctctgccttttggatatgagttctttccctaggatcaatattcccaaggttctggaggctcaggccaaatacaatatgtttacatgtgtaaggccggtagccatgcacattgagaatcctcacagtttactcaacatgaaattatgtgccattaaggacaatatatgtggaattccagaacctacaacttgtggctcaaagatgctgaagaactatagatcccccttcaaagctacagtactagaaatgctggaaaactatggcacagttattgtgggcaaaaccaacatggatgagttaggtatgggaagtactaatacaaacagcgtttttggaccagtctacaacccatcctttgataagactcaaaaaaaattgtctaagtatacattatcagaatcacaagacatcgaagaaacttatgattttcccaagcacatagctggtggatcatctggtggatctgccgctgcagtggcttctaacgttgttgattttgcattgggcacagatactggtggctcagtaaggctacctgcctcttactgtggcgttgttggcttcaagccgacttatggacggctttctcgttggggagtaattcaatacgctcaaagttttgacacagtcggtattttatctcgtgatgtagacacttcgaaagtagtttttgactacttgaacgagtttgacgagaaagatcctacttcgttacttccatctcatagagagagaattgatgagttggttgaaaccagaaacaaaggcttgcacaagttacgaattggaatacccaagcaactgaatctggatatcgattcgaacgtaagagaatcatggataaagcttatctcacaactattcgatcaggatcatgacatatacccggtagatataccatccgttgaacacagcataccctcttactatacattagtaccgtctgaagcagcatctaatctagcacgttacgacgggataagatatggttatagaagcaaattggactccaagggagatgttctttttgcacccaccagagatgaaggatttggggaagaggtcaaaaggagaattttaatcggaaactttaacttgtctcacgaagcatatattattcattacttaaaggcccagaatttaaggcatcaaataaaattggactttgataaagtttttcgtttccctaacgtcctaacttcttctcagccttcttcggaaggagtggacattttaattgctccaacaagtctttcaacggcgccaaccgtggaggaagccaattcgatgactccattagaggttttcgtcaatgatgcactaactgtaccctcgtcactggctgggctacccacttgtagtattcccatgaaaacaccagaaccaattggcatgcaagtgatcggtcaatttggtgacgataaccttgtgctaaatgccagccgtttgatacaacagttcatgtaaatattaaatcctgttaatatactcttctattttagtcaaagtcccttttttgttcaattgctttcggtcgtcccagataatcttagttaactgagaattatgctcctgcagttgatctatgttgaactttacagttttatttaccagaagctctttgagcctattggcatattcttgatcatactctaaattaacattgaatcttgcgtggaactcttgaatgtccggtccggagtcaggatcaaggttgggtggttcactcgcattcgagttagtctcacccttggcctctagcacggattcctcattagaagcacttgtggccccaatatctttggtactttcagctaatgggggctgaagaagctcagtagactcaaagatgtcgctcaccgctattccattaggcggttttatttgagcctgcaattgattctgcgatccaccaggcagttctgaatcttcaaccaatacggtctgatctccctctggagcctgggtgctagtcgccataaaagtatcttcaacaagagaagggaccaaattctctgaattcgaagttggattgatgcctggttctgcagtttctgcttgctgagattcgtatagtattcttgtagaatcttcttgaccggcttcttccggcttgctgtctgtgtgcacattgataaaggcttgatccagtgctaattgattcttgctttgttgaagatattttctttgtctttctgtctctcttgcatgcatcattttacactccttgatgaaattagcatcacctatttcttctattcccacttgggcatttgcaaacatttccgaagccttcaatagtctctcacgttccccaaactcgcgtgcatctctgtaaatcatttcaacgtctttaagaaattgctttggctcactatagaagccattccaaattctttcttctattacatcaagatccatgttataaaactttttcccagtagcaacctctaatatcatgtctccgtcacgttgatagggctgatcttcaggatgaatgttgctaatgtagtcatggaacaagtgaaccagataagaatcatcaatggtgggctttctaaatcgtttatacctttgtttgaatagttccatcaaagcactcagtttgatcttcaacatgtttttgagtctcatatctagtttttccaattgttttactgtgcttttatcatttgcttctactgtagattcctgttgcacttggggtaagtccctcaactttcgtctaggcctagtatcaatttcgttgaactcgattggcttcaaattaagagcagcaaatatttgctcaaaataatctcttctttcatctttatctgggtatttcagttcaattacattcttgaactcgaaaacatccaacaaaatttgtttctcttccgcaaccagtcttgaggagtcaagtaatcctaaaatcaagagctgatcattggcatcagcacttcttaaaagagccgatatagttgaaataacagtgtctggaacagatctaaaccaaatatccaaagatggaactatcactattgagggtttgtgtttctttgcttccatgaacttttgtactatgaccgcttccaaagttgatgaggaattggaactatcattgtacagggttcccaagtctaacgactggacatggtaaccttccatgtgatgcaaaatagctggtccgagatatatttgtcccattcctgaaccacctgaaatcaataatcttggtttataaactctggatcgtttcaatgactgaataagttcctgtctgtcaaatttattttttcccatgctggaatagtcaacatactgtgaatcctccaataatgtcacccttttttcagttggtaaagattggtgtaattctgctattatattgtctaggttctttttaagtagggactccaacgacttgggaagggggttactggggcttgcaatagatcgagcacttgaagggattattttctccaaagctagcatgaaatcatttgaggagacttctattttggaggggtctatttgtaatttcagttggctttgataaacttgaggatactttctttggatactgttcaatgctgcttccgtgcacaaagcccgcaaatccgaaccaccgtaaccttttgtcaattctgcaagtttttcgacgaaagttggttccagtggagggctccagtttttggtttgaatttgaagaatttcctttcttgctctgagatctggtaatgggaaataaaactccctatcaaatcgcccaggtcttctgagagcgggatcaactgaatctgggcggttcgttgcaccaattacaatgacctgacctctattgtccatcccatccatgagggccaaaagtgtagacacgatggaggcgtggatctgctcttgcttcgacgacctcaccggagccaagccatcaatttcgtcaaaaaagataatgcttggctgttggtttttagcttcttcaaacagtagtctcagttgcctttctgcctctcctacccacttggagaggcagtctgcacctttgcgcataaaaaatgtaacttttgtatttcctgtagaacaggatgcggctagcgctctagccatgagagtcttaccagttcctggaggaccgtgaaacagaacaccacggggtggtgtgatgtgaaaacgtgtgtaaacttcaggatacaataaaggcaacataaccatttccttcagttgattaatgtaattgtccaagcctccaacgctagtaaaatcaatgttcatatcgacacctaaaggatctgagtcagccaaagagttcttttttgatttgataactttacccatgttagctggaccggtattaaattttgcattaggatctttcctgttgcttttagagttgatcggcgcaatttcatcctcagatgaagagctagagtcgttatttaatgccgtgagtccaggtacattttgaccaaagattgaagttacatcactgcctccaaatggacctacagtggggaacagacgcttcaatcgattggcatgagaactgtatgctcgttttttcggagttggggggttcactagttcagttatctcatttgcaagtgggggtgggatagtataatcaacgttcttcctgttcctcaggttcagctttctggaagggggagtatttggaggagaatccttgagatcttcgagctcttgttggatcgaggatgcggcatgatcagaaacttctacagattgggaagcgttagcatcatcctcttcctcttcagaatcgagtatttgtcttcttgactttctggactgagaattggagccttttgacctggaactgcgagttcttcgagctctgcgacgacccttggatttggaatcatcgtaatcaaaatcgtccttcactatgaactcttcatcagcctttctctttgcgaatctttcctcctcagaggttaatccatcaaattcagagtcagcctgatcatcgccgttgtaatcttcagaatcattgtattcgctttctttatcgctatgttcattcttcacgttattatcggtttggtcaacctggactgtggtattttcagtagggtcgttatggccattttcattgacattttcattagtcaacttgtcgccgccatcatcgtcgtcctgatcctggtatgcctggtcaaagatagcatcctcgttataatttaccttttgctttttacgcctgggaggtaaaatctcatcttcttcgttggaatgtttctcctcggtgagaatatcactcgtttgacgacgatgcctagctctaactctgggggacgattccacggaattgttttgggacggcgtccttctgcgaaccatctaccttctgaatgtatcaaaagtactcaattgaagaccagtaattcagatatgatactttgaggacaaattaatccgactgtgctgtcttcagtggttcgaagatctagttactaggcaccaaagtgaaaggtgatgaaagagacgtacgaaaatggtaactgatagaccatacgcgaagtcagcgcgctttttcattagccttgaaatggtcgtctgggaaccgctcgggacaccgtctcacgtactaagatcgaggctgacagagtgaactacaacttttagcttttagaacgttgaaaaatcatcgattttggaaaagattcagctgctcttgagcaattaataaaaactagataatcgcaagcatatattatgctttaaacgcaccagttaggcccgaatttgttcctgaatttctctgctccggcgatgagctattatcgtaaggtgattttcttagtctcgaaggtgtcaaatccataaaaaagagcgatgcagccagggagaagatctttcttctcttgctataaatcaaacattattcatacagagtttaatcgattcaacaaagcataacattgattgcaattggttccgtcttgaactgctaaggagaacaatcataaattagtattttgtttgcttgttagactcaaatcgaattacagatgccagaaccatctataagtgcactttccttcacttcgtttgtcactaatgatgacaaactgtttgaagagactttcaatttttacacgaagttgggcttccacgcaacacgctcatatgttaaagacaaccggtcagactttgaattgacggggatttccacggattcaatcaaggaaatctggctggaaagtttcccactatctgaagtggtcgaaacgtcagctggtagagagttgagaaaaccactgcaagaatctgtgggctaccaatctgaagctcttctgggatattctccctaccagagtgacggtgttgttataaaattaaggttatcaaatcatgaccttcagaaaaacaaagacttgcccggtgaagttacgtttttcaccgctagtatcgacaaattaagagctaaactcattgaaattggtgctgagataattccctcagaaatagaccttgttgaattttcaaccaaggatcctatgggcgacgtcattagcttttcttcttatccctctttgagttccaagaagattacctctccagactttttcctccaccctaagaaggaagtacgctcccaagaatcaatagttgagcaggttaaatctgaagaaggtaagaagaagattgccatcataacttcaggtggagacgcaccgggaatgaatgctgcagtaagggctgtgacaagagccggtattttctatggctgtaaagtttacgcttgttatgaaggttacactggactggttaagggtggtgatatgttaaaggaactgcagtggcaagatgtccgtggtttactttccattggtggtaccataattggtactgcaagaagtaaggaattcagagaacgatggggccgtcttcaagcttgctacaatatggtcagcaatggtattgatgcgttagttgtttgtggaggtgacggatctcttacaggtgccgatctatttcgaaatgaatggcctgaactgataaaggaacttttgggtgagggcaaaattacaaaagaacaatatgaaacacacagaaacttgacaatcgtaggtctcgttggttctatcgataacgatatgtgcggaactgattccacaattggtgcttattcctcattggagagaatcatagagctggtagactacatcgatgctactgccgcctcccattcacgagccttcgtggtggaagtcatgggtagacattgtggatggttaggtttaatgtccggaattgctactggagctgattacattttcatccctgaaagacctccaagtgaaacaaactggaaggacgacttgaagaaagtctgtttgagacatagagagaaaggacgcaggaagaccaccgttattgttgctgaaggtgctattgatgaccaactgaaccctatcacttctgaagaggtgaaagatgtactagtggagattggtttggacactcgtattacccgtctaggacatgtccaaagaggtggagctccgtgtgcttttgatagattcttggccactgttcaaggtgttgatgctgttagggctgttttagaaagcaccccagcaattccttctcctgtcatcagcattttggagaacaaaattgttcgccagccgttggtggaatctgttgctcaaacaaagactgtcagtgatgctatcgaggccaaggatttcgataaagctttgaaattaagagaccaagagtttgccacatcatatgagagcttcctgtccgtttccaagtatgacgatggatcatatctagtaccagagagctcaagattaaatattgccatcatccatgtgggagctccaacatctgcgttgaatcctgccacaagagttgctactttgaactcgttggcaaaaggacacagagtttttgctattcgaaacggatttgcaggattaattcgccacggcgctgtacgagagctcaactggattgatgttgaggactggcacaacacaggtgggtcggagattggtaccaacagaagtcttcctagtgatgatatgggcactgtggcgtactacttccagcaatacaagtttgatggtcttattattatcggtggatttgaagctttcacagctctgtaccagctggacgcagctcgtgctcagtatcctatcttcaatattccaatgtgttgtcttccagctactgtttctaataacgttcctggtaccgagtattccttagggtctgacacatgtctaaacaccttgtctggatactgtgatgctgtgaaacaatctgcttctgctagtagaagaagaacatttgttgtggaagttcaaggtggatactcaggatatcttgccagctacgctggtctgatcacaggagctttggctgtttatactcctgaaaacccaatcaaccttcaaacagtgcaggaagacattgaattgttgactcgaacatacgaggaagacgatggtaagaacagatcgggtaaaatctttattcataatgaaaaggcttcaaaggtttacaccacggatctgattgctgctatcataggtgaagctggaaagggtaggtttgagagccgtactgccgtgcctggtcatgtacaacagggtaaatctccctcatctattgaccgggttaatgcctgcagactggctatcaaatgttgtaacttcatcgaggacgccaatttccaggtgaaacacaatgccaatttgagcgccgacgaacgtcatttgagattcttttacgatgacggagttaagacatctgcagtgagcggcaaatcttccgtgatagatgataacacgtcagtggtcattggaatccaaggttccgaggttacattcactcctgtaaaacagctatgggagaaggaaactcatcataagtggcgaaagggtaagaacgttcattgggagcagttgaacattgtctctgacctcttgagtggtcgtttgtctattcgtaccacgtaaaagacggatcaaatcggttgtttgggtactaaagacaatccattttttttctttctctcgagctggatgaaactagtgcatgtacgaatccgtgtgtaatctactgggatgcttattttacgcatttttgttgataaaaatagagacctactactactcctgatttcaagcctttctacctgtaagtttcgtttttttttgctggtgacaatagcctttttttttaccttttttgccatcgttgcgtcctgtatagcttcttaaatgtctccgcaacaatttttatgggagcaatagattacctctggttttactcgtaacctctagggttaataggcccattaaattggctatgggaatgcgagtgatatggcttcaactatagagagtgcggattattgttcattttctactgtatgcaagatgtggcatttttcttattgtggtgaaaggtaccgctgcccctcaattggttgcatactgaaacgacaagttgagtcgagtccctggaaaatcctaccagttgcaggcaaaataagtcaaccacgccgatcatcacagcgaaaagagttgcatttggttttgagagacggtgttttggtaaacagcaagccccaatgcaaacgatcataccgatctgccatggcagcctgttggtcacatgaaacacacaggagcacaggggaagttttattatcatgcgcggtgcaataaatgtgcatgagttacgcatttcggatatctgctccttatataaaagtgtttacagagaccatagtatgatgcgcgtatagtctctgtatctaccttgcttttgttctgcacaacaccacatttttcttggaccacttctagcataatccgtctgtgaaaaatgcacaccgcacttatctttcacgtatttgaagaaaagcctttttcatcgatcgaatgatattgcacttggacgcacgaacacacccattaccaataagaatgttcaaaaaaaaacaaccatcatgcacagatcacattgcacctgataacttgtggcattatttctgcttctttaaccttccataacaccacttttggtactttttccagcttcgcctcaatagcataataaaccagctgacatttcacagtaaaactttgtgtattgctaagacctctttacagacatcattttgtgatctgtttacgaagtcagcacatgagttgccgtttctttttttttttcttgtgaggagcgaattttcaacaattatgtcagttgccctgcttgaagaagcgtatatctcaaggaacatcaccgcatttttttttccccttttcttactttatcgaatctcagtcttcactgtagttttttttttccggcctgttttccgtcataggatccactacagtacgtgtatcgccgggagattatttctaccatcccatacctcttcaatcgttttcatttgaagacaagaaaggcacacaagtcttatcactccactcaaaaagtgaacgagaaacaccacctatatgacttaggtatgcctgaaagtcgaacaagcaaaggctcgatcaagagcgtacccaagaagtctgcctttgtgcacaaactttataccatgctttcgaatgaagagctaaatgatctgatttggtggaccggccctgaagaatcgggcacttttgcattacttccgggcgctgaattttccaaggtgctgtccacttacttcaagcatgccaacgtatccagttttgttcggcaactacacatgtatgggttccataaagtttccgaacagccgcttgtacagggtgataccataccgaaagttacctgggagtttcgtcattcaaacggtaagttccgcaagggtaacgaagactctttgccgctaataaaaagacgttctacgtcctcctcctccaaaagtattactacagactatgtaaagttccgtgtccatgatcaatattcctatttcccccaggatttacagtacccccagaatccacagcaatccaatcaagaaggtgagacggaacatacacagcaacctgtattatatcatcctcagcctactgtttattatcaccctaatgttggcgtgccccctgctccgccggcgccagcactggcacctcctccattttcacatcttggccaaccgatgcaaccaatgagtcaccaacagccccaacagcagattcaacagcaacatcatcaccaaccccagtcccagcacggccagccccaacagccccaacagcaatatcgacagtatacctctcatcccccgcctgcgttgttgccgtttacacctatgtacaatatgagaccgatgacagcttctcccacaaatatggagcctatggtattgcctacttaccattctatgagattgattgaaactgaactggaggtcaagcagtcccacctacaatcaaaatcggacgcactcataaaacaagttcatgattataataagcatatccccagtttggttcaattgattcctcctcacttcgagcctaaagtagacagaaacattcaacatagtcggctctccggtatagaagcgtctgttaggaacagaatttccaagttgagtcagccgaacccacaaccaatacattctgcacattcgtcatttgtttcttcaaagagaaattcctctttagttgatccattgcaggatctgcctttgacagcaccagtccctaataccggctccggctttttgtctgctcatagagggttttatgttcccaaaacgaattcagtatcatcatcatcttcccttcctgtcactcatgatcttcctgcaagaagaactcccactcctttcaaagatagaaaccctggcgactcctcagttgaaagttcccattctcaattaagaccatctatttttagggttcataccaaggaggagccagtaaaagctgaaaagagctccattttcagtaacaaagacgattcaattttttccaacgtgcatgcgtcctctattttctcacaaaaaacctccattgcatcccaaagatcttcattgtctatgattcttaacaagcctacagttgattcacgcgactccataactggctctcctctccgcaaagtttctgtacacacgattgacgaagaatcaacttcatcgtcaaacaaacgttcgcacgacgatagtaacggctttgaagataaacggggtaaactcatgaaactagattcctaggttatttttaggggtcatttattgccattcctttttttaggctttatttctttttatattttcccagtatgtattagtattatagattatggtgactgtcactggaaaatgagctgccacatcaaaattagtccgtacaagccgcttcgaagccaccaacccgagtccgtgtagttagttgctggcaaattgtcgatcgacaattgattcagaagggtcaaagcttcatcccaatgattgctgttgaaaagctcaacagcctctttccgtctctggagaacgttccggaacaaattgtgcttttctttatatttgttttcaccttggttgatttgtagtaacatgccatagaatgacatcatttgttgtagaaatttcaaccggattgccttatccacctgaaacttcaaattattcggtgtaacagtgctcaaaaatgaatccacgcttcggttttcacatatagttgaattcaagacagtcactttactaagcctccgtatcacgctggtgtcgttcacacaaactgtttccagatcgattggttcattaggtatggtaacgtatttcttcccagtaaacttccttgtatagtgatttgcagctagcgactccagttcagactctaataaatgatacagagccgcctgagacacaaaaaagggaagatcgttctctctaattgactgcagttgatggtataaatcaattataggctcgttctcatatatgcttatggcatcgttgtcactgataatcagatccatttgaaaatagcaatctggagaaaagctgtaataatccaccttgtattgacagataagtccttggtttatcctgtttagctcgtagttggtttgaatttgactgctttcagcaagatctggaagcttcaattgctctgggttaagagatatggataatctaatctcgatgtcttccaggggagattctctaaaataatcaactagtttgttcctatttgcctcatccgatttgtatagaagcccttcaaataacaagataatagttgatgaaaacagagcagatctccatgtcatatcatgtaacccacaagagcgagttcctataattctttaatagcgaaaaatacaactctgaggccccaaaaaaaatcaatccctgcaactcaggcccaattgtcctcagatggatcaaatatccatagaaacagaaaaggaccgttttgaaaatgtcaaagaccccgctttgaaagaggaaacatacgttcacactgtctataatgagatagcctcgcatttttcacaaaccagatacaagccttggcccatagttgaaaaattcctaaactcccggaagaattattccatcggcttggatgtaggatgtggaaatgggaaatacctaggtgtcaataaaaatcttatgatactaggctcagacagatcggatgggctaattcgatgcgcgtacaagaatggacatagagggttgttggtagcagatggcctacaactaccccaccacaatgacagatttgattttgccgtcagcatagcagtgattcaccatttctccacggaagaaagaaggatacaagccatcaaacatatcttgtcaaaactcagaccacaaggggaagcattaatctattgctgggctttggaacaggagaatagcagaagaggctggaaggagggaatggaccaggatcagttggttccctgggtaatgaagagtcagaatgagcaacagacaaaattaagatactatcatctttataagaaaggcgagttgatagataatagcgtaagtgctggaggggagatcgttgaagatggttacgagaaggataattggtgggtaatagtcagaaaagtctgatctttgattctttatacaatcatagttacgttgatattgtcatgttttttttttgttttttccttttcttgcttactttctctacttcatctcttgcacgccttcctttgcatttgcatgtattatatcatccatttcaaattaagttatcgaactagcaccattgcttactgaggagtttggtccctggctttgcaatgtagcattccttcgttcagtcttacctttcttcattacctgtttcaatgcaacactgtctaagggatctagtagttcaaagctacataagagttcatctgagacactcatgacagctccccaattatcaaactctccacagtaatttggcgcgctgaagacggtgacaagtgacctgttgttgaagaactcatatccgtcttcaaccaccatatgcgccctcaccaccagatcaaattgaaacttgttcaagaacttgtttatggctattttgttgaaacaatatgagacacctcgttcattatcgacccattcatttgaagtgtcagcaggatctgaccagagcagatcgtttagcagtccaaactcaggtacatcagtaggcctttgaatcctctttatatcgtccatggaatttaacattggtgataatccgccatgaacacaaaagatctttgatgcaatgacagcggtgataggcaaagtattaaaagtatccacaaacatcttccatgttttcaaattggctcttcttttgcactcatcgtaaaacccataagctttagtcacattagcacattcatgatttccccttaataagaagaaattctctggatacttgatcttataacataacagtagcaaaatcgtttctaaagactgtttccctctatcaacatagtcacctaaaaataaataatttgaagcaggggggaatccacacttggtgaacattcgaattaaatctccaaattgaccatgtatatcacctacaattttaacgggtggtgataattctaagagaggaggttgcgacaaaaatagctctctagcctttgagcatatcacagatatctcactggttttaagacatatatttttggttctttttccagaataaccagcatctagtagccgctgtataatatcctcaatattaataaccacacctctacttgtcattaaagtagtttttgggacagaagttgacattgttgaaacggaatcggaattagcaggagaattaatattggagtgtgatgactttggagtgttagcaccactgctattgttgttgttactgtgacttagagcagttaaactggtgctgcttccttgagtgaccgttaaatggggtgtatttataggcgaagacggagagctcgtatagctgcttaatccggtattattaaacccagaatgctgttcaggactcgtgttagaaactccattggttatatcttgttgttttaatatgggttgtcttggttccatttgtatcatggagggaggcaattgtaagttgtaatcatcgccaactgacagactgccgaattctccgctaagtctgtctgtagatgctcccattattggtgttattgtgggctttatatcatttctaaaggatgatttcctgcttctattgtcaaaactttgcgaaggcttaaacgatccagcgtcgtttaaatgttgcgacgagtccttcgagagacttcttcgacttcggaacgacctcacggaacgcgtactagtcattgtatcggacctgggtaaggctccctcttttcccttcggttgctttgaagttgaatttcccatcttgtgctaaagtaaactatttgaaagtagtaacttagattgggcaatgtaggggtggtagtaaattgggtgtttcctcttcctttctttatttcctctttttatgtcttttttagtggtggcctattcttggagtgtgtttgagcgatagtgagcaacagagagtgggaagtttatccgaggaaggtgacttctttccggcacgagttgaagttagatgggtaaagggtggtggtatcttttctgtgtggtggactctaagctcaatcatccctgtggtgttcagatgtattattatctcctatcagcagttttaatacggtacacaaccatttttatcacaccgtgcatctttagtcaacattgagaaataaatatacagacttcctgtccagcattgtcgatactcaacgaatggagaagtaccaggataagtaccacccgaaatttgttccaggtacctattcaattcgtgctgttaaaaacagcaagctatggggtggtaatggagatagtaaggtgtggaagatgagaaacgggatgatattgttaccccaaccttctaattcaattaatgaccccttaaattggggtttccttcgcaaatctgttcattttatccaactggtcatcttggctgggttcactgccgcaatatccaataatgcttccgcggtgcagactgacattcatgacgagtttaacatctcctacgactcaatgaatacgggagcaggagtgctgtttgttgcgatcgcattaagttgttttttacttggtcctatttgtcgtgtttacggtagaaaaattgtctacttgatcggcctagtttttgcagtgctgggatgtatatggttcactgaactaaggaatcaagccgacgctatttgctcccaaatattcattggcataagccagggaagtacctcagctcaggttcaacattccttttcagatatgttttttaatcatcagcttggagcctctattacgatatacgttttgagttattgtataggaacttatcttggtccgttgataacaagatacataacaacaagccaaggatggcactgggttggatggtatggagccataatagctggtatcttgttagtggtgtgtatcttgtttttggaagacacttcgtttgacagatcacgatatgatgctcttttggacggtgaaactcagaaaaacttttacgagacaaagttatccagattaaacagcaggggccaacagaaattgcaacaaatcaaggaattgcaaaacatgcttagaaattcactaaatgcaacttccacggaggaagataatgactccataaatttgaggccctataatttatattaccccaatggccaaggcgatgaagaagaacctaaatcgtactatcaaaggatgaagcttttacgaaaaacccccaaaattggagatttttctaagctgtcttctttactggtgcattcgttaaaggtattttcctttccctcagtatggttaagtggcgccttttttggttttcaactctctgccttatcgttttatttaactacagaggacactaactatgctgaacctccgttttcttatagtgattctgaaatcgcccgaatgaacataccacctttaataggaagtattattgggtgtctttatgctgggtccactttagactactttgtgctttggttatcccgaaagaacgatgacaaacgagaggccgagtttcgattatggtttgcactcttgaatgctataatatccccggctggattgctaatgttcggaattggcactgcaaggaatctagattggagagtagcgtatgtcggtttaggattcataggatttggattcagcgttggcagtgatctggctttcacttatgttatggaatgctatcctgaaatgatattggaatgtatgacaggtgtggcaactattgctaacttcctaggctgcatttttacttttgcttgctctccttggttggacgcttctggagtggagaatacgtacatagcactcgctgttattaatattgttttaatgcttgcttcacttccatttattaaatggggcaagcattttagggcccgtacgagggagggctatttgagttttgtggagaatatagaaaattgactatagaaaattgagtgatatgtacattagtttatattatggagataattaattgacaatgagtggctggcacctgtagtattgtgtttggagtgatgtggaaagcaaagaatgaaagaattgaccaaactttttagataattattgaatggtggtacgtgtggctccctttaattattgcttcaggaaatctaacattggttctgcaatatcctgaatgacatcatccgaccacaagacgtccagatgggcatattcttttagttccagataggtaactacagggctctgaaaacaattcatgagtttcttcccatcgacgagcaaatctatggatcctaaaacacaaaaaattctgggtagttcctcctcaatttttgcccaatcaccgttatcaaaaactgatttctgatgggcatatccaactgaatcactaagccaccatttcatcaatttggcgctaacataaactggggaaaaaagaaaatgaatgctgcgaatttcaggatcccataaggtatcattccattcaaataaatagttgaacatggcgtacgcacagaaatcaaaaagtttatagcggtaaagaacgctccgcaccttcatcataattggcataaatgcttgaataccgaacaaccaatcataaccagtaggagatagccatcgcatgaaacgaaacaaaagacgatcatttatcatttcgcctccaaatacggctggagccaagcagaccaatttatcaatatgctctaagtttcgattggccaataagtaaaatacttgggtaccgccttgtgaatgacaacataaatttatagactgtgaattggtagcattcttaacgtgctctatcatggttttcaggtcaaatgtagccatctcatgaatttcccaatcccacattttaggatcgttgtccttaaagaccatgtgcgttggatgaaagccacatctattgtttccgagccatacatcgtacccgttcatcaacaggtaataggctatactttttcttccggatgacaagaaagaggcggaactttgaagtagaccatgcaataacaaaatgggctttgaagagacttctttgttgggattcaccagtctctgaatcactatttcaaagccatctggggtgagtatgtggtattcaagaagatctagtcccagcatgtgagcgtaaaactgtagatcatctctcttgggaaggggcctgggaaatgccttaactgccattaactttctattctttttctgaaacaaattgtgcactgaggccaagaccatcaatatggtcagtaatagagttgcaaacgaccatgccaccaatgtcctcagtgtttccttgatcggcaacataagcgtttaaggtaaacagagatattccggcgcgctatgccagatccgtaggatacgatttcgagccattgggtctacagatcctgtttctaacatcttagcaaaagtctttagtgaatcaaccacaatgggatggaacatcaggaggctagaaaacggagacttatgctgtactattactgaatttgaggacaaaattataattcaaataacgtacgctggccaactggataccactttccaagttttgagagaggacgtacaagttcttgtaggcaataccttggtcagcgatggaactgacctgaaaaatagggtaatcgccggcgaaattggtaaactactggcattagaatcaaataaacaactgatattgagtgtcagcagtaagatatggaaatgtatgcaaggttcagagtttgatatcatgactagagttctatcgacacttaaagacactatgaacgaaaatcccaaactacgagcacaatatgaacagacgtcgaaaaaagaaagagattattacatagtataaattaattacaaagttccggaactctcattgatagcagccatttccaaaagttcaactttggccatattgaaaagttccctataatttgaagggtctatatatgcaaatgcttcccactcagaagaccagttttcagactcaatctctgtaatcaagctatgaagtttatctttgctagctttagcatctttcgagttcatcacaatcttaaccttcatctttgctctggcaatggggattagttgcttggataccaacaacctgatggcgtccagcgcatgtgattttgccggttttgtagacgtcaagttgaacttcagctcgtttagtgccttatgaatcattgtagttggatatcttttcatggttttagggttgatgcatttagcactaactaactgcagtacctcggccgtgtacttggatgagttggcctgtctttctttttcactaagttggatctctcctttattcagaatctcctttatgatcgtgtcagtatctgtagttccaaaacatttttttaggtcatcatgaggagcaacctggcctttggaaacgtttacaaatacttgaggaatctgtagcacttcgtctatatccttttccgctccagatctccagtcttgaatcttgttttgataacaggcaatctcgaaccgtttcttgttctttctcatcctgaccaaggagacgttagtcaacttgatctgagacataggctgattaatcggcattttgggtagagtctgtgatgagcagaaggatgagacaggattttttttcttgaagggcgtatgcacttggtcacgtgacaatctaggtaatatgaaacatgggggagaatcagcgggccaaacattgaggccgctttccatgaaagtgagggaccaagctacaggcaaagaaatgacagatgcggatcatacgtgaaccacatggtcttggtatttggcgatgttttgaaatttcctgcttaatagaactcccaaccaatttgttatcgcacctgtcaagaatgagtttccaggaacgtaatttcactacgtcaagctctccttcggtctacatagcttatgacacacaaggttaactgtagtcagcctggatttacatcccacctatcactgttcactcactccagtatggtacactgttgccaagacacgggtttcaatcctccctgattctgtcacctgggaaagttaattctcgaattgcaggcattataggatcttttcttattctaaaacctttcttgctttctttttatcacccaatctttaacatgacagaaaattcagcagagctaaggaaaaggtccgttaagaacgacagcggatctttcccttactcggatagtgtccttatgaaaagggcctcttcaagctcttctgagttgttgggaaacctcgccgatgaatcaaccaaagaggaatacttgttgaacaagctggatatgtttcttagtgatttggaattcaagctagacaattttgaggagtacatgagctcctcaaatcatgaacatctggaatttattagcacacttttgtcactcaaagacaaggttgttcgtaaaagtaaacagtttcatatggatcaaatcctcaagatcattgaagataactatggcgcattgctgcctagtagcctgaacgtgacggagaaattgatcacagccattaacttcctggatgcaaagctttctgaatttgacaaactacttattgaggagcagaaccagttaatgccaatcatcaaccaaaagctgatgaatgtcgatgaagccatagagaaaggagccgacaataaactcattcatttctacgatctcccctttcactggagagaaaataaatacattgtttttggttacagattcaacggtacacacaaggaggcaaccaaatctatatgccaatgccataatgaaacattcaatatctggtcccatttgttaggtgccatgctattagtttatctcagtttttgtcatttgccttctatggaattgtttcaatcgtttaatatgacagacaagtttgtcttgtaccagttcatgttttgcgctttccactgtctcatgagctcaacattttggcattcgttcagcaacattgcaagttttccattgcgcaacagttatgcgtgtgttgactacactggaattaccgtcctcatcacatcatcagtcgttactacggaacatgttgcccttcagcatgtaaatgcgtggtataggatatgcctgatcacgttttccgttctatcaggtgttgcgggcgtcatgttcacgtggtcgccttactttgataaacctgaaaaccggcacctgaggatatctttttttgtttcattagcatttctgggggtatcaaccttcgtactcctttggtttctaaagggagttagtcctacgtttgcattttattttccattactccgaagctttgcatcatatggaattggggttgtcttttatgcgacgttcattcctgaaaaatggagaaccgatgtggtggtagacaataaggagatttgtgataggacattattgaccctctacaaagaatctagactcgaggaggagctgtataacaagacaccagaattaacatccaaaggcaagaagaaacacctgacttcactttattggtgtgactatatattgtcatcccacaatatctggcatttgttcgtgcttggaggaattcttggccattattcggccatcttggagatgttcgggaacatgaaggactttgtctgaggaaaacaagttgatattagagagttaacattactgattgaagtagattgtatatacacgcatgcattggttcataggtatcttttaattgagctttgcctatcatttaacccctgcaactaaccacaccatctgtacggaattgtgatttgtttctcgaatggtaccatctttttagtctcgacatctatcatctataaaagacagggataccccctagctcttcttatcttatcttatccgcaaaatgtctttagagggcacctcaattgagtacgacaaactaactttcaaagacaatgcttctccattgaccttcaagaaagtcacacacaagttacctgtttcaaaggatgaaattgccgtgaaagttacggccgctggtttaaatcccgtggatttggggatatattacacatttcacccttgggtatcgtgtcttttccccagctaccgtactttgggtcgggattattctggtaccgtagtacaggttggttcggatttacaaaaccagtattatgtgggcgataaagtgtttggttatgtgcctacgctttcaactggaaccttagcacaatatctgttcctaaagcccaaaaccaaacacgatgcttcaattgtcagagttgatagcagcgtcacagatgaaaaattagttgattttgcaggaattcctcttgtattcctaactactgttcaatcgctgtcggttgcacccttgtcagacaaatctcgtgttgtaattatcggtggaagtacgtccctaggatggaccgctatacagcttttattaaaccactacaaagtcaaacccgaaaacttggtatctgtcaatggttcacgttccaacagttttgttcaagaactgggtgtattgcagcagaataccatcaattacgatcaagttgatagtctccagaatcctgttctggaaaaggccaaagacggaaagtttgatctcatattggatgcagcaggaaatagtgacctgttcgatcatatcaaggagattttgaaatctaaggaggagaacggccattatgtaacactagtaggggaccataagccagtttacgcttcaagtttacttgcacgtttcccctcatcttttgcttccttcaagagatttatctactggaaccttattggcggtggtcccattcactatcaattcagaaacgtacatgctagtaagaaagacattgatttggcctatcgattgtacaaagaaggtaattacaaggtcatagttgattcgatttacagatctgaggaggtaactgaggcctacaagagattggagtccaatcaagcgagaggtaaagtaattgtcaagttttagttcattttctcattctgtgatagctatttagcttttagttttgttgtaaagtttatttgtacttctctaatcatactggtatcggtttgctttttgagtgttctgaatagttaccttcggaaaattcggtactgggggaagttttctgcccttcggctccagagctattggtattatcctcgatattaccgtgctcagtagaatgataattgtgatggtgggcctctagtcttctacgctcttcattttcctcaagagtctcttcaattaatggttgttcttcgtcagtattcttgtccgtcctgaaaatgcacaacacacaacatgaaaggattgcagatatgaaaagaattccaataagaaccccaatactaactgcaaccattggcaggtgaatcattggtactttgtttggatcatcaaatagccaattaggatcaataggcctatctaagatcaataggcatgacgatttgttgtagcgtcctggatgaacggactcatgatgtagagttcttttagtacatcctttattgatcactctcacttccttatccttaccttcaacaatctgcaatgtaactgaatctttggatacccgtcgacaagataaattggtgttattcaacagggtaggaattcgattttcacaatcgataagtttatccaaggacccaggaggaagtatatgaagagcaataaatgattttaggtagctcgggttggaaaataaagtgatgtttgaagactccaatgattcttttgtgggaagaagaatcgaatatccgtcttcttcaagtatctcggtcaaattagaccagcttaaaatgtcctggaaaatggtagaatctacaacagtcagtagttgttgaagctttatatccaacgattcgggtaggatgatctcagaaactggatgaacaacacctacatcgaacaagatatctgtatactttcgcaagtcaagttcagtgtcattgactttcaattttgtaataccatcttgatcgtcgtcaggctcaatagttaatatgacaggttcgttagcaatgcttgtagactccaccgttcccacgaaatcactatatataggaccatcaatgataagattctctaagaccagggccaaagcagtcttgttcgaccttaggtagtctaatgtaagtcccaaattgttccatgaattgaagcatggtagtaaaacagtgtacccttttgatttgggaaaatgaagcagatctaaatcttccagaaattgtaaagatctagaacaatgaaaataagacccaacagcagtccccaaagacgacggggtagtcaaagcttcatcaatgtaaaaaatggaggtatttcctattttgtatgatgaactgtccacaacaacaaggttgttaataaaaagatcatgtccgatgagattcaatttgagcttttgacaaccaccaatctttgagggacaatacttggaatccaaaagctcagaattgcctgacagctgaccttcagcaaattggtaaagtatgttgttcttgtttactccataaggttgaaaattttcggtatcatcgtcattatcggttactctgggaatgaaaatagtctgatttaggctcggatcatcaataagataagagagctttcggaaaattatttcatcgacaaactctgattcattcaatccataaagaacctttaaaggggtgaaatgtggaaatcctttgaacaagtttgtagaaaattcgtgtataataccatttgacgctaatacatttgcttctgttgataggaatgtatcatttagagagatttcaaggccgtgatcaacagatgaaaaatcaacgatatcaccattcaaatttaccaaagatgtgttgacatcacccccataaattcctggcactagatgatgaaacaaaaacgttttctgatcctcatttgcatactgtgaggtaaggtacgaaaattctacttcattgtacggtagcttccgtggcaaaaagcaggtcacattattaaggaaatctgaatcaattgtagaagcacggagtatttcaccgaagtctcccttttcactcaatgtagcgtacaagtcatccacaggggatagcagctcctcaacaccttggacaaccgcatcctgagactctgcttctagatcgggttcaactatgctgatatttgatactttaaactcaccatactcatcaaagctagtgaagctggtcggattgttgactaaattgggaaatattcgaaccccttcgaaagaatcggagtaaatgacgtatgggatcaagtaccgtttcagctcctcagagtcaaaggcatttagatcggacggtaaaaaagccgaattaataggagcaactaacgtaaaattgtccatctgattcagtaaaggaaccagtccattgcgctgaataactcttaagaatttgctaaactgcacttgagaggaaagaatgtcaactaccgtagtcgtgggcacgtgctcaaaatcgtctgccaccacacctggagtttgatctatgaatgcaattgctaatgctgcccgtaaaagggagtatacgtaattggctaatatcatgatttgaagctgcgttcctgatcaacttggaactattaacgaaagataagcagagagaagaaaggttgcaacaggtagcgcgaaccaagtagagcaactggaaggaaaaagtacccacggttatttccttcccgcgcaactttggtctccagaaggagacggaacgaatcgcacggaaagtgctgggaggggcagaaaagaaaagttcaaccaagtattcagccgaagaacaaatgtcagaagaaacccaggacaataaagaacaacctcaacagtcacaactggattccaaccagacagagtcgcaggcttctcagcaagaactggaccagtggaaagctaaaatggccgaaatggaggccgaagttaacaaactgagagaacttcaaggacaacaagaggttggatctaggcccgaaaacggagtaggaacagccaattcggattcagatcctaagttcctatccatagaagagagacaagaaattgacagcaaaagtatatacgttggcaacgttgatttttcagcaactccaggagagttagcggaacatttcaagacttgtggtacagttaacagagtcaccattttgatggataaggtgacgggaagacctaaagggtttgcatatgtggaattttctgaccccagttctgtatcagaatcattagtgctaaatgattcagagtttcatggtagaaacctaaaagtggtcccaaagagaaccaacatgccttcattcatggtgaggggccgtggacgaggtcgtggaggtagaggttcatttggacccagaggacgaggcgatagaggtgggcgaggcggtagagctagaggaagagcaagatttgtaccttactgatgttatcgatgtgtgatagctcagataaaagagaacacagtgtataattaactctacggatggtcaggtatgacctccactaatgaattatattttaccatctctccttgcagagttcaaaagactgatgaaagataagaatgatgcctgagaaacatcttcatggataccaacaccccaaaccttgcagtcatcgccaatggcacagtgtaagtatgtagcggccttggagttggaatcttttcctaaagagtgttcatggtagttcaagaccagtacatcttttttcaggtaagaagaaatagcgctggcaaatgaggaaattggaccgttaccaataccttttaaggaaacagtgtcttttccaacttggagttcaacgttgatcagtctagcgcttttggatgtatttgtaatagagtaatctaccagttggaagtaaagatcgtgctgggtgtcatcatcatcaacaaagtaagagttcttgaacaggtttgtgatctctttgttgtacaactctcttcctttaacttctgactcattttggacgatcttagagaaggaaacttgcaaagcacgaggaagatccaattccaagtttctaagaataacccatgaagcaccaccctttccagattgagagttgactctgatgatagcctcgtaagtccttccaatatcttgaggatccaatggaagataaggtagctgccatctggcgttgggatccttggcctgtctttcttcctgtttcttgaaccccttcttaatagcgtcttggtgggacccagagaatgcgcagaccaccagttgacctccgtatggggctcttggatgaactgggatcttgttgcatcgctcaacgatgtcaattactgaagtaatgtctgaaaagtccaaatgagggtaaactccctgagtgtacaagttaagggccagagttaccaagtcaacgttaccggttctttcaccgtttccgaacagacaaccctctattctgtcagctccagccatctgtcctaattcagctgcagctacggcacaaccacggtcattgtgtgggtgcagggatattgctactgtctttctctcactgatgtttctagaaaaatattcaatttggtcagcgtagacgtttggagtagacatttcaacagtagcaggaaggttgaatatgattgggttttcttctgatgggccccaagcagccttcacggcctcgcaaacacgcagagcatagtccggatcagtatcactaaatgtctccggagagaattcgaatccccatacggtatcttgcatttcaggagcatccttggtcaactctctaaccagtttcgtgcagtttactgccatttcaagagattcttcctgggaaaggccaaatataatgtttctgaaacagtctgaagtagccaaataaatgtgtacaattgctttcttggcacctttcaaggactcaacagttctcttgatcaactcaggtctgcatggggacagaacttgaatagctacgtctgctggagcattctcaaccgcatatctggtaaagtcaaagtcagtctgcgaagctgaagggaaagcaacttcaatctccttgaacccgatctgaaccagcttgttgaagtattcttttttctcggccacactcatggggtctggcagagattggttaccatctctcaaatctgtggataaccatcttggaggggcttgaagagtttttgatggccattgtctgtcaggcaggttaagcggcttgaaggcaacgtatttcttggaggggtcctttagcataggcattgcggaatttggtgtatctaaaagctaagagttaagagaagaaagaaattttcagtcatgtcatcgcgatgagtaataagtatgtgcggagatgtatgtaccagtgctgaaagattatgtaagacatatgaaaatggaaggaaaagtaaattaggggctttttcagttattgcgggatcgacggacttgagtcaagggtttcaaatcatctcccaacatgctcaccctttccaacttactgagagccttaacacccttggcaaagactaaaatgcataatgtagttgatcctccgactatgatccaaaaccagtaatcgctctcttctacaaagttttccaagttcataccgtaaagagacgccacaaaaatcaaacctccgaaacttaaaagaccaatggaaaaccgcagacctagtaacatcaactgatttcgattagaatccaaaataatgttgatgatctcctcggtagttcttacgttgcttaggtaagtctcaactctctggacaatttcatcacagtgggccagataactttctagaagcatttcgacctcctgatgatcatgaaagcttcttttctctgatagatataatgctgccagctcgtcgtcttgttctaacaactcctccaggaggtttcttataagagccgccttttgatggaactgcttcagtttctttgattgtactagtagatatctcagttttatcctgtcaatgtgatcttccagctcctttaaaattcccttgataaccatggtgttcactttcatctcactttgcaaattggaaactactgatatgaagattgcttccaatgctcttatttcatagggtatgccggcctctttagtgggagttttcaacttggcagccaaatcgttgagaaacatggtatttgtgtgagaattagaagggccttggttgaacaaaataactctatcagaacgaattaacgctctaatatggagaacattgattaatatggagcttggtcgaattaaaatggctggaacgatgtcatcgtatcctttatctatctttctcaggtctctaggcagcagttcgtgtttcaacagcagttcatttttaagtgtccttgaggacacacttgaagcgttgcccgtagcatcgtagaccgtgcatcttgttatcgaaccggagtcagttttcacgcccagtgattttgagagtagagttttgttatattcctgagtcagtctgccacaactatagctaaagagtcgtatcctgtgtcgtataaacatgtatgggttgacgattgatgtatggatacgatgctcaaatgtaggggaaaaatagtatcgatttcagttctcggatcggtacgctcggcagctaccgttttggtctggtaacgtggcaatttttaccccaatggataacttagtaaagttgaaaagttgtactgtccgatgagacctattgctatttacttagcacgacaggatgaagaaatttcactcccattcggcaaccagctaatgtttcatgctccgtagacttcaatatttaatctacaaactatcgcgcgtagcttattcctagaaacacggtgctcacaaagatacaacaatgagtcaagatggtgtcacagccagtcttcctggttggttcagagaccagatatcgatgatcgatgaattagacgacccattagaaccatacatcaactatttgaaagaatgtgagaactccaatgttctcattcaattgcttgaggacgttacccgtaagtttaaggatgaccaactctatagcaacgacatcagatatcttaaactgtggttacactatatcaagttctcaaattcaccaagaaagatatttttgtacctacataaaaagcagattggaagcaaacttaccctcttctatgagagctttgcaagatatctagaatcagaaggagaaattatacacgctgatgaattgtaccagatggctatttcaaacaactccaaacctataaataggttgttgaaaagctacacattgttcaagaaccggcatcaacaactgaacgaaagatcgcatcttttctctgaacccactcaaaccgcacatatatttgtcaagaacccaaatttggaatatcctgtacgaaaactaataacaaataaaaataagaaagacgagctgtttgatttcaatttggacttgatctacagagacaatgaagagttttgttttgaagaaattctagccatctcctacaacttgtacgactatacagagaataatccacagaaaaataaagagaatcaaaatccagcttttctccaacagaaactacaagacaacccagaattaccactagagccatcagagatccgacaagttagacatgatattttgcacaataaaaccctcattaaaccgatagctatatcgagttcaccagaacaaagcccagcaagctctccatttgtggaaaatgtcgattccagtatggaagaccaagagcctttgacacagccacttatagaaaagatcacattaaacccaatgagccccgattttcattcagagctactaaagaaattaaaccccccattgtcacactactcacggatatcagtataccctaaacctctcaataaactatccgtattaacgtcaatattcagagctgacaaaaatagaatggttttgggtaacaagaacacaatgtttcagtttggagagaaaatgtactgtatcaccaaactgcttggagaaggtgggtatgctaccgtgtttttagctgagagtgatcttggggaactggttgccattaaggtacaaaatcccgtaagcttatgggagttttacgtatttaaaactatagagaatcggctagcaagcttaaatccaaatgacaagttagtcaaatcatttgtgctttgtcagagcttccaggtgtaccaggatgaaacctatttgataatggattatcttaatcaagatactttactggaagttatcaatgtctatcgaagtttgggtaaatctggggttgatgaacagttagtgctattcttaactatagaactgctaacgtgtatagagttccttcatgacattggaataattcatggagatttgaaaccagacaattgcatggttagatttgaaaaaattgctgactcaaagtggagtgaattttacgacgcaacaggaaacaatggctggtgtaaaaagggcataacattaatcgattttggaagatcaattgatatgacactatttccgaacaaaggggaaaatgttaactttttatgtaactggaaagtagatgaacaagattgccctgagatgcgaaacggagaaccatggacctatcaagcggattactttggtttggcatcaatcgttcattttctacttttcggtaagtcaatcacacttcgtaaggatgagaatggaaactaccggattaacgagtcgttcaaacgatattggcaggttgatctttggaatgaattcttttttgacttgctcaactcgacaaaagttggtacgagagtccttcccaataatgacattctctccaaaaataagatcaaattgtgtcattggttgacccatcactctcaaggattgaagaaatcaatcagtgacttggaacttatatacagagaaaggtctaagaaggtttttaaaagatgaacagcttttcatagcagcagttattttacaccaatagagatcaatcagctttctttttttggaactttgcagatatccttgcgattaagcgtcttagtctgagtttcggactattttgctgatagtaatattccgcttgttcctcggtaacaactcgtttcacaattaggttgaaaatgccaccaaatgctaaggccatgacagtagacgtgagtataatgacattgtaaggcatactgaagtctggagtgggcaaagtgagaagtgctggtgtggtcctggcttcataaatgactttattaaatttgtcaaccactgtcacgatagctggttctatttcgaatccatggttggcatcaggaggatactcagcatatttcaacattaatttgtcaaacttgtaagctaaacgcattgaaaagttgggaggcaataccaatttaagctctaaatgcgagggtcggactctatcaatcatgggttcatagtaaaactctggaagatatgaaacaatcgaacgatctgtgatcgggatgacgaaagattccccacttgtattattcgttaaagtcatcttcaacgtgtggagatatgttttcatataccatggggtactttgatagtatacaaagttcacctcctctgaatcggaaggatttctgaagtcaatacgcagtcctccagaatcctgcgagtagcctgtgagggatcttgaaacaacaagaggtggttcctttagtggtaaagtaatatcagaacggtctgtcttcagctcaatattcagagtatctgtgccacttatctcgtagcatggctcttgtacctcagaataggcaaatactgagtcataatcgttaacttttgccaggactttccatacttcaggaacagtatgagcacataccctagatttctccgtagtgacggtattctcaccgttgattatgtttccaaaaatctcacgcatatcgattttaatatcagtagaatcaactaaggggaagcagtagtatgcatcatgtttcttagttctgtcgcacctaagctcgttgcccggggtcggaacaggcaatggatccctaagtttagagaggactctcttggtattgactatcatatgaatattctgtttcaaatcataatgacagttgagctcatcatcacagtttgtttccacatctatagacatactgttccattgagagtcgtacactttgtggccattgagtaacgaagagagaccatttttccccttggaaggaagtaaatctaaaaatggagttaagttttctgtgcaaactggttctctaggcagagcacttctgaataaaaagagatcaccttctgtaggcaattcgttaataaagttggaagtcggctggagactatatacagggttggtagtaatgacattgtcaataaagttcaaactggcacagaataaaccagacaaagagtttaccaaatgaatccattcaccttcggcttcagtcttattgtctgcttcaattactgcccaaacctcaactccggttccaccagattgacttccattttgaggcaagctcccccatagttcggagtcccaccagccttgagaaaaacgtaggtgtaattcacgggtttttgtatcttctaaaattgggcccaatgatttaggaaacactgtataatgactgtaagttgatgatgtgtcataccagttaacagtatcggactttatttcaaaattaaaagaagcaagtaagttgttcttcggcaatggagtaaagtctaatctttccttaaaggagcccttctgattacaaaaaaccagactgaattgggaaacaatcagccaaaagccccagtttcgaagcattgccaatagtgtgttggtggatgtttctcagatctgttcttccgcaggcttgcgcgggtggaaaactctgctggaaggatcctaccagcggcgatgagatagcttcgctatcaaaccgtcctttcctcgcgcagtttgaaaagttaaactatcttgccctaaattcatcagttattcaataggctcaatgtctcaccataatgactctggattgataccctttgatccaaaaggttctaatggggttcaggctgctcctcagtataccattcctaaagaatatgaagaagaaatgatagataacgctgaggatattgacccgctcgagggaagtattgtgagttccaaacccaaggaatcagactatcataaaaggaagtacgataatctgatgaatattaatcttacacaacaagaaagaacttacaaggatcgtatgaaagaaagacaacttgatcgacaggaggaagatattcaaaagctattaaaacaaaaacaggaacaggcagatcaaaagttcaacgatgcaaagccagaaaatcaaccaaccagaaaaaggaaaaagagatgggatgtaaagtcttccgaaggagactctgttacggtcaacatattgccggttataaatggcatcgagttgaacaattctattcttgataaaattttaccaaatggatatacgatagtggaaccgcctcttagttacaagcctctgaatgacctgccaccagattataaacaagaagatcaaggatatttactacctgaggaaagcacattagcattggagaataaggcggtagaaactgctcaagagttggctatcgagaacttaggagagaaggagaagaaggttcacactctcatctcaaatataatagaaggggctagcaacatgagaaaaccagctttaaggcaactgacagaaaatgcccgtacttttggtgcccaggctatttttgatcaactacttcctctattcatgaaacgaaatttggatgaacatcaaagacatttacttgtaaagattgtaggtagagttctttaccaattggatgacttgataaggccttatacttataaaatattggttgtgataatgccattgttgattgatgaggattactatacgagaattgaaggaagagagattgttgcgaatctcagtaaagcagctggactggctcatatgatttcaaccttacgaccagatatagatcactctgatgagtacgttagaaatactgtatctagaacgtttgcggtgatgtcgtgtgctttgggaataccggtagttctaccctttctaaaagctgtgtgtaactcgaaaaagtcctggcaggcaagacacacaggaatgaaaattgtacagcaaatagcaatccttgcaggatcaggagtattacctcatttgaatggtttggtagcggctattagcaaaggtctttcagatgaacatgttcatgtgagaacgattgcagcacaggcagcttcagccttggctgaatcatcagctccttatggagcagaaagctttcaacagattctagatgagctttataaaggaatcagaagacatagggggaaaggactggctgcctttttaaaggcaatagggtatatcataccgctattggaccctgattatgccgattactatgccaaaatggttttcaaggttctaatcagagaatttgaatcaccagacgaagaaatgaaaagaacgtgtctcaaagtgcttcagcagtgttgtgacactgaaggtattgagaaacagtacttaattattgaagttataggcagtttcttcaaaagcttttggaacagaagaactgctttggatcgacgaactgcaaagctgtgttgtgagacaacattccatctctccaagagagtcggtgcaggattggttctggataatattctggtgcacttaaaggatgaatcagagccatttcgtagaatgactgcagaaacctgctacaaggttgttcagtcatacggaactgcggaattatctgacaaatcagtcgatcagttgttagatggtattttaattgctttccaggagcaagttattcaagacaatgttattctgaaaagtttttcagtcatcataagttcgttgggactgagaataggtgtccatttaccctcaatagtgagtatcatcttgtatcgactgaaaaatagagaaccggaacctcgaaggcaagcagcttcgttgatcacggttgtggcgccagtaataaagaaatgtgggaatgaggatatgctgctcaagcttggctctgttatctatgagtctttgggtgaggtgtacccagatgttctcgcatccattttggaagcgatgaaagcggtgattgcagtagttggggttgaaagcatgaatccacctatgagccaaattttgccaaccttgtctccaattttgagaaatagaaatgaaatggttcaagagacagcaattggcctcataggaatgatagctcaaagagcaccagagtatgttaacgccagagagtggatgagaatttgtttttctctcgtcgaaatggtcaaatctcaaaggaaaagtataagaaaggctgccaataggaccgtgggatacatagccgtggccattggccctcaagatgtccttgtcactttgctgaataatctgagagttcaagatcgacaattaagggtgtgcacggctgttgctattggtattgtggcagaaagttgcgcaccatttacagtgttgccagccttaatgaatgaatatcaaaccgttgaaaacaatgttcaaaatggtgttttgaaggctttggcattcatgttcgaatcgattgggtccatgggaaaggattatatatatgctacgcttccattaattgaagacgcattgacggacagagatttggtgcatcgtcagactgcagcgaacgtagtcaagcatatggcattgaataacgttggatttgggctggaggatgctttcatacattttcttaatttgctgtggcccaatattttcgaaacttccccacacgttattgctagaatactagagggtattgaaggttgtcgaaacgtaattgggtgcggaatagtgatgaattacacgttaactggacttttccaccctgcacgtaaagttagagactcctattggaaagtttacaacccaatgtacgtgcaaagttgtgacagcatggttccatactatcctgatttcaaagatcaaattcttactaaagacactgagcaagttacaccgactgtaattgaagagctcgatatatgggtatagtatttgtatgaacactcatcttttaataataatcataattgaatggtcattgatgagactctgaattggactggttaaagtgagactcgtctcctcctatgatatctcgcgattcgtttagacttgcctatgaaattaaagagagacaacaaaaaaaagagcctctaccctaaatctctcagctattccattgaatcggtcttgtgactagtacgaacattgattgcgacttaacagaaacctccaatcacgtttctcgcttgttgtattttttccccttaaaatcaatgaaactcaaaggaggcgatggggcccaaaaccccagccagccgactgccggtccacgatattcgtttatcacaaaggagaatgttactcctatatctggggcattggctgggttaatagctggaattgctgtctgtccactggatgtagccaaaacaagactgcaagcccaaggagcttttctgcagagtaagaatgttgaccacaaacttcatcaggtgttcgaaaacaaaagatatcagggattagtgcaaacaataaaaacaataacgagggaggaaggtattaggggactttatagaggtctggttccaatatcgataggatatttgcctacttggatgatatattttaccatgtacgaaacttgtcaaaagtttttggatagaacatcatttatttcacagggtaataatctttcttattttatttctgccattggtgctggactagcttcatcaactttaactaacccgatttgggtggtcaaaaccagattaatgttgcaaacaggatcaggcagcactatttatgaccgatttgatgggaaacatgggattaacgacatgatcgaagataaactaaaacacagttactataaaggcacaatagacgccttccgcaaaatgttcaaggaggaaggtatactgtctttctattccggtctacttccatcttacttcggacttatccatgttgcgattcacttcccattatacgaaaattttaagataatattcaactgtactcagaaggatatcaatgaagcgagaaagaacaatgtcaatggaagtttgcccaaatcaattgtgttcaaacttgcatttgtgtcctgtgcatccaagatgttcgccagtgcaataacctatccgcacgagattctacgaacaagacttcaaattgatggtcatgacctaggtaggaagaagtcaggactcataaagactataaagagcatatatttgaaggaaggtattcgtgggttctattctggtttcgtcattaatttaaccagaaccttaccctccagtgcagtgacgctagtctcttttgagtacattaagaactaccttgacaagattgcttctcccgccctatagtcatcacatttgtagcatataatattcggttttatagagtttggttcgattccaaagaattgcaccaaggagacattaaaggtggttaagataagtgcctgttaatcaatacagcgtgaatcttggtgccttgaatggactcaacaaagtatttaatttttgatttttcagtgaataccgcatcgcatggcaccagcgaagcagactgcttattgtattagatcgaaaatcataaacgagccattcacttgagcaaacaactgtatacagtcagacaaaagagtgttagcctgtagctattttcactcaactcgttagctcaaaatcccacaaaactactgattgacttctcatgacataaacatgttcatatgcacaataccaggaccagacacgaaaaactagacacgagacatctatctgttcgcgattggctttgccttccgtagattactaccgttctacagttacaaacccttgataaggacagcatagcacaaaccgtttcattctgacaacagtcaccatgaaagttgcaaaatctatcgtggccagtcttttggcaatagcttttgctaaagcagccgatccagccgagggctccggtaatgggggtgagaatgggccgactgtcatcagtatcaactccatccagctgccagaacttttgacacccgatactttcaatgagactcttgcccaaggaatccactttgtagagtttttttctccctactgttatcattgcaaacaactggagcccatttggaaagaaacttatcaccgcttcttgaaagaaagtgcgatatcagggatcagtatgagacaagttgattgtgccgcaaacggtgatttctgtggaaaacagtcaataaactcatatcccactttgagactgtatggccctagtgaagataacacctcgtacaaattgataacaacttacccgagtggaggcaagagaacgccgcagaatttcttgaagtttttgagatctcaatatgatgatctgaaaaacgaccgtttcaaccttcccgttaaaggagaggttttgactgaggaaaaaatgttgaaactaatgaatggagatattgaagaaccagtattggtttcattctggcctaccactgataaagaaacaactttgaaatattttgaagatgttcacagcaacccaatcagtttcaagaactgctattcgtgctttaacttggcagttttatggtccagaataaccaatcgtttgcctgacctggagactgccgtcttcaactgtggagggactaattctcgagtatgccaagctctcaatctaccctttaacgtaaacagagctcaagtttcgcctgagatatacatgttcttgccaaactctcatggaggcattcgtgtgaaatataatcatgacctggtaatttctgacattgtagattggtcagaaagattgttagccaatgctcaagctgaggaggtcactttagattcattggcggaaaagatgactttattgaatccagctaagggtctagactttttcaagggtccagatccaaaccagaagcaggtatttgtctactattatgaagaaggctctgacgcacctgaggattttgaaatatggcctcatctccttcagcctatcatggatttgactacgaatacttatatctatcgatccaaagattctcagctagaagatttgcttgataaaaagtacaagaagcttattgattatatcaatcaacctgactttgagccggagagacctttaaatagggagacctatctggcaagaacaatcacatccgttccaacattcctcgttttcaaagataataatatgattccaacagtctaccaaaacttttcacccaatgagatcagagatgtcaagaaagtcgtcaattttattgaacagaatcagttcccattagtggacagattgacaactgataattacgaatcgtacttcccaaagtttaacccacaaattcacgataaagacgaaaagattgtcatttctttcttctcttctgacaataaaacacagactactaatgattacaaccagcttttgtttgttcagcattcgtatgactatatcaaacaccaaaatagatttgatttgatcgaaaaggctcgagctgacaagactgacaagtcagagcagttgaagggggagggcatggatccaaaagagatcatcaaagttttatccaagaagattgaccatttaaacaacgttggaaatgtgttgacggtatacgtggatttagctgatgatcggaaacttcttgagaagacaggatggatatcgagtagaacaaagtacaaaccaggtgaatctataatagtgaccagattcggcaaacattattgggatagagatgtttttggacacaagctaatgaccactgctcaaagcttgcgagaaacgctctcttaccttttgtttccatccacatatattccaccagaaaagaagactacagtgagaccatctcctagagttgcagggtcaccatatcccgatgcatttgcgttcgtagatatcattcatcagtacgggttgtttggttatctgttaattattacatctgttattggggtgtacatgcttatcaagagtcatcggagaaggtcccgcaaggccaaatttctttcgcacagaagccacaaggaaggatttcaagatgcttacatcgaattgagcaaacacgattagtagatagagtctcacaccaataggccatcagtaggcgacaatcgcttaaagtgtgtgggtatcggtgcgcgatatagccttacataatacattcagatcacacatgttgtgagccacagtttaactcttcttcatacttgtatcgacatccctaagaacataatgcagctttactatcatgatggtttagacaccccagataatttctgtgaagatcacaattctggggaagaggtgtcagttgaagagctgtccaaaattggagtgatatactaccatttggacgaagagagtcaagttgagaagattgccagggaaagagattacaagaacagagattttgtggttctatctgatgagactttccctggtgggccagatgctttgcaagagaaactgaaagtcttctacaaggagcatcttcacgaagatgaggagattagattcatcctggatggagaaggctactttgacgtgagatcacagaacgacaggtggatccgaagcaagcttttcaaaggtgatttactgattcttcctgctgggatttaccacagattcacgttgtccactaagaagtatgtcaagacaatgaggttgttcaaggaggagccaaaatggcaagcctataacagaccggctgatgacaaaggagctagattggagtacttgaaaagtattcaggtgtaggtttttgtagttaacgaatatatgtgtatttattactttcttgggttgaaagatgcagagatcatttggaggtgacattggtgaaaaaaatgaagaactagagtgttcagaatataattttttcgacagctgacattgcaggtaccagcctctagttttcctaatgatcaattttggtagctaaagatcatctttgcttgctaacgtatcgatggactcaaaatgtcttcttttaagtgccaacctggattgtcttaaccagttcgctaacattgaaatattcgaattccctactcatcccaccattatgtctgaaggaaagcccaaccccaatcaagaacgtatgtgatcaccattttccaagaactttcaggacaactactaactctgaacagtatttcaaaagcaatatgatgaattccaagaaactttggaagctttgaacaacaagattggtcaattacaaggcgatatagaggaacacaatattgtactaaaaaccatcacaactgctccaaaagacagaaaatgcttccacatgataggaggtgtactaattgagaaaacggctggagaagtagaaccaacgttgaagactaacgttactaaaatgaatgatgcagttgaaaacttgaaaaacgagatccaaaacacccacaaacaatttgaagactggaaaaagaagactggcgtcaagattgtgagtgctaatgagtagaaccaaataactgatgattaatttacagcaaaaagggcattgatttttatttccgtctggctatttctattcagtattctatctagatgttcttcttgatctcagttgcatcttcagttgaatagaggaagaagataacgaaaattatccaggcaattacaacagcacctgcactggcaacgtaaacccaagaatttgtgatttcccaacttctggggtactcgtcattggcaaggtgtctgacaggtacaatgtcttcttcttcaataaaggtgtatccaggtctgaaatacttggtggaaaatgtgaacataccatgctgatcgggcaatttgaatggcccactagtgtatacttgaacggactcatcctctgtttttacttgctctaaagtgattctgtagtaaggatccaacatgatcagctctaattgcacgtcattagccttgaatggcacccattcttttccattccattcactcaatccaatctcatatgacacctcgtctttcaccttgtactcttcggtagattctggagcatccgtcaaatagtgtttagcaaaggttgacttcaacaaattcctactttggaaagtccaatcaacaagatctttggcactctggtcaaagtgctcattatcaaaaaacaaagtgctacccaaccataaacttctagcgttattcagaccctggaaagcaacagctaggaaaccttggtctcctgaagtccaagtagactgctcgttaacaactccctcattgatgtcgtatgcaaaagaggtttttggtgcctttaagagaggaatcaaatactcattgttagagagtaaactagcagcccctgagtaaacaattgctttgttgaatgctacaatggagtttggaactactgactcctccaaagaaagcctaatctcgtcatgttgttcattaacgccattgaaatgatcaattagcttgtaattcttaggagatggatatatacccagttcagtgttgaaggcaacaatttcagaattggatccaacttggtttgtgatactgataatgtcacctccttcgttgacaaattcgatcagttttagggcattcaaatctccttggttcgattgacctgatatgggaaaaacaaacagattttggtagattctcttttggttatagaataattgaacttcactggctttgtcgttcagatccacgatatctactctggagaattcgccattgagatgatccacgagactgctaaattcgccaaattccagaacagaagaatcgtacactaccaatgtatcagaggctattggagataaagccatgacagcggtgcaaaacgaccatatcaatactatgagtcctttgaaatgattcatggttcttcagtggtaatgataacacgtttaaggttggataattcattctcaactggttggtcacgtgaatgaccaggaattagaatgcgcgattcgatctgtatacagcccgcataatgatcaatgttctgaacttaagctccactgtcaataaccatgactaaaggagttgaagaagagtcgtttgagtcgggcgatctactggaagctttcaagaggcttaatgaaggcgagagaacagcaactgtaagtcttagtagatattgagttactacaaaagtctagttaccgagcaacggcaccattattactggaccatctactaacggctttcaaggagcttgaaaaaatgcttgattctattgaaagtaaaataagaaagctggaagaagtggcaaactttgacaatgctgaatcaaaacccaagaccaacgatcaataagttagctttctgaagggtattctttcaaaccttcctcaatagtcacaaaatcagcctctttggttttctcaaaaggattcctgggtagattgggattgaccatcatttttccatcatctagttctggaaagtgtactctcactgattgtcgaccatcaatccaccatttagtatgctctgagctgggtggtggcagcccgtgggctaatgtgatctcattgtcaacataattactggctcctggatttgatggagccatatttgcagtgtcctgttcgttaataatatctccataaaacaagatatcgttggcgtcgccaattttgtgcttcatttcctcgtacaattctgcagtgagtctattcttgatctcttcatctatgacatcgacagtggccttgaacacaccatataccggtctgtgatcactgaacttgattgacggcacactcccatatgatatctgattcagagactttcctcttgagatactaagaatcctatcagtccaggctgggactctctgtttctctgaagtatcatatctggatgttccgttgtcaaacttgtatgtaggtgcaaaattcaattccatttcatcatagtaagggaatgcatgtccttcggccatttgattgttcagttggtcatattcgtaaagcttgcggtaattcttttctcctatcagcctcttacaatcctcattggacagttcaattctgtagttgaagtctcccatccatataacgatatcatgatctttcaaggtccgtttccgggcaaaggacattcccttggcaatagttttgtaatcttgatgccgttcaacaacattatgaaatccagctgcaagatggctagaaacaattgcaaactttgtagtcgaactgtaagtaaaactaatggctacagctcccttatttgctgctatacccgcaagacctgtcttttttaatgtcccttcaatatctgtgatacgtgtttttgcggtggtctttaccaacaggaacagacatattcctccaagctgggatacccacagcattgtatacttatttggatcatctcggttgacagtcaacaataatttcttctcccaaaactggcgattctttgaatcaacattgatcatcttcccagcacttagggaaattatctcctgaaatcctattgctataacgtcatagttctctttcgcactgtcatctagtgggtatatccaagatcttatatctccttcgtatagctcgccattgatgttaaaggttcctgtgaatatctttaatgttctctgtgatgtgaactcattcttcttttttctcaattcattcgtgacaaagtcatgtataggatcaatcagttgaacctcaatctgaccgttcaatctacccaatagtttatccacgttatgctctttaatcttattgtcctgaacaacattgctcacatatttcttgctcactccggcgactactccaacaagacctccctgcttgtttttcgtgtgcttagagctcattgcatgcaatgtgattttctgtaaacgctgcccattctcgtgccataactcgttatgctttgctgctatttcgttgctaaaattgagatcgagatcagagagacaagcgtggaaaacggtacttgatatcagctgctgaatataattggccttctccaaagagttgaatgtgttggtcaaaaagataccggactgttttcctattgaagtctgatccttgagattatagcagtatgcaccaatgtctataatgcgatcttctatcgcctttagcagtttcgaatcagctgtatgatttttcaatgaatctaagggaaaattgatttcattgtacgtaacctgttgtctcagcacatcgtctaaatttcgaaagctttctttgtacttttcagttagctctcgttgatatcctctctctgataaaccgtctaatatatggacattgccaaaattttgacagagaatatcaaagtatttatcgaacgctgcttgagacgattctgaggatctcgggaaatctatttttgtggaaagtagctggttctctagagaccaaaacagtggcacatttcctcggatttgattgtaaaagaatattgtgttttttgtgtaaagacaaactgttgattgaacaaagttggaggtattcccattatcgtccagcccccaggggccaaatagatggcctttgcccgtcttcacgcagttttgcttcgagattatcgtcatcaaagagtctccatttgtctcaatactgcagttgacgctttgtacatagcctctcataatgcagaccagaaattccccacgttcttcgaacagaaacctctcttgtggcgtcaaatgatctttaaaattgatcaactcaccgaccataaaattattccataaaaagttctttgaatattctagtatcattctgaattttttctcttttctgaggtaacttgactcacggtgttgcaaagatgtgatgatgtcaaaatcattactataatagaaactattggaactcaacagtctttttaatgaagaataagggacctccttttcataaatttcaatattcttctccgcagtcagagcctgggtgttgtattttgtctcaatgtattcaaagctatcgttctcaagacagatgaagttgacattcttgatgacattgattctctcttggggtcgtatgcttcccacttcttgttttcctgtaataacacagacaaatgtattccctttgagatgaatcaatcctaataaaccgtaacattccatgttcaattcatagtaatgctgtgaacttagatgcttgagagacacaaactctatgatacttttcggtttcgaattgacatgattctgagttcgaactgtcttgaacagcagacagtaatcgcccgaaaccaaagccacagaccttggattcttacgcagtagaactttcattatatacttctgtttttgagcataagtttgaagttaagctattcttagttacagatttcataacgcttagatagggactgcgactggtgtttgaatgtaagcaccaaaagaggcagggtcaaatctgctgatgtctacggcatgatagtgccgttggaggcaaaaaaaagcgttcagtcctcaaggttttagggtagttgacactacgtctgaaccatctctgattactcaaggttagaaaggatatattaagttggccaagagggaggtcccttgcattgaaaaaggcaagcccgttaggttcctgaaatttcgcttatctaaccactgccaatccctaggctgactcactttcttgatctaactcttctctcggggaccacacttcacattggaggctaatgactgaaaaagagcattatgagcaactctgttatgcctgccgaattgcggacgtggaacaggtcgaaatgttggtttcgtcaggcatagacgttaatagggttgatgaatgggactattctcctctgattctagctagtttgtgtggtcatttgaacgtagtgaaattattgctcaaagttggtgccatttgtgatcgagatacatttcaaggagaaagatgtatatacggtgcattgaatgacgagattcgaaatgtccttctgagttacgacatcagtaagagtgtcaacgaatcgcagccattttctgctcatatacataaattaatcagtggcaaggcgacagtgaatacaaaggacatgctgctgaacaactgtgtccctgttcacaggtggtacataagtagccaacaggttggcatcagcatcgatcattcaaatgtcaccttgaactatgacacaaaaattgttgaacaattgattaagttcttgtacctgtctccccagtttcaagttaatgagtcggacttgaagcctcttgtacaatgtagcaaggattttggaatagcatgtttccagcagttatgcaatgagtacttggagctctccgcgcagaacgatatcaagagactgtccaagttgagacataaaatacagtttagccaaagcttgcacacaagagatctgttaaaagaatttgtggaaactcaagttctcggcgcaaagattgagctgggttcttccaccgacatttcacctgtcaaggagaaacttttcaacctagaaagctgtccagatataatactccgacttggaaatgcattttatccagctcatcgatcaatgatggtaaggtcgggttattttgatttgatgttacaatcctcttttgcggaagcaagcagttacaacgaacttacggacgttatataccatagagaccaagtcgatccaaaagttgatatacaagtcatttcacttactgaagaaattgctgatgaaaggctgtttgaaattctacttcgatacgtctattatgatgaaacatctgtcccagcaaacctcagcttggagactctgtacatgagtgatcagctgatggttgacaaattaaagaccatggccgcaatcgcaatcacaaatgactgggaaagtacaggctattcattatacgagatcttagaggctgcttgggtgacaagagtacacagattggaaacgtttgttgcccacgagtttgccaaacattttgaccactatgtcacgcaaccagagttcaaagaggtaataatggagagtgcaaatagaattgatgctagacaagcggtggactctattgaactcattgatgacatcaggttctatcttacccgagtttattccattgatttcgaaaaaccttatcatcctgaagttgactatgaaaaatgggaaattcaacagatgaacagtgacaacgttattcaatacaatcgctgtcttcaggagattgaaaatctactggctgaatgtggatttgacgcatgaaattgtaattatgtatcctatttattcttcttggtcttcctcacattgctagatccgaccttcttatttttaggggcagtggcaggcttttggaaatatgaagcaccaaatgtagcatataaagcatatattagaccaccaaaacttgctagtagtaccaattccagaaacagcatctgcggttggaagactgaaatttggggatcagaaacagtaatgagttgatttttgcttcctagcaacatcagttgatcgtccttgaggacataaattgaggggacaaacaaatagttttcaggctcaagatcaatgccaatcttttgggtgaattcgaaagtcatgtctttaagaagcttcaatggaccaacagaagaggcagttaagtttctcttggttagaccggtcacagggtcattgaatgaccctgcaactcctacgacggaaacagattcatcttccccgtttttgatgttgtaggtaacagagatctcttcgccattcaccaactctatcagtttggttgactcgaaggactgagggtgctcgtcaatctcgtaggtaactctaatgttgaacggtttctgttcagtaggaacaaattcctcatcagtatcaggatcacatagagtggtttgagtcaaaaatccaagtccaactaaggccagagtggataatctaagaaacttcatgctggtgctggtgggtaagacgtgttcggtagtttagctcgagagatttgggctgaaggtcgtgttccggtttcaatatcttatcgagataggaatcataataatttgatcccgcttgatgctaccatccccgaacctctatcggttctggagaagtctgttctctgagcgtatatgtctatacaaaggtagactgatctaataagggcctatcgagagaatctagtcttggtcttttcagtatcaactagcaactctctgactgattatacgatcttgatggtaccttttgatctggttcgcactgaccttcaggagatgcagttgaagtacagtgcatccctaacctagcatatcatatctccggtggattgagctcctattaaaggtcaagcccacgcttaagcattcttcaataacactgctcgaaaaacatagttcatccccacactctgcataaatcatacatatcccctgagtaaagctagatgattttaaggagttgacacttcttacgcatagaacaatcaagatgggcatcgatatatcggattatttctctccccaaatattctttatcattctgagagaaaccttggaagctgcaattatcatttctgtgctgctggcatttttggaccgttcatttcacacatcaagtggctatcaagaattgccaactgaaccggcaacttctcaagaatcagataatactgccgcggagattgttggtggcgaaaaactgtacaaaaggttgaggcttcaagtttgggtgggcagtttcctaggtttgttactatgtctctttattggggggattttcattgtcgtgttcaatgtcgccgggtctgacttgtgggcatatacggagcattactgggaaggagctttcagtattttggcagccgtaattatatcagttatgggattggcaatgctgaggctaaatcaaatgaagtccaaatggcatctcaagttaaacaatttgattttgaaccaaaccttacaaaaggagaaccaaacggagaaatatgccatgttttttctcccattcataaccactctccgagaaggcatggaagcagtggtctttatcggaggggttgggctggaccaacccctgagtacaatacctgcctccttgttactgggacttgccattggagttagtgtaggaatcgcattgtacaaaacgggacatacaatgtcattgcgattgttcttgattggttccacgggatttttgtatttggtagctgctggtctgttctccaaaggagtgtggcagtttgaacttcaaaagtatattgaccgatgtggcggccaagacatgtcagaagttgggtctggaccaggttcctacgacattggaaactctgtttggcatgtcaactgctgcaatggtgaaatggacggtggttggatgttgttcactgctctgtttggttggaccaacagtgccacctatggatctgtgacaagttacatcgttttctgggtcattttggtagctagcttacgaatgctgaggtttgaagagaaaaatggctatctcccttttattcccctaagctggcaggcgaagagatgtaaaaaacgcatacttttactacggtcgaatcacaccttatcgcaagagccatccaacaaccagggcagttctgaatagtttctattaaagctccacaaactaaataaaaaagtaagaaaataaaacaacaatataatagaagtaaccattaattcctaatatacacatctaccaactaaagatagattcctaattcacaaacaactcataaatatgttacatatcagaaagcttaagcctgggttgatgaggtgtatttggtaacggcacgagtaccttcagagacggcgtgcttagacaattcacctggaagaatcagtctaacagcggtctggatctctcttgcagagatggtagacttcttgttgtaagaagccaacttggaagcttcagaagcaattctctcgaagatgtcgttgacgaaagagttcatgatagacatggccttctgagagataccggtgtcagggtgagtctgcttcaaaaccttgtagatgtaggaagcgtaagactcctttctaaccttagatctcttctttggttcggaagaagaagaagtcttctttccggcagtaggcttcttctcagctggggccttagaggctggtttcttctctgcttttggtgccattttgatttgtttaggtaacttgaactggatgtattagtttggtgacaagcggatgtgggatatcagtgtgtttatatatacgtgatggggggaggactctcgtttcctatgataccttatggaatgggacagtacgcgctaatttgtctcgttctggatagactgctctgtttttcgttacatacgagtgggaagtgcgaacttttgtaccagagtgcgaaaaaagtggtggcaatcctgacgtttgtaccaagcgcgacggcacattattggtcagtttgtgcattttagtttttcttgaaaacatctcgaaacataacaactaggacaccaattctacagtgaaaaccattcagtggaatgtgaacccacataaatcttgcagcaataatacaacaatttatggctcctgcattctgattggctgagcgtttattgccatcgtgactgtccaatttaggacacaccctttcctcagaatatataaactggtgataattccttcgttctgagttccatctcatactcaaactatattaaaactacaacaatgtccggtggtaaaggaaaagcatcttcggctgaaaaggcctcaacctcaagatcttctaaggcaggtttgaccttccctgtgggaagagtccaccgtcttctgagaagaggtaactacgcccaaagaattggttctggtgctccagtctatttgactgctgtcttggagtacttggctgctgaaattttggaattggccggtaacgccgccagagacaacaagaagtccagaattatcccaagacacttgcaattggccatcagaaacgatgaggaattgaacaagttgctgggacacgtcaccatcgcccaaggtggtgtcttgccaaacattcaatccgaattgttgccaaagaagtctgccaaggccaaggcttctcaggaattgtaagtttctgcttagttcccagttctattaccgtttttattctatgtatactagtagtaatgtaaattatattaagaatagtttgttcttgtagtttattgtatttatcgtgtcgcgcgatagagatgcgagatgcgcacatgaatttgtttgtttgtttcgtttgtgcagctgtctcttgcataatctgtctctctttgtgacatatgatagattcagagtgtgtgaattcttataaatataccaaggttagcgcgttccctccttcttttccctttgtcctttctcttttcccttgttccctttctttccgttacctttaaaccaaacgatgccagttagacaaatttacagattcgtgagaaaccaatacgaaaagagattcaatagctccaagaaggagagctcggccaaccctggggctccagctgatgaaaccgcaccagaagctggagacgctgagcaggctccagtggaagaggttgcagctgaagctgctccagaggccgaggcagaagctaccacttcaaagtaaccaaccatcttcgttcccaggccttttttttccaccttttgttccctcattcagacactgctacctagtgagctaatcaagtaatgcatttcatcccctttgattttgtattttcctttcctttttatcttgtgtgttttagttaaagttgataaactttacattcaccgactctagatagtgttagcaacttgccattgttgacctgaacgtgtagaattgggctcccttcgctagcctggagcagactaagtagctttctggatttaacatcccaaagaaatacgctgccaaaatctgatcctgaaaccacaattatcctactaggatccttctcatctatgaaaaaatctgtgttgcaattgtacttccccatttctatcttgctgacctcaccaatcccctgtttatgggcaaaaaatgtcttgacaaccttgttatccatgtaatcccacaaccttacagctccgtcaagcgtactggcaaggatatatttcccattgggagagaacctgacgtacgaaacaggataggagacatctcccccatcgtagatcaaagtcttcaaacattgtcccgactgggtgtcaaatagtctgatcaacccgtcatagctggcactgacaatgatggttccatcccatgacagatcgacagcgctgattggatcactatgtgcacacaatgtttttagacattttgaattattaatatcccagactctaatagcctcgtcagatgagccactgatcaacagattccccttatggttgaatttcacacagtttacatggtacgtatgcccaaccagagttttcacgcatttgaaagactctatggaccatatcttgaccgtagtatcatctgatgctgacgctaaatatcttccgtcttcagaccaactcaaatcagacactcccaacgtgtgacctttcaattcctttacgcgatggccctcttgatccaatatttggatagttccattggcaaacgaaacagctatcaaacttccctctggattaaacttggcgcaagtggtataaccagacccaagttgtatgtctagtaccaattcatagtccactttctgaaccatgtctttggagtggggcaagctgaagagaaggttctattctgatatttacgtctcactgagaagagttaactactttacatccaaacaccacgattatctaaacctcgatcgccaccagtctggcattcactcaaaccagctctatttcaagttctccatagaccctgatctacagaagatggtatgtatagtctgttgatgttttagttgatccaattattaaccttgtgtttaggcccctttaactgtgattcctttgaacgacaaaacatcgaaagttgactcgacatcatttgctacgccttccgtggctataccgtcattaccagacacattaagagaacaaaagggtcctttatccattgcctcggagataaatggtaaacatccattggaggcccgtctgagaaactgggaagaaaatgaacacaacaatagattggaaacttatagaaggatattcggtgctggagaacccatcaaaagacagatggaattaggaattgttgatgccacagacttcaaacctaccattcttggtggaccatccaacttgcatagaaacatattactgaacaaggatacttccattgactgggaagatgtttacacaggtaggtttttgtcagcttgttcgatttcacttttgaaagttactaacaaaatttaggtttcgattctgttgcttgtccagatatgcacaccgagatggaaagaaaagttggaatttaagtgtaattagaaagaaatcgatagtatcccaaactatgtccaaactggtaagtaaataaaatccatctttaccctagttgtttcctaggtgtcatatcttttattatctatattctacctgacgaaccacagtcgtgaaccatacaccgatcttgcttagttgagcccaaaactgtttctgccgtctgttctcgtctctttctaacatccctgcgatcctctttcacgaacgtattatttgcacgctcgccttcacggccgcggtaccaagctgaaaaataatacccagtgaaaaatttagtttcctccactagttcccaatccaccttttaccactatcaacaaatactataacatccaaagaagatcatgtccgatataattaatcaacctcagtaagtaaaggatcaagaaacaactgtaacaaacaattgaagtcgaacaacaactaactcaatctctagaaataatatgccatattcatatgattccagtggcacatctcaaactaactttcaggaggcaagtacaacagtaaatgcacaggaagtcccaccacggcctaagaattcatattcagtttcggaaatgtttgaaattcgccaaagaatggtagatgctaaccaactacttcctgtggaatcacagctcccttataggttgtcggaaatcaacagaacaattcatgtcgatcttaaagaggctagattacaagattccacaaagaaaagctcccctactgttaacggtttttcaaatactgatcatgattcacagtttctagttgataaaatggagaaattatcaaccaatgatcagggatcgaactggagttcacctttagtaagtcatcccttgttgactaggcagacatcaagtcggatctcatcaaacatgactcctccccctggcattactcctctaggttcagttccgcccaccttggagccttctcaaattcaatggatctacttagatgcccaagggcaggagcaaggaccttttgatggcctgatgatgcaaggctggtttgaggcaaactatttaactcctgagttgaggttaaggagaaaagaggaatcgagttttcgtactttagctgaattggttcagtcgcttggtgatttcaggtatccattcttgaaaagattgccccccatcactcaatcaactgatcccattttcttccctaatcatgcggaggtgccacaatggggtgcaaactctagcaatagtaagtcgagttccccttggatctcccaccagaacttgtccatggattacggagggcaaaggttgaactcaccatcgactttccttcctcagtttgatttgacttcccaaatcagagcagctactcctctgtccgctccaattgtctctactcctgatttctccgctgaaattttgggagctagcacggctccccttggggaaagcaaccagaaagagctcagtgctactctgaccaaagaggccgagcctgagaatattgacgatttccctattaagtctatctcttttgatgatgaaccttcccaaggttctactcctgtgtctactgccaaagatgagcctgaaccaagcaaaccggctacgatctcctctgtttttgcctcgtcttctgtcactgttcctacgtccgctccagcccctgcacctgttcctgcacccactacggtaagaactttaccaagcctcagagaaatccagcaggaagaacttaccaaggcaaaactgagaagacaagcagaggaggctaggcttcaagagtcgctgagattgcaaaggctgaaagaacaagaaaaatccaaaaatgaagtatccacttcacaaaaagcatctgacattgctccatgggccaataccaaagtatcaggccctcctctttcattaaggcagattcaagaactggaagccaaacaactccaagaacgtaagaagaaacaactgaataacgtacaaaaccaacctattgctcaaagattgtcggaaggggcagcatcaacttccttgcccgcttcagcaacttgggcgaaaacacctgttgcacctgtgttggcaacaaaatccctgactgaaattcaaaaggaacaagccgaagcacaagcacagagattacaaagtcaagcattgaaaaacaacgcagtgtcttttgccaacgttgcatcatcctcttcgacccctgtcgaaccagaagatggttggaccgtaatttcaaagaaagttgttgccaaacccaaaccttcggcagctgccgtagcaggtgctcttgcccccaaacaaccattagcaccctctgctttgcgtgctttgtctgctcaaggaaccgttggtaccacagccaacaccgctaccaggtcatcgcagtcggctcctccaagtcgacaattccttgattggtgtcgatctcaattggtacaactgaacaagagcgttaacaaggaggatctcctgagcatcttgcttcaactttcaggaggttcagagtctcaagagattattgcagacactatttactccaactcttctataatggatggtagaaggtttgctagtgagttcttaaagagaaaacaagttgtcgaggcttggattgagaagaacggttttgaatttgactggtacgaagcacaaacaaaaactttgaacgacgttaatgacagctccaaggatcaggatgacgaatgggacatggctttcactaaggtggtcagtaagaagccaaagaagagagtgtaaatagactaagtaaaattcttcttttggctacgctggcattttaatagaaatatgtcctaattagtaatacttgcttctatttcctggtacaactcccattccttagcgagttgctctttcctgtcttcaatggcattgactctcctccttaaagcctcgttcaaagtgacctcttggcacacgggcataaacgtcggtgcccagccttgtttgtaagtctcggcctcttgaactaactcctggatctctagctcctggatcttcaaagccagtttgaacctgtcaaagaattcgtcaccaatggatcctttttggtacagaagggtgatatattgattattttcacgtaacttaagcaatcggcgaattgcttcagctcctcttcttatcaacgcagctttcaacaccttttcatctggcttaggatcttggtcttttagctgcaagtatatctcctttggtaaatctggaggaaagaaaggtttcataacttgtagcttggcgattcttttccttctgtaaaatatggagaacaaaatcagtgctccaatcactatggaaacataaatgatcggggtaaagactgagatcttttgcagaggcatatcctcaattatgggttcttcttctgccattattgaaacgttctgtctggagagaatacttgtcaagttggatttgatttttctaaaaatgcgcgccgctgatggaaaattataataattgtggttatataaatgtaagaatatataatttcgcttcttactatcggaacttctcaatgaactcaaccttcttttccaatgaaaggtctttaccaactagctttagtctacccgaattggagagaagatctcgtatttcgggccacgtatggtctttgtcaagaatgaactccttgagtctgtaatgggaggagtttcttgtgaataaattagttagaagatatgatgcgagggcttggggtatcggagttgtagtgtatggattctcattcttgatggacaatgccttcaccttgaacttcttgaaaagttttggaactgacacagtgtctgtagtgactagaaatggtaaaatagacttattgtttgatgtggttccttcagggaacagaaacactgtttttgattcagaaatggacgataattggatcttcttaccattcttctgagcatgcaaattaggagaagatagtgcatgcactacaactccaaatagtgagtattcgtagaggttaccttctatgtctggtatcagccagacaatatttttcagtcggttattggtgatcaatgacagtaccaatggatccagaggagattgataatttgaaatgacgaaatctcccttttgaggcaagttcaactgaattaacggtttatttgccttttttatgttatcaacagaaacatcaacatcaacattcaacaggaacaacactgccttggtggatagcaaaggaaccacagggtaaagcaggcccacaattaagaggaccaaaagcttcaagactccaagtacaacacccaccaatctcagaaagatgtttaccttaggcttatttaaaggcaggaatggtgatattccagtgcctttatcccgatacgtcgtatacttttccattacttgagcggaaagccaaataatttagttaatacttcagccgttcacttataataataattcgagaccattctaaaacattgcatgtgttgttttgttaccttcccaattaggacatccaaaaacttcaaaaactgatctcttaagcccttcctcttttctcagtacaccaaccagaccaggccacttgacacaagcagaaacttcccctaaaatgtctcagtcagccagcacaacatcaaggcagtcgtcgctgccgcaactgacatcgtctcaagcgtcttctactatcacttcaagtgcatcatcgagctctaattctgaatcccaaaatagcacagggtcttcttcggcgaactcctcagcttcgtcttcaggaagacctcgtctcagctctagcacaaccagctcgggcatgccccagctgacaacgacctcccagacgtcctctacaagttctttcagcaccccagcgatttcggtgcctccgtctaataataacccattcatttggaggtcgtctcaaccttccggaactgtttttatttcaattggagccgttatgggactgggtatcatatgctttattatatatatcacttggaaaagcttgaaattcaaaagacaggcaaagactggaggattttatgatagtgatgattcgtactcccacaaatacgataccaagtactatggaaacgatttgactaccacgccttcacgggtcccattcatggctccagatctcagatctacaacagacaacacttactattccagcagtaactcggaacctggtgttaatgccggtgctttcgattcaatttcgacgtttcaccacaagtcaaaacaaccacttgataccaccagaatgtacgtttctcctacaggtgacgctataaaacacagtaggaattctgtgcttcttccgagcgttaataatgggaaatttggttctgatacatccattctctcaccatctataaagcaaagttaccaatataaatcacccactggtcaccataggagcaacagttctcagcaactgttcatgagtcccatgttaagcactacttctttagccgactccaaaattcaacagcagcagcaatctccaagcgaaaagaagtcaaaaaggaatgctaagcgtaaaaccgttccaagtatgtacttagaccaactgatggatggtgaagggactgatgacttagtttagttagttaatttttgcaatagaaacattactaagtttattctttagtaaaaataaaagagaattaaaataaattgagttctctgctcttgttaatacataatagctgtatctgactttacattattgtacagctggttttattgtcctcctcatgcttgacactcagcgcacagcgagcagcttctgtaaacacttcattgactccgcggcctttcatggctgagcattccaagtatctcaaagccccgattctctttgccaccgctagacccttttcataagtgaccagtgaacggcctttactagacgattgaatgccaccattatcagaggataggttgttttgttgtgatagttgttgattttgttgtgaatcatcttggtcctgttgttgtgggaatcctgattgtgtctgggtatcaccatcctccgtgtttctcaagtcgcatttcaatgctaccaaaaccaacttgactccttgacaatgttccaggatttcacccacccatttgttttcaacgttttccagagaatcgtaggaatcaatggagaaacagagcataatcgtatcagtatccgtgtaacttagtgatctcaatcggtcgaattcttcttggccggcagtatcccacaacgagagctgcaattgcttcctgtcaatgaagatatcatggatataattctcaaacactgttggttcgtagacctgaggaaaataccctctagtgaacacgttcagtaaagaggtcttaccacaagcaccatcacccaaaatgactattttcctttgaactaagcgttgttagtaagctggtcgttctgttgtcggtatgttattttttcaatacttactaggtttatgagatccactacaaaacaccattttttccaatttttttgatatttgtttgatctaagaataaagtaggttgcctccttgcaatagcagcggtgttgtgctacttgaaatgattaaattaggtattccttcgataatgttgcaggtcagaaggagaaatacagcggtgtccttccttcgaaatgaccctcgattattgaggcagaaacctgtaagagtggctcgccatttactagataagactttcatcgtggtaaaccttttgctagttccaagggaaatggcagtgtctgaattcttatatacaagataatcatagaatggcttttgaataatatttatatagaaagaaacaaaagaaaacggttggttgttggtcaatcttcaaacgtaattacaatttcaagcaattaaccattaacctcacgcacgattgatactacaaaatcacctgaaaatatacttagattcatccatttttttggactactttaatcctttccctctgatcatctcacttcataatggctccaaaccttatacaaccactaatatacaaaatctagactcctcaattaattacaaatcattctactctttctccatatctagcattatctcctttgcaagttcatcctcactactatctgtttcttcttcatccaatttgagcctttttgaagtatcctcgtcatcagcaattccagcttctgcatgtcttttcttggtaccgtttgcttcgtcgtcatcattatcgtcttcgtcatcgtcaatttcatccccgctaaggaaatcttcaagttccttatcgatccattgcatgtcatccacattgagatcaaaactggcgtcgtttccgtcctgacccttctcaatgttgttctcattaacgtacttctccacaatgtgatcagggagcaggtagtcttcagggacttcaagaagatattcatcctcgtctactttatcccagaaggatatgcatttgaacagccagttaggatcaacaattttcacgttaggatcaagtgtcttggccagtttcaccttaaaagtccccgtattgcgtgtgattacatgtgtgactgatttgtcataatctgcaacaactgtggccccaaacgacctggcccaaatgacaatatccgcagaatttaacttggtgcctaaaggcaatattccagacaacaagaacgtatattccttgaaaacaagttgtttcatagaatttaatatatccttcacatcagggtttccaacctttgaatcatcatactcaaaataaaattcgttgtgaatccttattaaggcttgttccaaggtctccagttcattgtcatcatcaaaaagtaagtttgctgattcatgatcgctttccgtttgtactattttttccagattttcctggagcttagctaagggtctttcagattgctgttgttcaatttccaggttatgttccgttgattgttctcgaagagttttgccatttgcatcattcatggttaacaacgcatccacagtggaagcagtttcctttgaatctcctctctcttcaccattttccttacttgaatccgatatattttcgtccgataccaccagttcctctgatagttccttgtcctgttcttctgggtcaatctgaaatgattgatcccttaaatctttttccgcattaatctggtcctctaatgaggccaacgatttccgcctcttagatggtcctaacaaggcatgctgtcgtggaagaaaactagaattgatatcaccgatccccacaaaaaaatcgtatggaactaccttgatcaaattactactccaattccaaacatctcctcgatcgtcaatgaccactaccatagatgtatccacaggaaagagtctttgcaatgacttttgcgtcaatgaaccgctctcatctcgagaaagtatacgatcaccaaagtatttctcgtctggatcgataatcttggcaatctctttggcatattgtctggttgccatagtatatatatgaagttcgtatcgttcagaaacatgttccaggaattcccgcaaatgtggtctgagtttcacgtaataccagcaaacagtagcaggaggcttctgtccaacataattctctggtaaaataacttcctctttcaaagagaacgacctgacatctttcactgcaggataattggcattgtttgggtccttcatccactcgccaacagtggggtccacggtagcatggataactgtttgatcgaggtccacaaccaaactcagcttcttttcctttaaaagccgtttagatgacgtttgttcgattttttcagcttccgtcaaggatatctttaaatctgcacttccatgggacatgaccaccggagcttgcttatcataactaaaccctgtgtaatcattcccttcaacagccgaaccacacaatgcacacaggccaccgtactgaacagaatgggaacacggttctatcacagtggctatcaccgactccttattctccacaacgtcgcctatagataccagaacgtccttaactattccgtcaacgggacattcataactacctatcaattctaacttctctttttttggaggtttgtacgagtagtcttcatcatactcattcctgtcttccgtaacatctcggaactccgaatatttgtacttcaacacggtattgtgcttcccaagctcatcgccttctttaatagcaattcctgtgatatgaactggaaacggaactgacgatggaagtcgcagctcaattatattattcattatcgctggactgggattatccttattattttgttgtgtctggttgttgtctctttgtaactgtttaattagttggtgtgatagctttgcagtaccgacttgggaggtggtactgttaggaaacgcgcgcgcgagggtctacaattttatagatagattaattatattttgaaatctttattataaaacagtaattacaattaggagctgtccacattgaataggtctgcgattggaggttcaggttcaggttcagaattagtcgagtcaagtattgcattgttgctgtcccattgctttgagctgccatttgtaaagggagtctcctgattggttttttcaatatccccattggtgatatcaaaactggtgtcctcttctatgagcacctgttcgtcgtcattttcgttctcattaagattttcattaagatttttgttcatatcaacgtcatcttcgtcaaagttaaactcaaagtcaatatcctctgtctgatgctccagttcttgctgaagttcatcttccagttttcgtctcttcaactgctgtgactcttggatcttctgtttacgatgctccgacttggagatttcacgactaacatggtaatattcggtattcataatgtttacaatgatgtcagacactggtggttctatcttctttgtagcgtaatatcccaaatattgacctaccaagccatcgatttccttacgtctgttttccaacagttgctcttggtgccgtttcctcttttccaaaaccgacaaccgatgtttggcgtgggcaacaatgtcaaaccgtttacttgataccatacttttcggtggttgcgactggacaccattagtctcgccattcggtcctttctccaaattgtgatcagattcaacgtcgatttctccatgatgaatctccttgtctatgtcattatcattttcattacccacatcttcttttttgtcttcaactatttttgtacctataaggtgctgcaatgccttttctcctagtcttgattctgctgtcaattgttctctcagttcctttggatcgctaatcacttcagtgaattgaggagttgcaacgtaagtgtgctctggaggaagcaccggcatccatttaggaatataattctttcgcttcatgcgcaagggcataaactctgagatcttctctgcaatatcgaaaaagaaaaaagcatctttatcattttcactcacttgtacgctagaggcactttcttttaactctgaggcgtatttcgaaagtttttcaatggacggtttgactcttttcctggtcagtttcaaacgttcatattctaatgtaacatcttccaagtccaaaatgcccctatccacaaccaattgaacatctctttttgctattgtccgtcttctttgaatctctgtgcttctgtgtagttccgataccaatcggtctatgtattttgttgtaatgtaggtcagatggtcaattgacagcgaagaggcttgcacccccaaactggataaaatcaacaggactgatgccttcaatgctacttccatagccggaacacattctggttgtgaagtgatattcaaatctttacctgtgttgtatctctcttgcacttcttggtcgtgttgttcctcgtgagaaagagttggattcatgcttcgttgtccaaccgaattaggattttctttcccgctggacgctgaacttaccgagacgagggactgattatcgtcggacttatcagccatggtcctattgatgaatcgggaaaggtaatcctcagtttattgcggaaaaatgttacttgatcaattctctgatgttactttggtgttggtcgcgcgcggtctgggtgccttctaaactcccttaagatggttcaaatgataatttccttaaaactacaactgaaatggactatctactatttccgggtcatacagaagagaatactaactaccattcaacaggttattgacagcaccttgtactgatccaccggcacgtctcaatgcagcaacattactctcaaaatcagtgaaccccatgtcattcaattgacggagttgagtctcgtatctttcctctggtggtcgggtatctgtttcagcaggtggcgcagctcccccagaaaacagagaattaaacaactgcatgtttccggtattaggcaatggaggcgcattgcctccagattggttcaacatggctgcataaggattcgaagagttaagtagggcagagaatgggtttatgcctgtcgcattagtcgtggtgctgttgttgttgttagtgttgtcatttgttggtgcagcatttgcttcagaatcagttgcagagcctgcattattctccgatgtatttctttccaaagttggattggcacctggagcaggaaatgaggcagctccagcttcagcaccaccaaacatgtgcctcatggatgacatctgcctcatcagttgtggattagtcatcatctgcctaaattgttcgctctgtaacatttctctagcatacggacccaactgctgtagctgcggagattgttgtatcataaactcaaccatctgaggatctgaaagcatgttcctcatactttcttgcaccatgggagattccatcatttctgctatttggttttcatcaggcatggggcccatacctccatctggaccaaacatggaagcacttggcattgggacatccatcccggcataccttgctccagtaagtccagctagaggattaaatgcaccttgaccagcagctatgtttgaaggtgcagagcttgtattgttagcagcaccagtagatgttgatgtggagttattagcattcgccaccgaggctgatccaccatcattcttaggggcgcttttcaccaagtggatggtatgaccagactggactttgtaaaagttgagagtgtctgcatccttaagagctctaccagaatagatcagtctctgacggtctgcaggaatatcagatacctcggcaatctttcctttgaactcttcgacagttatggaaggatccacggtaagctcgtattcttggttacctgaggccctttaaatgttagattctctgctaatattggagttgcaaactcactgtttacttactttataaatacttggatctcttgggacatgtatttggggattggtaggatatatgtagacttcgaatgttgtcgaaattccgcaaaacttaccctcacaatattctcgaacgcaccctggagaggtcagatgtgggtgaaaaagaatttctacctgcgcccaataaattccatcgccttgatatctcctttctttaactctggttcgtctagaacatcggcgactaattcccaaggatccctggaccctccccatttgaggactttgtttctgaatttttctccattttctctgctaagaggatctttagcaaacaaatgctcccaaatcttcttggcaatggctctatcgaagagataagagtagtagacagcaccgtaggaaaataaatgtccaaactttccgggccactttgattcagtgtctgcaaatatcttcaattgagtctctaatttgtggtaaaggtcaatggaatcaaaatctttatcgaataccacattggaatgcaaaacttggtccagtatggccatttttatttggccaaaagtctcacaattattcagaaaagagttgaaacatgaatagttttgtagtagttttaatggtaatggctcgttggtcctgtaatgttttgcaaaactcatcaaaactctggtatcattggcaaaatgttccatcaaaatggagggcaattctacaaaatcagtggcacatctggttccactgacgttgtgaagttttgtcttccctagcatggagtgcattgcgtgccccatctcatggaaaagcgtttccacttgtgaaagtgatagaagagaaacacctccttcctcttggttgaaggagcacaccagggagatcactggtagctggctcgtggttccatcaggagcagtactaacctgaaccaattgcccctctttgcctggaatttcaactttgaaaggatcgttttcgtctagttcttcggggtaaatctttcttgaacagcacaccgtgaaatgcgcaggatttagcgtcttcgactccctatggaataaatccaggtagattatacctacaaatccttctgtttcactggtgacatgaaactttcgaacaccattatgccatgcctcacctggtttcagcggaacagctttaaattggataccatatatcgactggaaaagatcagacaaaccttgaagtacaactcctacggaaagatactgggatatatcctccgtattagaagatcttttacttgacagatatagcgtggtaaggtagtctctatcccagggtttcaccatttcaataacttgctcatcggatagtttatcggaattttcaactttaaactttatcagtgttctgagctcagagatgacatcctcttcgatatctttcaagttctttttcaggaaggtcataacattttcaggagttttggccatcttttcacttagttgatattctgcaaagctgctcttacccatgaaatgggccaacagtccacgatattttagaaagttttccaacaatgtgatttgacctttcgctggctgatgtagtcccaaccatattttctttctcagtgattcgttgttggttagtctcaagatatcagttgagacccgactgttcagtggtatcttcttcttgttagacagagagtaaataagagaattttctgtcgacgaatcgtaagaggttaactccttcttatccaccttaatcgaatcatgttctaattcatgaaggttcttgttgaactgctgcccattcatggaaattaattgactgagttgaataaagttgtctttggtactatcgtccatgctgatacctgatttcaagaaatctgtcagaagcaagtttccaacactaatctcttccggcgacagttttgctataatcttttcatcgcccaaaactgattccaacttgttaaacaaatcactggtagtgttcaggacattcatgtactcaaacattatttcatgacatttttgagctgcttcaacgaagtactcatccggatgagcaactctgataaactcagctagatctatcactcggcacaaagtatcacttagtcggtccaaattacgaatgtaatttagctttccctgctcactatcatctataatgacatgagatactaggttcttggcggccgacagtgacttttcacaaaactccagtagtccttctggtgaggttaaatacgggttctggaataggccaatggaaccttcaacttggggtatatatgtctttcctgtaagtgacacctttgtatgtggaataaaggacttgttgaactccttccacttaacagggttgtcaaaaatttctcttatgagctcgttatggtgggtgtgtttctgttgaaagttgaggtagtctggaatagggttctgttcgtgaacgagaggctgaatcttttggagcagagctgagtgtgtagtgaaagtcctcttatggcaacttcgtgtgattacagctaaacgctgtatactggaagccttcatagtagcgtgggcaaatccagacaatcggtgttagcttagccagaagagagtattgaataagttttaattttcgctaggaacagtttcgcttcagggtcctcttcccatagcaaaattggggtttttctcttcttcgaaaacagccttttatcttgactaccgtactacttaagtaatgccattccagaaactacatactgtaaagtctctatataatctttgaagtctccgaacgagcttagttatagtcgtcttctgagtttctctctgactcaacattcaagactgcattagcgtagtaaatattgttgtgttgaacactggcaagatactgtgccattatttgagagcccgacattgcatacgtcctgccaggtcgctgttggtccttgaaattaactgcgccacccgatgctgttgtcggcttcgatgtggaggacgatgttggcgatatggacgataatccagatggagggctctgtgatttttcttcatcggttttttgttgtgcagatataggtgcagttgcaggtcttccattggtgctgattcccatactagcaaatatctcctggacatcctgtatttgttcaggactggctgactcggaagcttttggtggatcagactgtgagttatgatgattttttggttcgtgtggttcctttccgtccttggatcggtgatggggcttgcgatcccttttgatctctttaggaaggtttccacatctatctttggcaaaattgattttaaattcctcatattttgaaaggagactaaatgctgggttttctggatcaagattcttgttcttgaacaagttcagacaatcaatgagttcaatggctgctgcaatgttgcaaaagtttaaaaaaacacatttatcaccattgaaaaagttgatctgctcaagttcaccaaaatattcgaaatcatgacgaaggatgtctgcactaggtaacgattgtgttttttttgtcttgctctcgctgatgtaaatgtttctagacgcaccggcagtgacagcaagggggatattgtttggtactggcccaataggtcttccccagcccactcgtacgcgtttctgtttgattgttaggcctctaagttgggagttcatgtagaactgttctgccgcaaatgcatcaatgaaggttacgaaacaaattcgtttttcaggtattaacttgacattctgcaggatcccacctttaacgacattgcaaacgctttccacggtggtgtcgggatgcaatccgcccaaataaattgttctgttttgaagattgctatatgaagagtttattggaggagcattgcttgaaatttgaggagtggtcatttggtgatgaaaaagacagggatcactacaaaaagaagacagaagtaatagcttttgatgagtgtcattaagcaactcaaacacttctatactcgtggaaatattagaaaaattgatctgtatggtttcataccgatactgatagtcgacaataagtggtattgcttctggcagatcagctttcaaaatagaaataaccaaatcatacaactgatcaccagttttattttgggtcaacgttctaactgcaagagatcttgtggcattcagattcagaatcctatccatataagtcccatctaccaaatagtcatcggatgagttattgaaacaccatgagatcttgagattgtcaaagcctgttgaagaaacaaagtccctccagtcaaaattttgcagaaagactaaagcagactcatcgttgacgaactgcaccaacacggatgtcccttcaccactatcctcttttattttcacattctccaagaactgactcgatttgaacgcgtccaaaaactctttcagagacaactccttgggcaatttctcaaataacaaggatctagagtgattcacctcatgcagcaactggtagtgctccgttaaatatttctgatccagattgctcatgtgttgatcaatatatggcgtgcttggctgggatggaagaactggtgtagctagaaagggtgtcaacaaatgtgacggcagcatggaccgaccatagttgtagtccaacggagttcccggttgactggtataagagaagtttttcatgttcaattatagatccacgagtgaagcctggttagagtttggtttcaggttgaagataatacaggacggacgctcgaaaagtaataaggaaggttacagtgcgatgatatatttagataaggacaggagagattgttcaccaagaccagatcccggtgtgggaaaggaaagaatgcaatcgagttagcaataaacggtgtcctgtgttacaaagagtgttggcaccctttcttagaggagcaattttccattccaatttgatcggaaagagccagtcctccgacccaaaagtcttcaggtgttatctgaaaataaaatacacgagatcggcatcacgtgatgaggacttccagatccgaacccgaatggtttctttggtgacacactacagcccgcattgttcaagccaatgctcaaatgcctaatacgctaaagtagatacagccataatgaaattttcgaatttcagctatttcacatacaaatcgatttaagccttagcaacgtgttgcaacaagtcgacgactctggtggagtaaccgtactcgttgtcgtaccaagagatcagcttgacgaaagatggagtcaattgaataccggcagaagcgtcgaagatggaggatctctcgtcacccaagaagtcagaagagacaacggcatcttcagtgtaacccaaaacacccttgagcttaccctcggaagcagccttgataacagacttgatctcctcgtaggtagtctccttcttcaagttgacggtcaagtcaacaacggagacatcgacggttgggacacggaaagccaaaccggtcagcttaccgttcaattctggaataaccttaccgacggccttagcagcaccagtggaagatggaatgatgttaccagaagcggttctaccacctctccagtccttgtgggatggaccgtcaacggtcttttgagtggcggtcatggagtggacggtggtcatcaaaccggactcaattccgaaagtgtcgttgacaaccttggccaatggagccaaacagttggtagtacaagaagcattggagacaatgttcaagtcagaagtgtatttctcctcgttgacaccgacaacgaacattggagcatccttggatggagcagtgatgacgaccttcttggcaccggcgtcgatgtgcttttgggcaccctccaaagtggtgaaaacaccggtggactcaatgacgtagtcgacaccagccttaccccatgggatgttgacagggtctctctcttggaaaacggtgatttcgttaccgtcaatgttgatcttgttgccgctggcagaaacctcacccttgtaagccttgtgggtagagtcgtacttgaacatgtaagcagcgtattctggagcaatgaatgggtcgttgatagcaacaaccttgatgtcagctctggaaagagcgactctcagaacgagacgtccaatacgtccgaaaccgttaataccgacagtgatagccattgtgttttgatagttgttcaattgattgaaatagggacaaataaattaaatttaaagtctttgggtcaggagaaaccaaaattgggaaaggtgttcgccttttatattcgattctggtggtttccaataatctcatgacatgcgtccgcccgctattattgccagcgacggccgggacttttccatccctgggctgctaggtcgggtacacgacctccgttttacccgcaacgtaatgctgggaagagcattgctgcaagggggccgtagaagaagctctccagcagagtaaaatttcctagggacggtaacgggcggtggaaggagagagaagggaagagacgtttctggttccattactccacatttaagttttaccccggagaattttacgttgccagcaggtcgttcggagttgcaacggagccagatatttcagagatggctacctgattggacgaggacaccaagacatttctacaaaaaaggatcctgtcaagtgaaaggggcaattttaagatttcaatcttgatggatttcattgatcgataatagtcgcatgtgaggctgaaatgtgccgatgaaagaaaaagaaaaaccttgcaacaatttggtccattgtcatcactgacctaacgtagttaagggatgctgatattctttgggaaaaaaaggaacaccatgatccacggtggaagactataattcaggaacggatgtcaaatgtccgtttatgggaccatttcgatggtaatttgatcggaactactggaaaactgtgatttttcagagagtctagtaggccatattggtcgggacacgcctgaaactgtctgcaaccccacagttcgttaaagttcctagtaggcatgctcaagaaagcaaccttggaggtgttgagaggcattaaaacgtctgaggcattaagcgtttaggtttggcaagttaaggtccggtcaatagggtccaaaaggtggttcacttgggaccagagtagcagagatcttagtgcaaatgtaaggagctgaagttaaagttttacttcaaacttgatccaaatttggttatgtgtatactaaatcaagaattgacttgtggaagcatagatgttcaaaagacgcaaggatgaatgattgacagtcgggattgagttggcatgcaagttaatggattcagtctttttctttcacgaggcattctctgattttgccagacatacgatgtaaggctttaaaaaacttgaatcgaatgtatgcgtatatttcgtactctggtcattttgtagagtgaaagaatgtgatctgatcagatccgaccaggtcttcgtttttggtatatatctccttgcttcctaatatggttatattgtcattttatgctcgcgcgtttcgtgtttagtattcgctctgctctattattacttaaatctaacgactactctttcaagccttactcgacagaatcaccttgaagtaccattcatactgcccaataagaaggtctttaacgctgcatttaagggatgtaccataatccgtttacagcatatattttaactagcagattgaccttttttatgagaagaatgagtgtgcttggcagaccagttttgagccaagcagatattgaagcattagaggtttcttttaccgatgatgacaaatcggaaccttcatttgacattgatgatgacgatctaattcttctaactctgaaaaatgttcatcgttcccccttaagaaaagaacaggcattgcatccttcaattttggagactcaaagatctgaaaaaatcaccatcactcaaacaccgtcgcctgattggcacttgtttgaaacaacttgcattaaaaagagaaagattcattttccagatcctgtctcttttgacatagaggcccagatatcaacattttcctcctctcctataaaggctgataaaaagaataataaagtgatagaaaaacagctgacagagcctgcctccaaagagtcacccgtgatagatttaacctccaatgaagacaagccagaactcaccactagcacccaaaaaccttcaacgcctccaagatcaacatcagctccggttgtcaccaccagtattggtgttagaaatattcatactgtcactgccagcaatgctcaacctttaaatagtaggatacatctcctgacgcaaattcccaaacgcccagatgtttttcagtttactcaaaaagactcacaagaaattgacgacgctcagcccaaacttgtcaaacctttggttttatcgcttgaacaagaaaaagtgattcagttagccaaacaggggttgggaatattctacacaggatctgctggaactggaaaatctgtcttgctccgaaatttgataaaggaactaaaagagatccatccccaaggcactgttggtgtcgcagcttctactggattagcagcttgcaacattggtgggcaaacgttgcattctttcacaggtataggacttggtgatgctgacgttaccaaattgttgacaaagatcagaaggaataaaaaggttagatcaagatggcttgatttggaggtactcatcattgacgagatctcaatgatagatggaaatctgctagataaattgaatcttatagcccaaaggcttcgcaagaataagaagccatttggaggaattcaactcatagtatgtggagatttttatcaactaccacctgtatccaaaacccagtctgccaagttcgcttttgaggcagactgttgggatgaagtcgttccaatcactttgaaattatcgaaaattttcagacaaagaggtgatttggagttcatagacatgttgaatgaggttagaaatggacggatctcccccagagttgaagcagagtttcagaaactgaatagaccactcccagtggatcaaggaattacacctacggaactctatcccactcgagaggaagttgagagatcaaataaaaggcgtcttgatagtattccaaatgaaccactgattttcaaaagttatgatactggttcgttaaaagacgaagagcaaatccagcatatgttaagcaactttatggctcctaaaaccctgactttgaaaaaaggagctcaagtaatgatgatcaagaatgtggatgccactttggtaaatggatctgtagggaaagttttggattttattgacccagacacatacttattctacaagaaagttagtggtgagaactcggaactggaattggatacaattgaacaggagatcgaagcaaaaattctatccaacggaaaaaaattagatgctagtttgaagccttcagaaaagttgatttctaatgcttcaaatttagcaaagcttgatctggatgacagcgtattttctttcatgaaatgcatcaagagtaaaaagaaaactgtctctgaagatcttaggagaaaattagagttgattaacacgctatacaagaattccagtggaagaaggttacctttagtgcgtttcttgaccactgatggtgaaactcgggatgtactggttgaacctgaacagtttagtataaatgacatagatgagaaacctctagcttcgagagtacagttaccgttgattttagcttggtccctttccattcataaatctcaaggacagacattaaaccatgccagaattgacttaagaagggtatttgaagctggtcaagcttacgttgcattgagcagagctacttcaaggaagggtatacaagtgctcaactttaataaagagaaaattcgaaccaatcctcaagtggagatgttttaccagaaaatatatacagttgacgatgcagtcgaaaaggcaaaaatccaacaaaagcagaaacctcttgatgatgcttcggcccataatgaagcaaaggagaatagtaactatgaacgcatggctccaaatgatattataaagcatttgactagacgaagataataaaaatgatggtgatgacaagtttgaggtatatactaacctaactatctattattcggcgttgcccctatagcccacccaagaccattaaccagcatattagaaaatttatcctgagcttgtcctaaatccactttcagattttgagcagtttggtttttcaaaacttctgtagcggacgatgttagagctctagtgaatcttgattctaacgactcatttgccctggcatttgattctcggacaactcttttattccttaacttcaaatctcccttaattctctctaggtctttattaagtaagctccattgctccactatcggtacattgaattccgttggtacatgtaagaggagctttcctaaaatgctaagttgtttttcaatcaagattttggaattttctgatgaatcttcatcaatgtatttggaaatttggaaaaacactatccagttttgctgaatgatagaagaaggactatctagtagttcaagtccatgttggtaggaatagttaaaatcatttctaactagggagaactcaatacatttgagctgtaccaaaatttgtaaatctgcaaattgagcttttagcagttggctagactctgaggaatcactaaatcctatgatcaggttttcatatatgtcaacgaggtagcctggatctttataagagctctcttcagattccaaaattctaactatgacatgtatcggatcttctccattgttgagtagtagtaagttcttgggctgaaagtttcttgaaaaagagagatgaaatctctgtgagattgattcgaaagcggaaatcagggattgtagctgggaattctgactaacattattagtatttttgggaattatatcagggtttgtcactatggatggatcatgaaaatgactcaaaagagttttaagatgattaatgttggaagcagctccataaagagaccaagcatgttctagaataatggaagcgtactttggatttttgttgaactcatgaacaccgaccaactggggaataataagcctgaaaaaaacatggtaatcatgcgattgggaaaaaaagagtttgaaaaacagtatgttgacttcttctttggatacttggctgaatatttgcgtgtcattcaaaaaccagttcaaagtattcaggagacttgtccaatccctctcgctggaacagtactgaatctcattagcaagaaatttattgagctccaacaactgaatctgagaatcagaagtaaattgaaggttgagcaattgaaaaaccgacaaatttgaggcatataatttttcacaacattccaagagagtacgtaatttgagaatgttgttctttgttgggaccatggtcgaaaacttaatcacctctgataagtttttctctttccagtcattcagttcaattgtctcgtcggcggagtttgtgctaacggtattatcatctgaaacattcaaaatgaaacttagtatttctttgaacataaggcaaagactcaaatcaacgctagacgtaagatacccggtaccaataatcagtgaaaccagcctgttataacaattgctgtcattttgctgaaatactttgagtacctcaaaatcattagtttttagtttggaaagattggatgctaataattgactatcttgtagcgtttgttcaaaaactgtttgcaaaaattcaatatactcaccccaacaattgatataggtaatgtagggaagtagaatttcatgtgtaactttttcagcactatcttgatttatgcaatcatatatcaactttaattgagttctgatggtcagagtgttccacttggatagtgtcatatctggtgacaagtacgggaacaacttatgagcaacctgtacataattgattctccaatctgacacttcatcaacaaataaagggaaattgaaggtcagatctggtattacttcgtttactttaatggttctcgctttgataaatgatacagtaagttttgtaggatctaaactactggaatatgaaagagccattgatttcttagtaacttgcttgcataacttagtggctctgttgctaatcgtcgaaggatccagatttaggtacgtttgatagtcaggatgggaggcctgaaatcgttccaaagtttcctccaattccaactccagtttggtaccagaggtatcatcactaaccacaacatcttctggtttatacccgtccaataaatctaaaataaaggtcaacaaatgtggatccaagtgatcgggaagaaagaccaacaataaacttgtaacgttgtacaatgtcagatcaaggattctatcatggggataaccttgctttgacaactcttcaatttctttggtcttgaaatacacgaagtctgcaattaggtccaccaaagactttaattgcaatgtcttcccctctgaagccaacaatcctattagcaagtacacttgattcgttatcatggtggggacaactgacctgagaagtgaatagtaggcaattggaatactagactcgaataatggggaatgttcggatgtatctaacatggattcttcatcaaccaacaatatttcagggcccactgagcaatgtcaaccgaagaagccggcataaggacgcaggcacagttgcttgacacagaacttaacaagtacatgtccacgaggacgcaagtttgggacttggctaatgtggtaaaactgggtaacaagttaacagaagatcagattcaaaagatacagagtttaaaggcagacataaacagaagcgaagcattccttaagttgaacttgagatcacaacaattagaattccgaacgatttatgaacagaacaaagacgttgaagaaatcgttaatgaaaaattgcaatccaaattgtcagaaatagaagcccaaaatgcgaagctacagtctcaagttgacacagtttcggagctgatcgataaaagaaatcaaattaccgacttgttaaacctttttatttcgggaaatcaagatttggaattgtccaaagatgaactagagaaaacgttccaagggtacgacatggaaccagtgtacaaaatggcaaaaagatcaggaaagatttacaggttcagaaaactacacttgaaagaatcagtgcagcaattgaatgcaaaaatcaaggacaaagaggctcaaattcaaaaattaaaagcaaatatcagagaaaagaaagctaggtgggacaggttgtcaaaaataatagcctccaacttggagagtttaaaggaagatctggtaacagaacttcgataatttcgaaaatgtatgattactatttacacaaatgttacgtcgtttcagtttattctgcgacttctaatcgatctctgacaagttcttgaataacttccagttccttctcttgaggaatttgaatatcattagctctgtactcttcaattcttttgacagcaagagtaactccttccttattgctagtctcttcaaacagagcgtaattttcaactatgcttgacagttttcccaagtcttgcaattcaggaacgctttcagaaaatttggcaaacttcaattctccaatgaacttgacaccctccaggaaatgctcatcaactacagtgtcagcggataaataattagggattccaaatatagcatactgtagcctttccagtttgtcgtaccattcttgagtttcaacgtcctgagaatccaagtactcctgtttaaaatcctgtaaataatcttgtagctcggaggacttcagtaatttttctctagactttgtctccgccaattgcctttctctcaaaacgtgcttgattctccacatcgtagtcctgatttgttcactttgctcttcgtaaataatggcactctgagaatcaacgctttccaatagtcggtgttctctgcccagtacatttctctctttcaaacacacataccatagcttgtgcaagtcgtcaaacttcttccttctcagctcttgaattgtccatggacgaccagttgtttgaatttcctggggttttctaagaaagttcttgttgtcgaaaaactgccacaatggatggttttcaggaacagtgatgttgtctatggtagggggaatgggtcttctaagttttatgttagttggcagcctgtttctggcggcggccattgaagtggtgctgaatcttgccactgtcgatcgattcattagtggttgtggttgactcttgagacaaattttttccagatgtcggtttgaagaggagtttcctaatcggtcacgtgatgtttatgtaatcaaacagttggttttgagttgcaggagaagatactggaggataaagtaagctgtgcaaagagtcaatggtggagtagcgtgtagtacgcggtccttatctccaaatggctcactttgctgaaagtttgtttaggtcgttcaagatgaactggctataaaagtttaatatctaaatatgcgcgagaaccctctgttctatttcactctagaacacagtgaactgaaccactatgcttagactaatacggctatcctcgtcattgccgaaggtaaatatacccaaggcaaataagatgccggcaagacctacgattgctgagggcgacatcaaggaaaagttcataaagggcggatctggtaaaggcggacaaaagatcaacaagactaactccaaagtgcaacttacacatatagctacagggattgtagtaacttctcaggcaacgaggtcaagggaacagaaccgcaaaatagcaagggagatactggctttgaaacttcaagacttggaagatccagcaaacagtaggcaaagaattgtgattgaaagacagaaaatggtaaaggctagaaagaataagagaacaaaggctaaatacgaaacattagaaaagaacaaacaggaaaaagaggatttactggagggaatagacgagatagtttttattgatgagaactctgagccgattcaaattgacaccaagcaatctaaacagaaactactaaaacaattgtaaattacactaagattacagaatgaaactaaaagagatatttccttctcttctccacattttctaaagaatggtatttgatcaactgatcaatttcatctttattctcgttggccaagagaatgatgtcatgtctgggtaagaaaacccctggaaagttggtaagatattgggtgttatcttccaggtaattagagatgatttgaacaattagtttgagatttccactagtcacatccagtaggaacgtcaagtagtaatctttgactccaagagcatttttgaaagtggatttccattcctgatgggagtcaaagattttgacctctgcaagaacgtctttaagcagcttcgtgtaagcgtctttgccaattttttcgatcttttctgggtctataggaggagagtctctttggagagattgcaggaaaacacgggataggtcagatttgctagtggtggaagatattgggatcactgacgatgagtgttttcttttcttagcattcaccaacacatcatggagaacttcgtcgtccgaatcgatattcctgacttgtctcaaagcggtagatgctgcgtattttcccttttctaataccaaattactaactggttcaggtacttcatggttctcaagtctggcttggtagtatcgatagtaacttccaacaccgtatgcagatacccactttgcgtatcgttctgaccaagatttcttggagtgatgtgggaaactgtctgcaagctcctggaaaattgatgagtttaccttgagatcttcatcgttgacatcattgatgttgctttcacgaacattatacttcaaaatttgactgcataactgaaaatcatctttggcagagtatctaactctccctggtagcgtagaagaggtcaatggctcttctgaggttttatcatctgcagtagaagcgtccgcatcattgatgtatactctgacatagtttccctcaacatctctcagcaactctttagaatctggatcactttggtagtaatactttaagctcttgcggattttttcattgtatctagacttgatactataaaccgttcggtgtggcagatacttcttgtggatatgagtattgatttcaactggacgatgtgttggtattaataatcgataagtctctgcaataatgttgtcttcctccttagtgaaatagcttcgtactggagtcatcttgtacacttgtgcattagtgtccaccaggagcgtgtaattctccagtgggagaacgattccctcggttatacagtcatcgataaacgacaaacggtaaacttgacggttattcgggactgtctgcaaatttcgattaagaatttcctgagactccgccagaaacaaagtcaatggatcgtcagtagaatctattagggtacctccatgttgagtgattcgttctttgtaaacagcctcaacttcctttcctgagtcatcctttccaaccagaaaaaacttgtaaggagttccgattggtgtaacaaatatcgcctcggtctttctattgtgagcaatgggaggcgtcacttgatttacctgaatgtcttcaaaattattcatgtttatgttttggttcttgtttgcgaaaggatgttggatgttgacgcgatggaagaagaggtccaaatgctggatgcttgtccggtggttttgccgacacacgactgtggtccgaagtgcgcgagacttaaaacctaaaaacaaagagatacaagctaagtgtcgcgatactagatggtgacgaacgagaaggacgtctataagggggggtaaacccggaaatgaggaaggggtgtgatgtcaagctggagttagatcaatattcgaggggtgaaaacactttttttgccaagggagtttagaaataactgcccccccttgggcatttctcaccccctttttacaatcatggattaatttccacagcttattcttcaagaaagcaaaactaaccccctattcttcgttagacgtcggtacagggttcaccccctttttatgataacagatacgaagtttacaccaacacccaatcagtacataagaagtgcctggttagtacgctcacacccctaggaaagtattagtcccccacctgccccctctatccttcttaactcctaacttcggggtccgtcgatccattcatcattttcgtctaactcgtctttcctcaatttcgttccggtttctccctaatcaattctacctttccctttttccaccgttcgtatcaagcgataccaatactcctaatcttaagtttactcccataaactctgtccctcctacaccccctccttgattcgaagtcaccggtgagatctacccctcctagttctagagccgggaccccggatcccgccacgaaaatcaatggagaacgagacattccgcgccgcatgtctttaatcctgcgcgcctcgcttgtccctttatatagtcatcagacttctcccccaagacataagggagaaaagtgccaacaaaatgtattaggatgcctaaagctacaaagaagagtatcaagaaagagctagaagttcctgatgtcgtaatcaaggataaaaaaggtcgttcaacctcctgctatctgtgccaaagaaggaaacaaaagtgtgatcatcgtttgcccgcttgtactgcttgtctcaaggccaaagtgaaatgtatccagcccgcaaaatacggtggcaaatgtccggagaaagatgaatacaccgtatggttggagaagcggctgcagtttctggagtccgtggttgacgctaacgactctataaaacgaaccgttattccaactggcccttggactcagtcctctagtttagtccctattaatgggagtaataacgctgaaaatggcgtaagtaatggaatcgcagcaggtataactgccgcctctgtaggaaataccacgtctgagttccaattacctctgcctaccacgtctgcaatgtcagccctatcgtccaaggtagatagaaatcatctgaaaattctaaacttggattcgtttgagaatcagtctgaggcggattttattaagagatataatttacaagagtttttgaagcatgatcctgtttttcaaatagatgagcacatttccagacaactttttgatatttttttcaccctgctccagtataaattccctattttggacgaaacagaggtttttgagtttccacaacgcttatttttctaacaatttgaagggttatatgaacaatattagctatttttacttttgcctcgcaagaatgttcctcgtgtgtgccatttctgcccttttgcataaaacgactggaaggtatcatggtaccaggcctgcatcgtttttctccgctgcattgaaatacgcagcaaaatgccaaaagagtatctcaaagcttcatagagtggagctattgattctcctcgtgttttacttaattagaacagataaagactcgacgggattattcgatgtcattagggatgcgatgagtgtctgtatggagttgaaattgcataagaaagaatcatatgttggcatcccaatcaacgtgaaagacagacagctcagatgtttttggtcggcgtacctgctcgagaaagtcatcactctatctttgtccaaaccgtacgtcctgaatgaatcagaaatggattctgacattcccatgtttgacgattctctttctaaagggaacaatttccttaaccaattcatcaagatccgaaggttggaggccagatttgtagagcagctagacatcattaataccaagagctccccgaaatcaacccaattggcaaaagtcgaacagtattttcaagaactgcaacaatggagacgtgaatgtcaaggattttctaaaggaatagaaaacgaaacattacagtcgtactactaccgatcagtaagaacattaattcaaccttttttggaactcttggatccagaagacaggctcttccaggaatgtcaggcagctgctgcacagatttgtcagtcgttcaagacatatcaccaaaagactgttagtggtcattctactattcatgtccatacaacatttatcgcaggggtaactttgatttactgtttatggcttgcccgaaacacagacgacatgagacgaaagctactcggagatgactccaagcatacaagaccgactatatcggcagcgttgtttcaacatatggatgatcttcgtgcttgttctatttcattatatgttatggccgaaagaacaaaatttgccttaagttttagggatacctttgaggaaatcatggctgcgactatcggcaacctgaagattagatgtggtcctgattcttcagagattatctacaataaagaaccaggaatgccaccagcagttgtgcgaaaacctccaaagcattatacgtctactaccgaacttgatatcaaagctactgacgccgaagagctagaagaaaaagccaggaaagaaaagagagggcaattgcaacgaaatgcaattcccaagggtctgtctcatcttttggtagatccagttcccatgaaatctcaaaattccagcggtaagtcttccaattcgcttttgaacaataacatcgataataaccacgctggcaccaacggaagttccacctttttggctggaagttctagcaacaacggtaatacaaatgtagttgtcgacaattcaattaatggctcatctttcctatcacttccacaaacggaattcactccctttgttggtcgtacgaacacaatgattagcaatatttcagtgtggactggagaaagtggtcagtttgtcccaaattcgatgaaccaatcattaactcagcaaggcctatccaatgattttacgaagacctccagcttcactcataacactaccaacaataacggcaccactaatagcaacgttgactttctacaatcttggggcaacgtccgcatggacgaattattcaatgttaatgaatttgttccctaatatatttacttaatttaactcgacacatttccatattaattggttgactggttgtgatttgttgaccgtcagctgtgatggcttgtagttttttattgggaaatcgtctgtgttctctcccacgctaagcaaaattttgacgtccccatttgtgtcgtagtatcctctaatagcagataaaggaggggagtctgtacgcttgggattattcaagtgtcctaataacccttgaaaccaattgccaatacgaacgaaacgccctttgactccttcagagctcaggtcaaaacaatagctgaagtgaacattaggcgcactttttggatcaagtttctctacctgtggaccatccttgtacggatctagatctctccaaatttcaatgtaaggttcaatcttgttgttcctgtcaggattagccatttctcccacttctttgaagtctccattgggcagctcttcaaattctccaatgtccgggagacctccgtcattttccacgtatttaccatctacaaatttcgccagagataactcttgagtgaactgtttttttgatccttccaactcaatagtggacccgaagttgcaaaattccataggaaatttcgtctcgtcaacataacctggcaaaaatggcctcaagtcaacaaatctgccacctgctgtttgaatgacccaagttgacgtcttctcaataggttcatcattcccccactgaattgaaatacgagcactaaatatatccatcgtccaaggaaaaaacagtgagtaagcttttgcaaattgtcaactcaataaatactctcgtactattagataagataagactcacgcgaagagccaaaatcttgtgcttagataataaaactatgtactcaattgccgataccaaataagaaagccaactcgttcctgccaagcttggatatcgtattcaaactctggttatccagagcgttttcaactatttctcttttcgtattttgaatggtcaaaattctatcttcgacggtgttcttgatcaacattcgatagacgaaaacttctcttaactggccaattctatgggctctatccatggcctggtcttccacatatgggttccaaaatgggtccattattatgacacgggaggcgcaagtcaatgtcaaccccacgttccctgctttcaaagaaagaagcattacgtttttctccgtactctcataaaactcttgaatggcagcatctctattgctaagagacattgacccgtcatatctaatgaatttaatgttgttctctttgagtattacctctatgacatcgaagagagttgtgaattgactaaaaactatgatcttctcccctggattgtctctcagtaactcttgtatcatttccactgctttatcgatcttggcagacgattcgaagacgcctttgttctcccggatcagttgttgaatcatttcaatttttgacaacactggagactcacttttaactatatccatcactgaaatatgctggttcacaatcttgtcgtagactgggaaactgattacattgctttcgttgacaggcaaacgacaggtcacacatttggacactctaagaccgtcatcagtttcattctcttgataattggtgaagaaatcgtctttgcaatcttgacaaacaacatgtccacatttgtataatatacaagcattctcatttatgatgttatccaaacatataggacacgtaaatccggcctctgcttcaatgttaattctccttaccacagcaggagatagttgtgtggccaattgtggcatcttggtagcaacttcctgtttcaatttggcttcttgcttcatctcagataacttcacgaggaaatggtggcaacaagtttgtctcagtctcaatagcaagataagaataccagaataatgatttccttgtccctttccagcgtttagcatcttttcggcttttttggctgtctgtccttccagatccttgtaaaagtctaactcttttgcttccatttctatgaatgtgtcaatgatatgcttcttgggtaacttgagaatgggctctccatcaatcttcgaatctttgtttcgtttcaacaagattgctttaagtagggcatgaagtttcctcatagcaatcttcttgtctgtggaatcatatttgcctgacatggaactctttataggtaatactatgccagttctaaatcgcttttcatcataatatggcttaattctcaagaatcgaagtagaggccatagttcttcaattttattttgtagcggtgtgcccgttaaacaccatctgtatttagacttcaccaaagcgactgccttcgaagtgattgtattttttcctttgatcttatgggcttcgtctagaatgactcgaagaaactttgtttcttttgcaaaaaatggtgacttgaaagatatgcctccagagtcttctgctggtatggatgaagagttgggctgtaggtctgcctccttaattgcctcttcaaaatgcttcttcatttgagaagacagagttccatacgatgttaatactatatcatactgttggagctcttcaaacgaggacattttttgcttgtgataaatgaaaacttttagcctgtattctggtttcgtctttaacaagatttcagactcccactgatgtagaagagaaactggtgctattattaacgtagttttgaaatatccttcgtctccttggatgggtttcttttccgactttgccgttgacgttttgctgacctctccattcgtttctgatgtagacttttcggatctaaccttctcttcaagttttgcctcctcttcggcttcttcttgtgttttccatttgtttgcgtaaataatactaatagcctggatggtttttcccaggcccatggcatctgctaaaatgcctcctttgttggttgacttctccatccgaagtagccaatctaacccaactctctgatgcttcagcagttgaatattgaactccttcggagttttagccaattcatcatcgtctttgtcctccatatcgggctggatattttcaagaagccgttgtaagcttccagcgtcttcatcagaacgagaataaatatttgaagcataacccaagctatttgccctatgaattgcatccatgaaagactggccttccaaaacttcattcttcatatcaccgtgaaaagcattttgagcatttcgaaagataagttcacgatcttttttcagtttgtcaattgttgacgagagagcatggattcttctgtgaatctcctgctgttttatcttggatgtatccatctctctaaatatgtgcgctttttcattagtaagctcctgaatcctgttcaaaagctgagtgaggtatccttgattattagcggtcgcctgaggattgttcacgatagattgatatcttagattgagctctgaaacttctctgtttaaatgccccaaagtggaaatgaacctattgatctccataatattcgactgagcatgaactcgaagattgtgaagattatctaacaaatcttttatccgcaagtccagccatctggcttgttcattctggtttgaaccgtcaaaatggagtatgtttgcaggggcgttgaaagttcctggcataattcctagaggctgctgaacaatattggatcctacaatttgcaaatcttcgtcttcatcatctgaatatgattggagaggtcgtttcccttggaagatatgcgcatcttgtgctgtgttgttgttggctatatgatggctctgattctgtgtgctggagggaactggggtagaagatgatgtagatgcggggacagatgtatttatctcgatatcttcagttaaatcgatgatctcttcaaaatttgagtttgtaggttgattgctggacttttttggtccatcattaagtggaaagggaaattcaggttgggacttagaaatccagtcggcgaatccattgttgttatcaagttcattattctgattattggaaaattggtcggcttgggggatgaacctactactattgaacgtactagcttgtggtttcactgatgattcccgtaacgattccagtctggcaaaagaattggagttggattggtcatcaagttttctccttattggagttgtgccgttactgttgcttatgggggcagtaaaattaaatgctggattgggggccaaaaggtccacttttggagtaggctcagtcacctctatgatttccagatcagaatcatcagagttaacagagtctgtcattaccttgcatagatagatggaaagggacagttgatagatgtatcgcgatttgatcgttggggatcgatggtccctaaagggacaggacggttacagggaagcttccctcactgcaatttactgggttgtggcgcagcttagatgggtaatgaataatgcatgccagtaagcatccgttcagcatccagattagcgtatcgattcatagcaaattacatggactaacatactttacgaagatttaaactatttttacacgcatagcagctctataactctccattctcctcgtcgatcttcttcagcacaaaatctaactccttcttcaattttgcattatctgggtcaaatgaaagtcctctctcaaaattgttttttgcatcaacgtatctccccatcttgaaaagggctacccctcttctaatgtaattatctggaatggatggcaggagcgttaccagtaaatctgcatcattgaatgccccttcaaagtctccattcatcatgtaagcgtcagctctagtgacaataaagatcgtcatttcactcaacgtcatctgaaaactctcgtacttgggccttctgttaaccatttcaagacccgtcgtcaacaatttgatagcctcaggatacttgcctgtctttatgttggatacagccgactcgtgtaatttctgagccatgtgggacaatttcttgtcaaacgactccttacttggtggagaaggaacatctgctttattggccaggatctctccgctcaaggtgttcagctgctgtatgtcatattctaagtctgcgtagtcacctgtgactttcagtttctttgagctcacgtcgtacgaaaatggtagcatctcgtaggtgaaagatcggatgaaacagagagtgtatcaacgtgtcaaccttttttttttgctaaggctagagagatccctctgcgacctcgaaacactacagaaacaaactagcttacatcagcaaacaactaaacttacgatacgtgccctatgtatggttctcaatgtactgtaagtaaaagcttacaagtcggcatcatcttcatcaggcaatggcatagcggcagcctcggcgttctcttgctcgtacttctttattaaatcggcatcaatttgaacctctggggcttgcaagtcgggagcagcaacgaactctaattggggctcaccagacaactttctagctaaccacaagaatggcttctcaaagttgtagttggacttggcagaaatgtcaaagtattgcaagttcttctttctgtggaaagtgatggtcttagccttgacctttctttccttgacatcaaccttgttaccacaaagcacaattggaatgttctcacacactctgaccaagtcacggtgccagtttggaacgttcttgtaagtaattctcgatgtaacgtcgaacatgatgataccacagtcaccgttaatgtaataaccatctctcagtccaccaaacttctcttgtccagcagtgtcccaaacgttgaatgtgataggaccacagttagtgtggaatgacaagggatgaacttcgactcccaaagtagcaatgtacttcttacggaactctccagtaaggtgtctcttaacgaaggtggtctatgaattgttagtaatcatgaggggaactaaggggcggaaaacattatccgactcatcaaataatttgcacttactttaccggtaccaccatcaccgacaaggaccaatttaaaagtgggttcagtagacatgattcaatgtttgtataacggaaggaaaaattttgttgttcttcccttgccttccaaagagaatgatttacgcagtgcacgctccagtggaaaaaaatggaatgatttgtcataaagttgctattattacgtaatgcttgcatactagttttacttgactgtatttctgtgctggtactctctcatgacggatgatatgagctctttctcttctgtggtgttgtagtggtatatggctggtggagggtttggtaggtttggcagacttggcggcggcggaaatgtttccaaaggagtttctaatgacagtggtctacctggaatattcgcatagagatcggattcagttatttcatatggtaaatcgttggagtcccaaatcccaagctctttagccttttctagaactgttagtagtctttatgatagtatggccctgtggtgggcgaatcacaagatgtcttaccttcgtagtaatcgcaatactttctgagatggtttcggccaatcaaatgagattttctgacactcaaagagtcatgggtcaagtaggctaaacttgttagtaagatccatttggcgacgatcaattacggttcacactcacaattgcaatattcacaataatactttgccattaatcttaatcttgcttacctcttctctcaatggtcctctgatagtgtcccaaccattactcctcgattacccgtcttcttgccaaccaacgaaatcgctcgaaatgtccaagtcaaggaggaaccatctaaatcaacccttagacacacacacaatgtttgccgttatcagatcatccgtaagtctagccttcaccactcaattcggtgggtttttcaatgtttaacttgactaacatattcaggccctgagaactcaagttagagctttctctgctgccccagccagaagaagtaagtatcaatcaggagtgaaaaaattctagacgacagacacgatgaacaagtactaacatttaccttaaagacctgatttctgatttgtatgtcaaggagctgaagggattcaagccaacccctctttctgctgctgatgccgaaggtgctaccaaaccatgggctaagccagcctccccaaaagttccatctctggaaggagagactgctgaagctttgcaacagtatgaaacctcagacgttgagaccgtccaggctgcttcatctgaatctgcttccgaagttactgaagactggtttgtcttcccagaggaggaaactgctcaccattgataaaattatagaccacgagatctaatgatactagagagaagatacgcaaattgatgcatgttaaacaactattgaaattattgagctcatgattgaggtttcactagtgcaggtgaaggtccagattctttcagttcaattgttcacttaggtggtgtagatatccatattctagtaatgaagggtacgatactattattaactacggttaagaattacgttctcgttgcatggtctagttgtcttgttttctttattgtttccattctttgcctggtttctacgcgttattctttttatctcttctcctctgtttagatttctcacgagttgttatcgatttctgagattctctcaaaatatcccaatctgatgtctgggctctccgtctacaaggaactcaaccagtcgttgataaatagaggttatctgtctgaaggagtgatctttgaagatgaaaatactgtgagaaaccagaaagtggctcaggtcattgaacgtcttctagactccatagacaataacagaacaatcagagacgatcttctcttacgggaaaaagatcatttacaagtgatagactccctgaaaactgaccaatctctcttgaagaagcgtattagcactttggaggccaagtcaacttctcaagagagacatattaaccagttaacagcacagatcgatgaattgacaagttcagtgcaaacaaacattaaacaacacaacaagactaaatcacaactacaaactgtactccaatcatctaatgcagaattcaggaggaaagaccttcagattgatcaactccaagaaaagctagtcgcaaaacagttgggtattaaagggaaagtattctccctatacagtcttcctatcatgcctgatgatcaaccaaagaagagacaaaaaatagccgagtcttcaacggagactcaaaagttaaccccagtggagagatttcccgtagcacagaaagaaaccatgactttgctgtctgatttatatgatataatctactcactgattcaagataataactctaaaaccaggtacttgactatttacaacaatttcatcaagaatttagtaaggttcatttcaaagattgcaaactacgacggcaaaatatcgtatgacctaagagaagagtatgcccaattgacttcaatggagataaattcccctcctgggtctgcctctacagttcatgagacaaaagaagagttggtgaagtctctacaattatcgaaaacagaatcagagaatattctcagacagttttcttcccaaatgaatgaactatacaactctttaggaaatgcttttgaactgaatgaactatctgcagactcggaagttgcctccagaaacggtctcaaacaacaactacatgaaagggagacacagattgaatctcttcgaaaagagctggaaagtgtaacacataattggaaggctgctattgaaacgatggagaagtggaaaaaatacagaacgaagaaaggcatatagcaggagagctattccctttaatctctggtcaggttagtgtgaatggcctggattttagtgtacgctaacactccttccattcccaactcgctaccagtaccactcatcttgaaccctccaaatggaacacggatattatcatcatttgaagaattgatgtacacagttccagcctccaactggctggcaacggtattggctgtgacaatatccttagaaaaaaccatagctgccaaaccgtattccgtatcattggctagctcaattgcctcttcctgagagtggaatttactgatggcaactacgggcccaaatatctcgtccttcacaatcgacatatcctgagtacagtcaacaaaaatagttggatggatccagtaaccactctcaaatgtaactggttcatctccaataactaactttgcaccctcatccttacccttctggatataacctttaaccttctcaaactgagatttgttgatcacaggccccatggtggatttcttatcaaatggagacccgatgaaccagttttcctgcacatgagccttgaacttttgaatgaactcgtcgtagattgtgtcttgcaccaagacacgagagtttgccgtgcaaatctgacctgtgttgtacattattccaaacgcagcccaatagattgcctgatccagtttggcatcatcaaagactatcaacggagacttacctccacattctagagtaacagtctttaaatttgaggaggccaatttttgaatctctttgcctgtttttgtggacccagtaaaggctattttatcgacatctggatgactagccatacgggcaccagctactgaacctagtccactgataatgtttagcacaccaggtgggaacccggcgtcatttactagttcagcaaagtacagcaaagaaagtggagaagattccgaggacttgatgacaatacagtttccagcacacagtgcgggagcaattttccacatggccatattcaacggatagttccaaggaacaatctggctgacaacaccgtagggaatccttttcgacgtcaacagtttatctgggcctgacggaattacattgccataaattttgtcagcccaacctgcgcagtatctcaaaatactaacggatccttcgatgtcagggagagcgttagagaactggggtttgcctgcgtccaaggcctcaattccagctacagtttccgcgttcttctccaaaagatctgctaaacggttcatcaaggttgcacgctcttctccagctagctttttccaagttttgaatgcttttcgggcactagaaacagcattgtcaacatcgctctcttgggcagcgtagaccgaggtaatcacttctccattggatgggttaataacatcaatggtgtcttttgactcacgccattcaccattgatatagaggccaattggctgatcgtatttttgtccggtaggaaaggcaattgatttgcttaagggacttgccattttttttttcaaagtgaaggggaagataagagcaaatgaaaatgatcagcgaatactttactacggggtacaacccttcgctctacctgaagaagttttaattttcatatataatgaagaaaagaacgataaaatgcagctatatatcataacgaaaggaaagggtgcatatgacaagggtctgcaagggccattgacagaaaactaatcgtcaattgctttcaagtatcctaatgctttcattgattggagaaacttagaacccacattgatttggatactgtctgtcgtccaatggctgaggcatgataccggcattaaccaaccttttaaaatcccactccaaactggcctctgtcttgaaacaccagaaaataaaacctgcgcttttcccgtgtaagaaagcatctagctgggcttctacgtaccttctgtactcacagatacgttcagagctcaatttcgaaggatcctggctattctcacaagatccgatccaaggggagttatcaagttgaccttcatatctcgtgccttttccgacaccatttaaccaaggagtacaatcagtaagtgctgccgaccattcaccacagaggttccagtggtactctttatttgcatctctaccccaatcacaggcggcttctatatgttcatcgatacttctttgcaattcatctgcatcgaagacttgataatggtggtgatcaagcaccacgttccagtaaccttccgctgaggtgaaatcgtccccccagtactctggcgcctggtaaaatgcatcgtggattacaacaaagttgttcccaacatctctaactagatcataaccatccgcatagaactgtcttagattatccatgtctaaaataggtcccaatggttcgtttaagagttgaataccaatgaccacatcgtagtagtccgtggttccatatttttttgaaatatatttcagaacatccaaagttacttgaacgttgttaccattttggaaatcccaactgtctcgcttaccggagttgtcaaagccgttctgagatcctggagctccatgaaggtcaatccaaactttcagtccatgctttctactccactccaaagccttgtcaagatactcttcctggccttgaacataaggatcatcatccagcaattggaaggcccagtagccaattggtatacgaacaaagttaagtccgtaagctgcgatgtcttgaaaatctttttcgtcgtagaacgttgaccaatgctgttgaagtctatccaaagccagcgatttacctagtcgttcagtgtaacgatattcatctactggtacatcatcgccgaaagcttcaaaaagcgaaggggtgatatagggctccaaaaccagccatccaccgaggttgacacccatgattttttcactggagtaatcccagattatatctctctttgggagagtaattgcgctgcatagactggcgaatagtaatgtaattaggtacaagttcatccccgttgtgcaataaagctaaggaagcagtagagaagtctggaaaaggttacacgataagatgatccgctcctgcttcaatttaaaaaaaaagctgattgatgccacacgctacagccaggcacgtcgtatgaaagtttcatggcggtatatgcaaagaacgggcaacccgtgtagcataatctgttgttattagttcccattaataagttgtcgtgacaacgtgggtgtttagggagatccaacaattggcagatgatgcaggaagtatacacaaaatagttctcagaacgttagcgatctctctggtaattaaatcaatgtgtggttgcataaatctgaggtattttaggttatgacgccgttttgtcagatgagatatttttaggtctacacagtaattacgtgcataatcacatgccaggtcacatgggaatttcaggtggtctagaaattggctatctcacttaacctttgtaggccaagagggactgagagttcaaagacgacagcaatctgcgttgaaattgtgctacgatcttatcaggaggtaaatgatagtaagaggagaaaatgcccagctttgtgccgaaaaagtaggagtagttattaatagatttaggcttgacaggttttccgacttcaagttttcaagccatcttgctagatttgtcctcacttgtcccagttgaagaggagtgagtggcctttttttagactgcacctgtttcgggtttgcaagtgttctttcaacgtagtacggatgccgtattagagtgaaatatgacgagagtaagcaaggaagttttcttggcctagttgtagttcgctagttgttattagttgtcatgacaattcaaacatttttcaattgcaactattcttctgtgcatctgtttccactagcagtttgacatggtaggtgggccaattattagtaactatgtcttcctgcatggcaaagcaaacgtgcgacgatgatcatacacatttagtatgggaatggaggcagtgaggaggcagtgaggagactgattagaccaaagagggcaagaagataaacggaaaaagaaaaaagaaagtgcaaagcgcctggaattctcattcgtgtttcttgatggtatcgagtcttatggttacaattggaaatgtctaacagattgccaaagtatatcgtcaaaatgaggagtcctgatgccttcaaatggaattagtaactgaaattagcgagtccaccagcagcattgctgttcacaacagccgtagttttgttctttttctgctagatgatgagtcggcccgacatttgatctggccaatcttggtctcatcgaagcatgaaaatatcgaagatgaaccttcgctgaacaccaacctgatcaggattctgctaagtgtggaggatttctgatagagacaatgtcaacttgaaatgaaagagcgctctgtagttgatacgctacactgtagccgacccaatgctatcttgatatgaggcgattctagtactacgatgagaagcgcaagaaactcaaacagccgatcagcactatccctttcatgcatgaatcagttgacatctgaagattgttttgaccgtggatattgatcaaataatatagcaagtcacgatcaagcttgtagcatagcattgagcaataaggtgaactttcctagggactttagttcttttccaaaactctttccgcgtaatctgaaaacggatcactcctgtgaatccatggtactattgtcaaacataatatagcaggaagagcgtaatgttgtttcaaagccgcactgtagtgtctggattgatcaccatcaacgctcacgtaatcaaaaaattactggtcacgtggatagtcaatcgcttgaaggacatcatctcaagattttcctccttaactagcaatccttggatatcatggctaagagatccaagaaccagcaaaggcgattacgtgccaaactaagaaaaactaagggggtgcctgatcaggaaaatggattttcagttaagaaaagtgacagctccgaacctattcctgtttccgatgacaatgatgaagtaaccatagcacaacctgacactggtggactggaggggccacttgctcaggagtttcaaaacatatttgcaaagtttgttccagttgaagagaaattgaactttgagcccacccccttggaatccagaaaggaagagattatatatagtagttcttcagaggacgaagctgactctgataaagaacgaacccaaacacagacacatctatcaaaaaaggaaaagaaaagactttacgggatatctttaacggagttgaaaaagtacgctgctagacctgatctggtcgaatggtatgatgccgacgctgaagatccaactttaaacgtctacttgaaatgtttattgcgtgcagtcaaagttcctgtccattggcaatccaagagagattacctatcttctaagaggggctttgaaaaacctccttttagattgccagatttcattcgtgacactggtatcatggaaatgagagatgtatctcaggaagatgaatctactctcaaacaaagaactagagacaaagttcagcctaagatgggcaagttagacattgactttcaacggttacatgatgcatttacgaaatttcaaactaaacctccgatgctggctttcggggatgtttattacgaaggaaggggctctgaaacttttgaactcgaaaatttcgtccctggtaaagtttcttctcgactaagaactgctttaggaatagctaatcatgagaagcctccatgggtcgctcaaatggctaaactaggaccaccgccgtcttatcctaatatggacgcagatggtgttttcaaagagccattaatgaagaatttaggacccccaattgagagagattcctggggtagcatacatccggacagtgaggaggaggaggataatgacgaggaagaggaagaggaagaggaggaggaggaacaatttattccaagatacgacaaagaatccactgactacattcccatcaaatctgttagtaacgaaattccaacaatgagacacgacacgacaaacgaaacggaagacgattccacaaacgctccactttatcaagttctgtctcagaaaaaggaatcaggaggattcatgggtgaaaagataaactacgaacttccatcatcaaaacggtagagtaaaccatatcccatcaactagcaggtgccccacacatatagcatagcgtaaaaagaattcttttgcacataccccaccaattaaaataaactcatctctgatagaaagagtaagatccgtcttttgcttcagcagttttattaaggtgtaattatatataataaatttatagatcatggctataagattaaattcttattggcttctgctaaggcacataatgtggtataaccatcagttacaattaaaaaataattttataaagatgaagctcccgagttagagtttgagtatgattagttatactttgaatttttcataatctttttcttcaagtagcacgttgcataacatatttttaatggctcctatgaccattcaacttctattttccaatccatggctttatttatgcactttagtaagtcttattattctcaatgtatacataggtgccatcgtttaagtgattttaatttaattcattgatatatgactcttattatcttcagcttttgaatattcaaatattcatttcttattttattttgtcctgattgagtatatacccttacttctttcttttcattgtaattttcaggtgattttctcggatctacttgatcttctgtactagaattacatatctctataattgatatcgcacattccatccaaaattttccatatagtttccacggctcaccatagaaagacatgttatttgctttaaaaattacatcaccgttctctcttataacaaattacaatgggaaaagaggcagttctatatggcatagatgcaatttgatctcttcttcattttctactttgataatacaatttatagttggtgttttcttctagttctgaacaatgaaattcaattatgtctggtatactaattcattagaaaagctgggtacatattctcttcttttagcttttattctctggagatctgttttctggtttactatccatatagttgttcgacttacgtaagtcaggctcgatgatagtagtgcatcgcaaattgaacgtgcgctacccaaaaccccaactccaatcacaggccaacaatttgggcagtaatcaataaaaaaccaataccaaccttttgttcagagttagatccgagtatctggagaagaagaatacaaaagatagatagaccatcacttttcattctatttcggattctctaattggtttgtttatttcttaacgagaatgctttcagtgaaaagatcaataagtagaattccaacagcccgtctcttcagcactactaggagacagttgaaggaggtcgaattgacagtcgacggtgtaaaggtatccatagaagccggttcttccattattcaggcagcagagaaggctggtgtcaccattccaaggtactgctaccatgaaaagttggctgtagcaggtaactgtcgtatgtgtttggttgaaattgagagatcccccaaattggcagcttcttgtgccatgcccgttcagaatggtatgagtgtcttgactaacactcctaagatcaaaaaggccagagagggtgttactgagatgttactggagaaccaccccttggattgtcctgtgtgtgaccaaggtggtgagtgtgatttacaagaacagtccttgagatatggtagtgatcgtggccgtttccatgaaattgttggaaaaagggccgttgagaataaggccattggtcctctgatcaagacctccatgaaccgttgtatccattgtacaagatgtgttagattcctgaacgatgtcgccggtgctcctgagtttggaactgcaggacgtggaaatgacatgcaaattggtacctatgtcgagagaaacgtcaactctgagttgtctgctaacgtcattgacctgtgtcccgtgggtgcattgacttccaagccatatgctttcagagcaagaccttgggagctgaagagaactgaaacaattgatgttcacgatgctctgggttccaatgttcgtgtagacactagaggtattgaggttatgagagttctgccacgattgaatgatgagattaatgaagaatggatcagtgacaaaaccagattcgcctgtgacggtctgaagactcaacgtctgactaaaccattgatcagacaaggaaacacatttgtggacgctacttgggaggaggctttggccaccatcgctgaaggtttccagaaggttcaaccaaaggagaacgagattaaggcaatcgttggttccctgacagatctagaatctattgtagctctgaaagacttggtcaacaaattgggctcagaaaatgtttctactgatggagatgcaacaactgttcctccagcccatggagccgactttagatctaactatatcttcaattcaactattgacaacattgaagaggctgaccagatattattggtcggtactaatccaagacatgaagccgcagtgttaaatgcaaggatcagaaaggtgtggctacgttcagaccttgaagtccaccacgttggtgaggaatttgactccacttttgagttgaaccaccttggtagcgatgtcaatgccttggctaaggcccttaccggtgaagttggaaagaaattatctgaagcttccaagcctttgatcatcattggatctggggttacagaaactcaagatgccgaggctgtatatgcaactgtggccaaatttgtcacttccaatgcaaacatcgtcactccagaatggaatggattcaatttgttgcaccgtgaagcttctcgcgtcggtgctttggatgttggattcaccactcaatccccagaggttgccaacaccaaagccaagtttatctacctactaggtgctgatgaaatcgtcaacaaagatatcccaaaggacgcattcgttgtataccagggacaccacggtgacttgggagcttccttcgccgatgttatcctaccaggctctgcttacaccgaaaagactgctacatacgtcaacacagaaggccgagtccagtcgactagagccgccacgaaccctcctggtgttgctagagaagattggatgatcattagagctctcagtgaatacttgggagccactttgccctatgataacctatacgaaatgagatccagattggctgatgttgctcctcacctcttacgtcacgaggttgtagagccagtgtcagagggcatcgctaaggttggattccaatctctggttaaacccggaattcaatccaaaggagttttactcaagaacccgatcgagaacttctacttcacggatgtcatctccaaatcttctcctacaatggccaagtgtgtgggttagctttggttccaagatcgaaaagatcaaggacgagaaagccaacagctatctatcatttgcttaacgataatcaagacaagaaaggaaaaaagagaaccactagaacgccgcctacgaaagcagaatactttcacatcatagtatagatccatctgtttgcatatatacacaggagaacaacaaaaggagaaaggcctttcctaatgggtctaatctatttatttatttatttatttagttgtggtttttacttggtcgtatgaccgaatgaataggccgagcaaataaacacgcctgttcctcccagcctctacacaggtaattgtaggaaaattagacacctatatctttatcaagtatattctgagatatcctggagcatattacagtagttgcaacatgtgtcacactttctactttaaatattcgtagtagcaaagagccgtacttactcctcttagacggtagaaaatcgaggatagaaggtatgttgctaacgctagcgatgaaaattgttccaacaattatcatcatcttgaggactagaactacctgttttaggaaatttcaggttccctaaacagactaaaaacatctatctgctcacttaatcctcgcattgcttctagctagccattcctctctattcgcgcgtaattgttatttttccgcgtgttcctcgtttcttttgatttcttacactgacttatttttacccaaaaacattatcacccaactttagccatctccagtgctccacatcgtgttccattcgtttcacctaggtaatttcaccttttcattcgctttaaagtactggccagaactattattggtacggtaatgatcattacgcagaatcttgtttcttattcgggttcaagtctcaatcacgatgggaagggcaactctagaattttgctcagctctaccaactttcagcatagaactcctagtgagccactaaatggcactgcctataatcatgagtccgactttgtcgtcagaaaaacacgttcaaattcaagttcccattcgaatgtcagcttccatggctacaatctgcgaagtttacttccatatgtcaactttaaactttgcggaatgtgcttcctttggtattctagttctgttgtcagcaataacagcacaaagcagatattgagacagttttcttatcctgtgactctcaccgaatttcagtttttactgaatgcatttttttgcttggtaacgattatcgctgtcaaccaacatgactccagagtatacaaaacctcctccaagatgtcgaaacgatttcccccggggacattcccaaaagacatcgattctgcattcttcaccctgaaagactcatttcttacaatcaagcggaatattttatcaacaactatacccatgggcatgttccaattcttaggccatatcaccggtcataaagcaacgtccatcattccagtatctttggttcatacaatcaaggcactttctccaattgtcacggtcttcgcctaccgcttgatatttcacaaacactatcctatcaaaacatatttaacattaatcccattagtgtccggggtcatgctcagttgtttaaaaaacaacctttcaataaacaacgatctgttcttccaaggatgtctatttgcatttctctccatgttgatcttcgtctcccagaacatatttgctaaaaaagcccttactttcaaagaaaaccagttaaacggagatgtcgactccaaattgaaaggtgacgatgacactatcctaccgcaatacaagaattcggaaaataacaaagcagagaagtttgacaagttaaccatcttgttttattgttccatcataggcttttcattaacgttgccgttatacgtgattctggaatctaacgttttcgtccaacaaaaaaccctttccttactccaattaacacctggcctactgtttttgttaatcctgaacggttttgctcatttttgtcagtcactggtggcatttcaaatactaggcatgattagtcctattaattattctatcgcaaacatcatgaaaagaatcaccatcattggattttctattttctgggaggctacaaaactgaacaacgtgcagtggtgcggattagttctcacaattatcggattatatagttacgataaatggggtgcagtcaaaaactagccctggaataatattattgattaccttagatcggataaaggatccggtaaataatccctgatgtcattgccagtcttgtctatgaatctatctccgctgccattaatttcgacttccctctgtgcgaccttatccatcaacctgaggaagttagattgtttgaatttatgctcagtgttctgcgaaacagtagtgtccacgttgttcatttggttgaagacctgctgggcaatctctgcaaacttggtagtctctatatcattattgtcatcttccttctgtagctccttttgttgctctacttgttctgagtcggagaacatatccataccgtcaatttcattctgaactgtttcgaattgtctctcaaatgcaaggtttgtcatgtagtgactttggtcccccagttgcgtctgattatgagtaaagttctgattatgctgctgagagtgctgatttaccatactaaatacttctcttgcaggcgcattaacaagtctctgggtttcccgaattctcatttcatattccatttctttgttatgttgcatatggttgaactcttgagtccaagcatttgcagttgaagacattgcttgcatgttagttctctgatccatggtctggaagctttgctcctgttccatacggacgttctctaggttcattgcgccaaaatcttcaacccatttgttattctcctgttgttgcctaaactctgaactccaattatcgccaaatctggtattcttcctaattagctcagcagaagggaaataattcctttgaacagatgtgttttgaaactggccaaattccgctcctgcggtggtgttaaaagatgactcggctctaaaggctctattctggctactattttgatccctaaatcttgctacgtggtcattttccaaagtacggtcctgcccgactctcttgctgagattatctagcgctgtggcagggccacaactgccattagaagtaaacattcaaacacttaattagggaagaaaaaactgtaagggatgatcggtcattaaattacatatggagacatcttcaagtgtctggggtaaattattgattcggtacactatatgcatgtggcttcttttttacatcacatcatatcatagtagatgcgcctagtaaccatcgtgttcctgcactagtttatcagtgcacttgtacaactgaatatgagagtcttgggtgtgtgacgtggccaccatcattctatgcggatgaagcatcatggaagaaacgtagccagcagtcttattggataaatatggcgagggatctctgatagttgaaacatgttcacctgtggtggtagcgacattaactatcttggaagcggtcaggatcactggagcatgctcatggattaaggaagcagtgatagatctatgaggaaatgactcgattggtttatctagtcgaatgtcccaaagattgaccatattattggatgcactcatgagctctcgatgtccacctctttgcatatgaacgtttttaatcattcctcttgattccctgttttgccaaatcttaaccattgaatctctagagtccagtcttcgatcgtagacacgaatagttccgtcaccaaatcctccaacgaaaatatttccagcaacttggtcggatgtcagagaggttatggaactcgtagacctggcagggatgtcgaccacgcatagctcacgaggagcatcccaaatcctaataatcttgacgtcaccactgactaacaatgatccagtggattgttgccattcagaaaccaatcctgtggttcgagaggtaagcagaagatcggttaatgccctccaagcagtggccaacctgatatcctccatagattggaaatttttgtagattctgactacaccatcagaagaccctgtcaacagcattgcgttatcatcttcattaataaacttcatgtcagtgatcttagtaccaaatgggttgttattagaaaacctggataattgttcattggtttcccagttgaaacatgtaatattgtctttctcatcagcagatacaagatagctatcaaattgtgtaaattttaacagttttggctgagtggtattgttgaatgtagcaatattgttgttccaatcccctgaaatagccaaatccttttgtggttgtgtttcattaataattgactcgttccggttccttctccaaagtctcctggtgtactcaaaacttcctggttcatccacatcattcacaccaatttgaggctcttgaaagtattccatgctgtactcaaagaatttactatgtaagggcattgttggttcgctgattggactcaattgtttcaaaggaacaaacctaggtgtaggaggaatgggctcgataccatatccgagatacaaatgtgaaagatccactggggccaactgagagtcatgatcttggatatttctgttgctagcaccagaaaagtttcgcagccaatttaatgcgagattactcatcctatcagtaagtgaactggttgagacgttggagacagatctttgattatgtccattttgttggtttccttcaaataatggtgttatggtcgtagaattcttatttgaagtaatttttagtgattgagaccggctgcctgtctttgaatggctaggatctctcgtcttatggattttaagttggtttccattggataccatccccaatccatgcaagctggcttgatctgatttcaactgggtcgtgtcattggttgaacttcgttgtagtaaatattgttccatatcacagacaatctcaccaaggggactttgattcaatttgatcataataaaatctaccaaactctgcgcataatcttttactccatcgtcaggatcagaactcataatcagtagcgttttgaatacagaactgtagatggttccatagttaatacttcttctcctaacttcgtcaatcatgctgggatcatcaattagagttatttcctcctctaattgaccacatgcactaacaatgaaaaaatggatatacttcataacgaacttggaaaaaaagacgacaacttcccgacgaacaatgggagatccatccgccaataggaaaagcattgacaatgcaacttttacctcttgctggttcgactcttctttacccatcatcattgtggacggttcttcatcatcagatagcgttgtcagaaagttggtcaacgaaattacaatggaagctctgacctcaggaatcggatcgttcaacagtttagttaaacgctcaacatgtccatctttataagaaatccatcgtccatcgggataattggcccataactggcctgtaaaaagtgcacaccattgtctaagtagaggatgtcctgatttttcaaggtaatacaaacatgtaccaacaaggtctgagctgaagcaaagccgctgaccaggtttgtactccttcacaaaaagggaaagaatgaatgcagacatcgctttatgctcttcatagttgacgtcattgaccaaaaagtggtttccactagcagcagtcgtaggtttgggagccaccagaatttggataaaataattgtatcctttatctttgcataattcctgctgagtattcttatgatcaattgacattatcctggcccaaataaaagttagaaccggcttaagttcctgtgctggactctgcaaaagctttaaaatgtaagggaaaataccaatagacagggccaaataaactgcccatggacctagatccaagaatcttgaaagtaaaattaaagctctcaatctgtgaacttgtgatagcaatacctgtaaaacaattggcagctgatctgggggatctttggaacttgaaccatatttcaaccaaatctcaaaagcagtcaagtgatgttcaaagaatgtggaatgctggtaattattaattatttgaccttgtgattgacttggtgctggagctggaggcttttggggggtctgatttccatcttgagagtctgataatgatgtagtagtagatacgggtgtgggagcaacagaattgggctctgttctcaataatgtgttagctgaagcagtaggatctcgagataatttttcatgattcttcaccaattgagacaagacttgatcgatagcgagatcccaagagtcccacattgtatgatcagtgatatccggtaatggaggatctgagatgggattacaaccatttgctgtcataattttctttgcaaggagaaaatttctaaacaatgcagcaaccatcaagtcttgccggaaaagtttcttgaacacagctcttggaagactggaccatgcaatcgtatcagttatggctgtgaaaatccaatttaattctcccagtggggtccttctatccgtgagtttaccaggaatctgtatctgtccattctgatccaacaaaaggtcataatagccatgaaatttcaaaggggactgtaggagaaaccattttacactgatctcgattgggcatgttaagcaacacgtaaacaaatctgctggaaggtctggattcatgggcagaatctcgctggacttacacgcagctagctggatacaatcaatgtaggcagcagtgggtgaaggagcactgatatcatggtttccgtcattatcgtcgtcgattcttttctgaacaaatttcttgaagttggtcactatgtttccagcggaagaacaatcgtacacaaagatgcaaggagctccaagccatgtctgcaaatcgtacaatgaaataggaatatactgagtgtatcctctgttaaacacccaaatttctccactctgcgtaggttgtgggactccgtggccattgtaatgaaataagatacgctcatctttggcagtctttcttagagtgttgcaaaatcgtttcacgtcttcaacacatggatctagagattgcttgtagcgagttctcaaagataaggtctcatactgtgtttgcagcgctctcccaatggattcaatagccttcttattatctgtgaacgacagaggatctacccaagcctctgttttagcagaaggttgagtcttgaggatatcaggagggtcaactccaatgttcagacataacacaatagctgcactaacagtcttctgtcggtctttcatgatcttccaatcgacaatgggttggtattttttgtaatttttttccttctcttcttctgtagttgggtttcccgccgtctcatgcctcttgtcgtcataatagatgtagaaagtattggccaacatgtccatgtactgctgagatgtgtactcatcttgaaatccatgccgcattgttccaatttttctaaatataggccaatgaaataaccggctactgtcagaatgaagctattactggtgaaaataccctgtaaagtgctagttgacagagtagctgggccagattgttcaacgagtgagtgaggtttatcaggaaatatcagaagaatcggtgaccgaatgaggatattatttcccaatttgtgtaaggtacgctttttttttttaccaagaccaagtaatttacttcagtatacatatgaatactataatgtctttaaagagagctagggaacctcttatgaaagtctatttgtaaatctgtcagttctttatccgtaatctcatcaaactcatcccaaacatcgctattgttctggactttttttgatttagatagatttaaagaggtcgttagatgttctggcttcttgggttttggaggtggtttcttgtggtggtgctggccattatcagcctcagatttcttgctggaagaatatgggactgcagttttcactggatccacaacagaatacttttgaggaactattcttggaggtgtcttcgctttctctaacgatttggagacattccgtatgatgttatcagccctactggcattgttgtttttcctttctgcttccgtatacttcccatacccttcagctgtatgaggtgctgggtcctctggtttattgaggagcattttaatacgcctttgaatagatgaggatctctttaccttggatttggatgattcttctgtttggagatctaatgactccgagctggtactcctgctagcataatggttctcatgtgttggagttctagatctggaaggtgccactgatgaccacttgtcttgtctctctctatctctcccgcccgtcaataaattcttcaatcctcctatgctactctttttgctgtgacccaagccctcgcctgttaattgtgctctgcgtgatttcaaattttcactcttggagagccccctcaagaaatccacgttactgtcaatgtgattcttatttcccggagatagttctattgtttgctcttttgctacactgtcgataatcttgttcgcagcttccaatgaaggtcgtttctcttgatctagaatctttggacttgaaaaatcatcagatgcatataagctgacgggtcttaaagtcctacgaggtggaagagatggaaccgactcagatgacgatgatgatgatgacgatgatgatggtcccgaaaacttagatgcttgggaaccgatacttttgtgtttattgtgatgatgttgatgggacttcaaactagcctccgaattgctgataaaacggctcttatccaacttggcaaatggatccttatctcttttctcagaagaagtcctcgaagatgttgtagatattggagcattttggacgttcgtagttaagttgagaactttggaaacgttaacatcaggttgagaaatgcgtttcctctgtttgtaaaagttctctataggaacaggaacatttctcatcttgcatatttcttctaagagatggtaaatatgtggtctcttttgaggatcagaaactaatagcttgctgatgacattctttaatctgggagaaaatggaggtctgtctggaaactgaaacgacccatttacaatagccatctcttcagccttataatttggagtgtgatcaggattgaacctttcaaaaggcgtacagtagtagcaaagtttgtacaaaaaaattccaagagcccacatatcggccttttcgtttataggatggcctctgtaaaggtcgagcatctctggggatctatactgtggggtcgtatgcctcaaaatatcatcttgtaatattttgaactcttcgatattttttggagggcgtagaggagatgatgctgaaccaaagtcacagagcttatacgtccagtcgctggaaatcagtacattttcaatcttgatgtctcgatgcactaaagggggctgtaaagaatgcattatagcaattccctcggaaacgtccgacattatcttcaatacttcatcctctttcagcttgttgtgtaaccgcgtattcatgaagtcaattagcgtaccattagcacagtattccatcaacacaaacacctcatatccaactccattatccattctagatgcatgtgaatcaatgtaagatacaataaacttgtgtcccttcagtcttctcattgcgtcaacctcagccctcaatatgttcaactgggctttatctggtacagagactctctttaaacatgcaatcgagctaccctcaaacggagggctgcattctactgtatacacatgtgaaaatcctcctataacaaatgttagtaaagacagacttttaatggaaattgctgatgaacttacctgctgaaatatacttgatgacagtgacactatgggttcctactgtcagtggagtccccggcggcagcttggcattgggtggggtaatagagggattggaggccataatactatcgtattcaaaactgcgtcggtgcaagcaagtcgttgctcttctataagctaaggaactgcctggtatgttaagggttcgttgacaaagccaagatctagtgtcgtgcgccccgaaaccagcgaagatccctttgattatgtcagcatggtattgttcatattatccgtctcgacagaaggaggaaaagatatctagcgaggatccgtccaattggttagttaggtgacaaagattcaactgaaatgaagagttttagagcagcggtaagtttggcaaaagattttttaaatgagaggctgtgtttactaacaacttgtttagctgggtgtgtctggtttatcgttgggggccttcttttgggggactaatagtagcgtcattttgaacgagtcgaaacgtcaattctatcaggacgatgcttccgtggttcccattcctggaaccattgttccggcagctggtactgagattgaagctttaggtaagaataagattgtcaatgggatatctattcgatcccctagcccgttggaagccactttctcctcggtcagaaaaaccataaacgatgtgtataaacaagctgaggacaaattttacaatgtctccactaaatactatgaaactgagtccaaagtagcctcgcaagtggcccaattacatgaaaaaagagaagatcttttaccaaatggaatttatgttatcgttggcaccttggcaggatccatttttgccagaaggaggaacattctactcagagctattactccggtggcatttggtttggtcacattcaaaatattccttccggaaacttttgggaacaccgtcggatttgcttggaaactggagcaggaaaaaatcccaaaagtcgccgaaacgcaacgaaatgtcgtttccaaggcagaagagctctacaaagacgtggagtctacaaccgaatcgtcgcgtgctgccgcccaatcattgctccacaagagcagagactatgtttcacaggtgaccggtctgaatctagatcaaaaggtcatcaatggcgatgctacgactacgaaaaacaggtaggaagaaatgtatgacatgtttaaagttgtattgaattctaagaagtgaggcgggggaagccgcaatatgaaatttttaatctttgcaaacaacactaaactatgttgtaacctctattgtgttagcccaatgaatatagatggacagcattcattttgtggtcttttaccattttctatagttcgttatcaatatgcaaaatgaatcgtaagtgggtttctatgtagaaggaaaaatagttttcttactgacccgagagaaatagaccaggtttccatgaggacaaagttagatcaatgtctattcctgggactgtatcaggctcaagatcaagtccggcaactggaactggaacgggaatgaaccagctcttatccttggcgtcttcttcgcaagtgaactcccttcaagatctttgtagtgcttccaacggttctgcttacacagtcattaacaacccggtatccttgaacaatccgtctcttggtaggttgttggagtatttgggtgggaatgctccttcctcatcaaactcagttaaagcgaagctaagcaaagtactcaaaacaaagaaaaggaaattcagagcgaagcggagcttattaaggagctgaatagctggataaatgttcttccaaataaagaaagtgcaaagctgatctttgagtatgccagatcgttggaagttatggtaaagctccaagaagaaatgcttcaaaagtatgaaaacatttcccttcaactcggctatgtcgacaaaagagagaggaaggccaacgccctgaaagcacagagaaagaaagaactccgttccttgagacagaaggaaagtcgaaccaccgaaaaccaaacaattatcttttatagagaatcgattgagtgtttgaatacttccattgaagtggttcaagagcagtatgttcgaacaatcaacaatgctctgaaaggtagtttcatcgactttcatatattcttgcggaacatgtcaactgaaatcaaaaatagttccattggctttttcaagttcctcaacgatggttcttccaggaactaccagagatatatcacagctaatgatatgaaaccagcattacgcatggcatccacctcttcgtctatcgttcaaggtgagaaaacagtgtcacctaatccttctcctttgcaccataatttggaaatcaaaagaaactccaacaacaacccaacattactaactcttcagaataactctgtagagaatattctcaaagacccattagttgagaggcctcaagcaagagcagtatccagcatataccataatcttgtaccggatcttagaaagctgagccataatagagaaaaacgaaaagtccctgagtccaaagattcagtttcaaatgacaaccattggctataatggatggttaaattttctgtgtatgtatttgtttttgatgagtgtgaaattatcactctatgaacaggctctataatttttgattaagaaacaacgtttttgacatttcgtaagtggagatcataatggcacatgagggtgccaccttcaagcatctggggaaaagtccgacgtatagggctctcactccttcggcttttactatggagtagagaaactgaaacattgatttctctggctttctaacattgagagacgaaacactttcctctgaaatctgtagtctagttttccctacatcgaaaggattagtgattacagcagctattactccagatatggaaccacttaggaaagatcttgcaaaaactccgagatccaatcctttgtgctgtctcaaagcatcatcgtcgtttagacttggcaaattccaaaaatttgctcttttggagaaaaattcatacgatgcccaatagattccactaaacggaacatctctccacagcgttaactggagtccagtgaagaggcttcgcagtcctctagaactcatttcctcaccggatctttttagaactttccaaaacaattttcgattagcattaatatgtgtggggttatttttcagtgatgaagggattgattgcaatctagttttgagtaattccaatggagcaacacaagtggctgctaacactctggctacagaaccacaaatcaggggattcaatgttgggcttgaagttcgaaacggagatcgatctctcaagtactcataaccactgaagtagacaatattagcagggactcccatcaaaagggtaaaactaagcccacggtaaagagaagcaaagccttcgttccgaattatcttggacaacccctctgatgtactttcaaacttgacatcttgagagcaagagtgagagacgcagaattcgttgattgcaacgctcctcgcttcctccttcactgtatctaaccagaacacttttctacaacactcgcccgcattcgtaacggcgggtggcgttataagatattgctgctgctgccttattctgaccacatcaaatggagtaacaaccagagaagtaagtaccgacccgacacaggcgctcagcatcctttgattcaaactgatgtcattgctggcgaccacggagttagttactaggccttcctttcctgctttgaaccttgtattaaggtccacttcgtattcctccacggtaccggcaatctcagaagccatagacatgataggaagggtctgatggttaacagggattcagttgaagatctagtaagtttaaaggggaagatggtaccaatccccaggggaaaaaaatatgtagcgcgaagacggaagacaaatgcaggacgtcggatggaagataatatgaataatgtatctaactatttattaactttgcctgtacctttcaagaaacttgttcttattcttttcataattggtatatccgtcgtcaatggcctcttgtggtgacaatggttcttcatcgtcaaaatggcccataaattgtgattgtcgaggagacggagtattattgaaggtttggtgtttcttaggaggagtgtcaaaaggggaaggttctccaaaagctatgctgtttttctgctgttgagctgaactcttattggttgtatttgtgacaacagatgtgtcatccgcttggttgagggtgctatgactagagaaggctgtgatattctcggacaaatcatgctcaggttctatcacagacactaccgagtcccgctgatattcacttaatgctgtcttataacttacaatatcactggattcagattgtgtgtagttgtttttggaataaaatgctttcgtcttcaactccgtcttattgggcgaaaccggtcttttgagagattcatcggatttgttcctggcagagtaatcactaagaggtttactctgtctatttgtatgattaacagttgacttgtcaggttcaatatccaaaggtttccctatttctactttgggctccgtttcagtctgtaccttgggtgattgtggaaaattgcctctagtatatcggtggttgttctggttaatggcttctggcgtcaaactggcaactcgctgagcagtcgatggaaagccagacgaatcattcctatgcaaacgtctgacataatccacagctacagacgacactgaattgctgttggtgctaccattctcatttccattggcagctataccagttgacggggatactccatttggtccggttagtttctcgttggaatgtgagtgaagccttccgtgcttcaagaagcttagtccagattccgtcttctcactgctttttacactgacggactctgggttgacgtttggaggcaacattggtaccaccgtatcgtagtaatctaggtaattatttcctgatctgactcttgaatgatcttgctctaacccggagaattctgaatttgtacgagaagagggcaaaaagtctggtcttctgtactgattctcatctagcctcgttttcgaatcaactggattgcctagttccttggcttggctattttctggggagtctgttggcgcaccataaaaagacacatcgtcatgatcaacgtcaatttcgtccttcacttccttcttgaacttacgagaagcccgaatagatagtgccacgcataccacaatagccatgaggcagggcacaccaaccgccaacccaacagcgagcccagttgtattcaccattgatcgaaggttagggtgataggatgaagtgacaacaattcaaagcttaactacctttcgcgcggatcagttgttgtggctttgaggagaaaactggccaaatataggcggcaatgcgcgcacaaatagattctggacgggagtatatccaattggagtaggaaagaatatgactggctgcatcctgacagtcatcttcttcaccaccatgaaacttgtccgaggcaatgcaactccctcagccgctctgcctcgggcagccaattgctcatgttctggattctccgacgactggctggatgggtagacaggaactcaggaactgaacccattcctcttgctgcaccacttttctcatgctcagccattctctgccacaaccttggagcttcttggggatcataacaagattgggacatcagcattaatccgatgtagtctgcttctgtttccatctcgcgagacgcaggcatctgtacagcagtttgtaagagaatccgattgagagaactggagcctgtaatagtaaaaagaacaagattcagtagagcgtaaaagggcatcttggataagttctcgccagtatgtctggctaactgatgagcgtactcatgggctaaaactgtagccaaaccatcgtcattggcacagataggcaaaatcgagctaataacgaatactttaccgcctggtagaacaaaagcattgggcggttgagtagaatcatgaatgacatgaaccttccagttcatattatcagtggtactacggttagccatgggtttcaaggaagatgtgtcctcagagagttgtgaatcgtgagccacggcagaaccggctttaataattttattcatgatttttttgaccctgatcaccgttggatgattttcaggcagtattttgtctctattttcagcaatcaattgggaatacgactgttcaccaattattgtttcccatttgggattgatccatagtaacctcttacgctttgtgatgggggcctcctctatatgagacaccacaaatatgcctgttccagcaacggctacccccaggtatttcagcttcctcttgttgttccagatgggaactgttgtgttctggaatcgatgataagtggcgaaccgtctaatgtttcttaggaacatttgcgagatgaggcgactactaagcaattgtcaagttgattctgtaataaattaacgtcagcaataacttcagttcagatgtagtaaaataaagtcgtccaattgtcgatctgagaacactactagtccttctcttctcaatgatgccgtatggctggtaaatagtactcctgatcgatctgggataaactaagttcgcgaagtatttttaatcaccctcctctccagatagagttcaacttgaacgacatcactacggttcatggctaaagctgaatttggcactcccaaatatgtggccaatcaaatgaaggctcgtgggcttcaaaaactgcgacactattgtcaggtttgcgaaaaacagtgtagagacgataatggattcaaatgccatgttcagtcagagtcccacactaaaaaggtccagcagctttccttggaaggcggtgataacaagaaaagaggcaagattgctgagttctcgtctcaatttgtgaaggatttcattcatcttttacggagcggccatggcgataagtttgtgggggctaaccggttctatcaagaatatatccaagacaaacagcatattcatatgaatgctacaaggtggtcgtctttgacagtttttgtctcatatttgggtcaagagggactgtgtcgagtaaaacaggacgatgcagaaggtttgatgattgcgtatatagatcgatcagcggcagcagaacgacgccgaaaagaagctcagaaacaaatgcgaaaacacacagatgaagaacttgcaatgaggcagctggaagagaaaattagagctaagagacctcgagaggaagcacccctggttcctctcggtgctaagaatacgggcgaagataaacgagtttcagtttcattgaagcctgccacggaaactacttctgtcaaattgaacatgaaaagttctcacaagaagattgcaaatgtaaagccaataaatgtcttcaaaaggaagaagacagatcaagaagtgggcaatgtccaacttggatagttttctgtagataattttgtcatacagggctggggttaggttaggtcgggtaatagtataataggctctctttttgaactgtattaagctaaccattcttcaccaggcagcttttctgcgttctgcttcggagaattccgcttcttctgtcagcttctctgacaactttctccctccagttttcgcatgtgatgatgtgcaccctatttcttatcgcgactctctcaagccttctcctccacatgaacttatttggagcagtcacagacactctatttgcgcagagagaactactcaagtcccgacaagagccctcagaggtccactcaccttctcgcctcttccaagtggtggaatccgtggcttctgtgctacggaaaattcccttcctgaagcactgtatcggaccacctgtagaaggcgaagagttgataagacaacttctggctcaacagaaagtctccaccagttatgaagagtggtacgaggtttcacaaaagctagacatcctacaaaacctagaaatctggaaatatgaaaaggaattttctttgtacgattaccagctcgtcgaaagacgattggccgaactcagagagaccataaataataaagactacccaaaattactatatctagtgagaactacgtggagtcgcaatttgggtaatatgggaaatgacgttttgtatgcatactctcacgttggtaccaagaaactgattgaggagtatgttgcagagtgtgtcaaagggctgaacatactggcaagtgaagacaatggtttggacgatactcatgtcctgggaacccttatacaaacacgcaaggccattggacgtacggctttggtgctttccggaggaggatgttttggactgatccatattggagtaatggccactttattagaacagaatatgtttcccaaggttatagcaggatcatctgctggagccattctggccagcattctatctgttcagactcccgaggaaactttacaactgctcagcactattgcgactcggaaattcgaaatatttgaggagaacaaccatagggagggcatattggtttgcttatctcgattcttgaagtacggtacatggttcgataactgctatctacagagaacaatgcaaacatttcttggagacctgacgttcaaagagagctacaatcgaactggaagaattttgaacatcacagtttcgcctgcggctgtacatgaacagccaacattgctaaactacctaactgctccaaacgttctactttggtctgcagtgtgtgtctcatgttctttgcctggtgtattcccatcgagtacaattttggaaaaggatccacgcactggtgaaatctctgagtggaataaagcagctactgtcaagtttgtggatggctctgtccacaatgatttaccaatagctcgacttagtgaaatgttcaatgttgaccatattattgcatgccaagtcaatccccatgttgtaccatttcttaaaatggctggtgatggagtcaacactggcaatacattccttcgaaaatcgcttcaaatggttaacaatctagcatccgatgagattacacactatctgacaattgcaggagaacttggtattgcacccaacgtatgtaccaagctgaaatctgtccttgctcaacaatactcgggagacattacgattcttccagacctccgtctcacagagttgaatttattgttgacaaatcctactcctgagtttttgttagatgcctcaataagaggtgcaagagccacctggccccagatatccatgatccaaaaccactgttctgtcgaatttgagttggacagagtgattggccttttacgctcacgtctggttggacgccctgttctcattgaaagaaaccgtcctcgatcccgtactatagcgggaggaagaagaagcgacaccgcaacatcgacagcaattaccacaacaactaacacacggactcctttcggttcagctcatgactcttcattcaccccggtctaccattcaggttacagctattaccttgagacaccagctccagctcctgcccctcctgcctatactcgccgggcatccgcttatgaaagaagaactgctacacagccaccatccccattacaatcacctttaaagtcacgaaacaacagtatggagaacctagttcgtcgtaactcattacgcgagatcaatgcgctactctacagggacaattctcccaagacttctcgcaaacgtatagggggtcccaagaatcataaataaagcgtaatttattcactatctacccatacataagaatgatagcttctgttactgtgctgtaataatattattacttgggaatctggataatctcactcagtttctcttgaaccagtcagaggctccaaagtaagcgacgctagagtcgaaagcccattctccggcatccaagtaccttttgacgagaccttcagcatctttattaccaattttctcaatatttggagttaaacccgttgatctgtgaactccagccaagaaccctgacaggagggccagatctgcaccgaagtgaactacttttccaatcttgaaatcagttagttgacaggtcaaattattaagcaaaaagcctcttcgattttgaacttactactcccatttatacctggtttgttttcttgccctaattatccctcaatagtatcagctatctgtttttgtcttgtgctctcccatccaagttgggattcgcgaagaatggcagcgaattgacagaccccctcttataaagcagacattctttctcctttcctgcccattaaccggctattaaaagaggccatattttggagccccaatagatgatatatgtattttagaagagaacacgtttgagcaccctctcccctcaagatgagagctaggtcttttaggatgtgaaggaacggaaatgtttaatagtctgtccaggtcacattttcaacggtacaccaggaaggacattgtcgaaggcatttcgcatcatcttattgttttttacggtatcttgccgttttatttacgcatcgtgaccatgagatgacatggtttcaccgccagtggtgtacttcgggttggtttggtttttgtttgttttgtttatctctctctttcttgtttatctaggactttagctcgaacccccttgagaatgttgggtatatttggtgtgatatttgcttggttttgtgatatttagttactcgtggtggaccgcatgtttgcgaggtcaagctttcatgtataaattggtgtcatgggtgataccactccccgcctccaattccagacggaaagagtaatcatactgacgaccaaatattctcccattaatgagtgaatgtctggaaggaagacttttctggttgtaacccagtctttactcgcctaaagaatgtctttcttcctagaccttccaactttcactctccactaacgctctggccctgggcgatttatggtggttgattttccttcgcgaagtccacagttttctccttttgctttccgccgccggtaccaccagccagtcctagtcatcgcagttcgttttttttctgcccaataccctaatctacacgccgccttcccaaccttcctagcattcaagatgtctaacagaagagaacggattgcctctcaagacgatcatggtgaggcattcttcgattcccgtgaacctcgacaaggaggtttcagaggtcgtggaggatttcgtaatggaggatcgaagcaggaacaacaaagagagaatcccagacgagatattgaaaatgacgaaagagatttgcttccttcgtttccaaaggctagcaacagggaaaaaaatggaccacgagattttaaaccccaaaacaataagaataagaacagaccaagagaattgcccaagcatccaagtgagaccttcacttcagaacgagagaggacaaattatgctcgggaaaggggtgacggctatggaaaacctcgaggttcaaggtatcaaaacactagaggaggccgtggtcagaattatcccagagctagggatacttataatcagagaggcgataattattccagggaaagtgaatacagagaaagagatgacgactatagtagagaagggtacagaaatcgaagaactgatccaagaaacagagaaagggaactagatccaagagacagggaaagggaaagagaaatagattcaagagatagagaccgagattcaaattacagagggtacccaaaaggcccagaaagggaagccagtttctcacggtactcaaggtacggcggaactcaacttccgtcaggcccaaaagcttcgcttcgagacccgagagatagagacaacggagtcagacggccgaatgagtcgactcgaccagctagaggttctactagaggtcgaggaaattttagaggtagacttccaactggaccaagatctgctggatccagatacgataaccattcggagtctgatgtggatgaagatgtctttcttcataagaaagagcctacacagtttatgtataaccatgaaacagatcagcttatttttgagaggattcaacaagttggtgagggaacatatggtaaggtttataaagccagaaatctgttgactaagaattttgtcgctttgaaaaaactcaggttggagggcgagaaagagggatttccaataacaagtgtgcgggaaattgctcttattcaatcatttgatcacgttaatattgttagtctcactgaaatgatggttgaaaagaattttatctatatgatcttaccatatatgaaccatgacttgtcgggtattctgacacacccaacgctacaattcacggatggacaccggaagaacattttcaagcagcttctgcaaggtatggagtacttacattcaaagcgagtcattcacagagatattaaagcctccaatattttgcttgataacgatggagtattaaaaatcaccgacttcggtttagcaaggaaaatgaaggatctcaataaagacgcacagtctccagattatactaatagagtcataacattatggtatagacctcctgagttgttattaggctccacgtcatatggtagagaagtggatatttggggaattggctgtttgcttttggagttgtttacgagaaaggctatatttcaaggaaacaatgagatcacccaacttcaaagcattttcaacattatgggaactccaacaactgcaagttggcctgatatggataatcttccatggtatgaaatggtgaagccacgaagtcggatagtaagtcaattcgctgataaatacggaactgtactaaaagatccggattgctttcatttggctgttcagcttctatgcatgaatccagcagaccgaatcacagctaaagaagcacttgctcatccatatttcaaatcggatccaagaactgaaccattgacttttctgaaagagttgggcagcgagtggcatgaatatgaatccaaaaaacggagacggaaggaaaaagaagaaaagaggaaagctactgtcagtaaatagatactctaatatactccttccatgattcaactaattttgcattagttggtcaatgttgattgaatattggcaaaatatacaattatgacaatccaaaaaaagaatgccctctgccagaattgaactagcgacctttgcattacaagtgcaacgctctaccactaagctaagggggctcaacttgttggagtgattgaacattagatatctaaggacaactagtattagtgttaatctataagatccatcagatccatcagatccaactctagtcattatataaaatgtgctattggtttgcttgagcttgaactgtaggattttatttttcttatgggttttctcgctccttccaaattagaacttcgataatttttcatgttgtaaacataagaactcgtaaggctttttcaaagagggttctccaattctggtacacatacatttctgttatattcatcttttaggcaatttggcactggctagattaacttactactaccattttaagcccgacagctgtccattttttatagtatatgttaagatggtatcttcccatctacagcatcttgtagcatctatcgctaaatatttttttccaatctttcaacaccatccaagatcatggaaagttcatcagagtgggacaaaagaaggtatgttccccaaaagggcgacccggcgctgcctccacaactagcggattactcaagtaaaacaacggaagaggtcatgaaggatatcaaccggctgcctctgttcatgaccgaattggatgagacagatggggagggaggagagaacgagggcttggaagccttgaaggctttagcctacgagggtgagccagatgaggttgcctcaaacttcaaaaaccagggaaatgactgctacaagtctaaacagtatcaagatgctgtccaatactataccaaggctctagaggttaagtgcgacgatgcggcgattaatgcttctttgtacctgaaccgagctgcctgtaacttggagctgaaaaattatagaagatgcatcaacgattgcaaactggcattgttgttgactcctgataacgtcaaggcttactatagatcggccaaggcgtatttggcattgggtaaactagacgaggcctcagagttggtagactttgccctgaaacaacaggaagagcatgaagttaaacaggacacaaaagcccttgaaatacttggaacacaaataaaacaccagaaggagaagcttgaagaacaggaacgacaacggaacgagagagagaacgccaaaaaggccaaagaggctgcattggccgtggcattaactttgcgaggttacactataattcacaccaaagagccatttggcattttgcaagataagaagatcacccttgaagcggaaaccgatgtggagagtcaaatgatattccctggaatggtcctgtaccctaccctagacgaatgggactttgtagagcaaattagtgagttgaacacaccaaaggagattattggaatgctaatggaccgcccaccggaatattttgcacagcctggccatggaaacttccagccaaagaatctgcaggcgtacatgcagactcagggcggagggttggttaaggttggaaagaacctgagttttaaggagatcttgagctccaaacaaccaatcatccctctaatggacaactctttgcggatttacgtagtgcccaagcaggacggggactttttgtcccagtggaataagactaaagcgcttagtgaaagaatgtgaagttgatacagttcactttttttttttttttgaaatatgcgcaaggtgcaggatttcgcagataccagaaaccagaaggagctgattactctcgaacacgactatcttattgtatgtaggacagttctcaagtctaatattaccttttccctgtatcaaccttgcccgaaccacaaaacgttaaccgtctcctatcagaagacccggctttcttttttcacacactagacacccatttcccgtctgatgaaccctagcgaggctctttaattttgtttacatcaataccacaacttactagggggaaattacacaatgacaggatcagcatcgtctggacagcgcaattggtttcagaaacttctgaaaaagaacaggacgtccacctccaggcctgaatcggttatcagttctcgtgatataatgcactacattcaggagcacgaggccatcatcgacccggattgcattttatctattgaacctgagcactgccccgaaatatcgaacgatgctgttgaagattacgaggagtcgcccgaaccagaggtacagggagacgtgctgagcaattgtagatgttgtgggacgatattgaagtatcccacttttgtgaagagaatcaagtgtactatttgtgacacaattactatcgtggaaaatggcgacccaaagaatgcagatcgcaatggcttgaatagcgattcaggtcaaacccaactcctaagtttagagtatttggaagaattcatccagaataattcttcaccaaaggcattgggggtcatgttatacgaatcttttagttcttttagagtactgaacaattcatttcgagttcccaattatcggttatcgcatcgcactccagggttagattttccccagataaagcgtttctacaagagaatactcaaattgccttccatcaactcttactacaagatgctactaggtatgtcagatctcctgaagagatctccagagttagaagaaccacagaatatactctggttgttaattattcttgaattgcccaccttccagcatgttttgattcataaagcaaacatcccagaacttaggtccgtccaatatgatattctgaaaaggacaattgggttgattgcaaacttgaacaagaccccacttcagtatctctgcaactggttgcaccgttctccagaatttttaattaaagtggatttaatcaacttatacatcacctttcacgttacgaaatgcataaactatcaactcaaacctacgaacactacagacacagcaactcattcagaagatgagaatgtcaactacaaggacacactattcaaagatatgaatgccacatctcccgcccaggccctagatgctctgccacaaaacgcaactatgaataggcaagatgagtttacctcaaaaataggattgagtcaatatggcaacaactggcatatcagaactggtgcccgggctttatctatatttttcaccgccaatagccacaatggcaagtttaaagtaccagtatccaatttttataacacattggtcgattacgtcaatatcaaggaggactttgatgcttggcaactcaacaacaggaaaatgtctaacggggcgtcttccactggggactccgttcaatctgtgattgactacttacaaaataacacgatatcagcatactatggaatattatcgaacgacccaacccaaatgagaaaattgtcatttaccttttgtcagttcccatttttgatttctctgggctcaaagatctcaatccttgaacatgaagccaaaagaaagatggaaagaaaagcagaagaagctttcataaactctctgaatcagaaacagccatttgggatttatttcaaagtccgagttcgaagagggctaattgctaacgattccttgaaatgtatcaagaaccatacgaacgaccttcaaaagtctctcaaagttgaatttgtagacgaacctggcgttgacgccggtggacttaaaaaagaatggtttgttctacttactagagaactttttcacccgaacaaagggttattctcatatgatgaaacatcgaaattggcctggtttaccatatccaacattgaccacgaagaattatattacttggtcggagttgttttgggattggctatctataactccaccatcttggatcttcgactaccttttgttctcttcaaaaagttattgaataaaaaaccatccttggaggacttttgcgagctatatcctgaaaatggtggtagtctgagaaagttgctgaagttgcaggatgacgaaatatgggacaacatggagatttattttgatgtgacctattcagacctcctgggggctattaaaaccgaggaactggtccctggtggatccagtatcaaggtgaacaattctaataagaatgaatacgtttccagataccttgacttttatttaaacaaggttataagtaactccttcaattctttctacaagggattctacagtgtcataggaggcaatgccctatcgttgttcagtccgcatgagatacaattgattgtacttggagacgacaatgatgggaaaaaagttgacacagagatactaaaatctgttacaaactacaacggctgggactcccgggaagctgccgtaacaagcaaacaagttgcctggttttgggagttttttgactcgattagttacaaacagcagaagaagctcttgctcttcattacaggaagtgacagaattccagctaccgggattcaaaaccttccatttaaaatcacgaggctcaagggcaacaaggagaggtttcccatagcccacacatgcttcaacgagctttgcatctacgagtaccccgataagaacacaatgtggaggaaactagagtatgggatgaatgaaagcgaaggatttggcatcaagtaatatttaaaacgtataccccaaataggcaataaatggtcaatttttttgcaacggctcgtagtgtaagcatgcagccaatgagaaaacgccaaaagcaaacatcaaagaatcgagaggttctgacttctctttaaatttgattttcttagtacatcccaaagtcaaataaagaaacaaatgttaagatcactagctagaaactctgtggggttgaagtctttgggtaagtggaattccaattagaagaatacgttggggagatacgtgaagaatgagggtgaaaaaggacccgatggggactatcatcaatactacgtggacttgatgatggataccgaagggatgcccaattcaacaccctgttgacccacctcttattttaacataaaaccttgttcatcttactaacatattcattgtaggccaggccagaactttgtcttcttcggttaccgccttaaagtccaattatgattctccagacttttcacactacttgaagaaggatcgtaacgccgataaaactagagacttcacctacttcatggtcggttcatttggtctgttgtctgcagccggagctaagtccactgtagagtctttcttgtctaccatgtctgcttctgcagatgtgttagctatggctaaggttgaggtcaagttagcaaatatcccagaaggtaagaacgtcattgtcaaatggcaaggtaagccagtgtttatcagacacagaacccaagctgaaattgaagaggctaacgacattgatatctctactttaagagacccacaaaaggatgccgaccgtgtcaagaaccctgagtggttgatcatgttgggtatctgcacacacttgggttgtgttcctattggagaagctggtgactttggtggatggttctgtccatgtcacggttcccattatgatatctctggtagaattagaagaggtcctgctccattgaacctggaaatcccagagtacgattttgctgaccctgataccctggttgtcggttagagaaagactcattgaacttttccatcacattattatacacatcagggacgaagaacggaatgcaagagcgaatgcaaaagaaagaaagaagaagagaagaagaatcgaatatttggagcttatttaccacataaagttttctgtaaaaaggtaacgaaccataaactatttaaatgacgatcgatgtagctgatagctgtagttgtaggtcattgggaaattgcttccaattaatctgtgtattcggaactagctccccaaattcattgatttggttgacatgagttcctgtttcgtttgtagaattttgtttcaagatttcaaacagagttgaagccatgtctgtcaagtttgatgggttataatcctcgatatggtaaagcctccagaagagactccaatgaaatctggcatatcttggtagaactctgcgtttccccaaattgggtcgatagcttctcacccagcgattcgtttcagggtcgttttgatagacgccaatgggaagaagttccaatagccaccacttgagacatcttattatgctatcttctcctctattatcaaaccgataaacgggaggaggcggtacttcgtccaagagtaaagtgttgggaaatatctgacgcagttttcgttgaaactgaaatcttgtaagactactggccatcgctgcgaaatccttctccagaatgtcataaagtaaagaagtagccgttgaagatgaatgatgaggggaaggcagattatgtgaatatctcttcggaattagttgtaaggggtcgtgatggtaagagaataaagagtccatggttggatatgtgagatcgaattcagacactgaaccagagctgaataataccccatacttaagtgcttgggctatcatccaccgaaggggaatgttggaaagacaatgcccttgatcatcagacagccaacctccgccaacgtcggaatgagatccagggaaccagatctcttgcagatctatttgaggtgagtcgggaagttcgtcagcggtttcagtaaatgcaaaatcactagggatcggacaaaagagattttgcttgaattttgtacgtctttcatcaatgctaattgcgtgtcggatgtgttttatatgatcggctttagatgagaaggggaacatacggtccctgataactccgacagaattgaccgaatcccaaagacccataaactcgatattgactgtgtttcggctaaacgttcgtttaaattctacagccaatgagtttgcaaggtctttaggtgctttgggttgtccacaagtctcccaattgcggtaaatgctccaggcagtaagagccatgtgtgtcgaaccaacactcagtagcccaactttttcgatcattccagctagaattcttacagtaaaagcaccacggctatatttaacggtcagtacagttttccttgtagagtgatcttgcaatttgtccaatagtcctagttacctgaatccaaaaagaaaaatcttatctccctgagaataatactgcaccaaaaacttgtaggcagcaacaatatgctggtccattctatgagccaccatggagtctatttcagcgtttatggttacaggaatcttccggacgtatccctgaaggtccataaattccgcttccacggatcctatgcctggctgatagtagcacaactgggttgaagggtcctccttgtataacattcgataaaatttcataacattagtaaatggctgagtttggaactgattcttggtgccatctacgcatagaatgatggttttgggcattggtcaaataaacggtacaaaaccagaaaataataaccacgaaaaaaaaacgagtatgcagtacagatgacggttgaaatgtttcagcgtgtattaggagtttcaagcggttcatattcttttcgtcctatcttgggaaatttggatccaatcaaacagaagaaactccaaactctgtcttcgatataattctgttcttcgtcaagtaaaatctgttcgttttcatctatggaatgtgtagtagaatgcaagtagttttcatattttatgatatcttttctggagagaagtcccgctagcttacccccactattcttcaccagtattagccttggccccagtttgacaaagatatctaaactgatctccaagggagttgatgtcatgacagaaacgggatcccgcttgattagatgatccaaataacatgtttctgagtcctgtaaatcttctataaaagggtttgtagatgagtcttcagagaacatgcacattgtttccaactgcaaccgatcttgccctttgagccttccaatctcggcaactagctgctctcgttggaccagccctgagcagaaaccttcttggtctaacacagggtaggctttatagtctgtgtccgctaaaataacctccagatcgtggtaggaaagtctaagagggaagtaaactgtttcaagggtcatagctttatgggtagcgttgtcctggaaaaactcatgctcttccttggaatctataaatggcatcccgttgaattttatcatttgatcagcaatacctccagcaccatatcggtcatttatggttttagtcaccgcaatcgcaatcatgatagggatgatgtagttgacagctcccgtaagttcgaacattacaatgactacagtaactgtcagatgagtgattccgctcagtgcggaagctgcaccgattaaagcataggaccctccagtaatacatgatgaaccgtctttaggacacgatgcaaacaaccaagatgtttctctactggcatagagtatctccattattaaacccacggatcgaccaaaagttgcacccaccgccattgagggcacaaatattcctgcaggaactttgcatccatatgaaataatcaccaataccgatcgaatcaaagtagcaacgagcaatgataataccaaccatgatttgtgactgttgtcattggtgcaaaggagagaatgtgagtcaggagagcattctttgaacaacaactgcatagtttttgtcatttcatctttcagaaaaacgttgttatagcagatgaggctcgtcagtaaagtcaagtagacaacctcttttattgcgtgtggaatcaaaaagcggtttctgaaatggactactttgatattcaattttgaaaccacaataccatagagaccaccaaatagtcccagcagcataaagacaggaatctcaaaagagtaccaagtttggttgtaggtaatttggaacaaaaccagctgaccgttccgaaaggggtcaattgaagccaacgttgcagtcgcacataaagcgcagaaatagcatttccaaaaagtggacaataatgggaagttggaaatctcttctatggcaaacaatacgcctccaattggagaaccgaaggccacacctactcccgcagccgtggcagcagtgatgaaatgtctcctattgaaggccaaaccattgaaatatttggaaaataaaacactaggaaccacactacctacacaggcagcatagtgaacactaggtccttccttaccaacactcagtccagaggcgatgaccaagggtaacgtcaatgatttgatgaaaagtgtagcttgattgagaaatgccttgaaatcgaacccactaacaatgatcttgatttccgatatccctgaaccagctgctgtcttagagtaagtcttgaccaagattgcaccaattgaggcaaaaagtacactccatccaatgtagagcagatagcttgctggccaagggttccagaatgggcagtcgtcatgtgaaagtcccatacaacaaaactccctattcaaataccacgcagtagagcaatacccgttcttgatagaggtcagccattccgtaatgatatttagacacccagcgataattccaacgaaaactccgattgatgctaagcagagccaatcgatgatccaggatgaaaaacgatgctggttggacttgagtgtctcatttatccagtcaatagtgtcaaactgatcaaaccgagcaattgatctgaggtacctggaattctcagagtttttccagtacatcgcagcgttttctgacggtactagaggactcttaggggaaggtagaatcaataaagatcatattaggtaagcaaattttggatggaataggagactaggtgtggatgcgcgatctcgccaaattgcacgaccagagtggatgccggatggtggtaaaccgtttcttcctttttaccacccaagtgcgagtgaaacaccccatggctgctctccgattgcccctctacaggcataagggtgtgactttgtgggcttgaattttacaccccctccaacttttctcgcatcaattgatcctgttaccaatattgcatgcccggaggagacttgccccctaatttcgcggcgtcgtcccggatcgcagggtgagactgtagagaccccacatagtgacaatgattatgtaagaagaggggggtgattcggccggctatcgaactctaacaactaggggggtgaacaatgcccagcagtcctccccactctttgacaaatcagtatcaccgattaacaccccaaatcttattctcaacggtccctcatccttgcacccctctttggacaaatggcagttagcattggtgcactgactgactgcccaaccttaaacccaaatttcttagaaggggcccatctagttagcgaggggtgaaaaattcctccatcggagatgtattgaccgtaagttgctgcttaaaaaaaatcagttcagatagcgagacttttttgatttcgcaacgggagtgcctgttccattcgattgcaattctcaccccttctgcccagtcctgccaattgcccatgaatctgctaatttcgttgattcccacccccctttccaactccacaaattgtccaatctcgttttccatttgggagaatctgcatgtcgactacataaagcgaccggtgtccgaaaagatctgtgtagttttcaacattttgtgctccccccgctgtttgaaaacgggggtgagcgctctccggggtgcgaattcgtgcccaattcctttcaccctgcctattgtagacgtcaacccgcatctggtgcgaatatagcgcacccccaatgatcacaccaacaattggtccacccctccccaatctctaatattcacaattcacctcactataaatacccctgtcctgctcccaaattcttttttccttcttccatcagctactagcttttatcttatttactttacgaaaatgtctccaactatcccaactacacaaaaggctgttatcttcgagaccaacggcggtcccctagagtacaaggacattccagtcccaaagccaaagtcaaacgaacttttgatcaacgttaagtactccggtgtctgtcacactgatttgcacgcctggaagggtgactggccattggacaacaagcttcctttggttggtggtcacgaaggtgctggtgtcgttgtcgcttacggtgagaacgtcactggatgggagatcggtgactacgctggtatcaaatggttgaacggttcttgtttgaactgtgagtactgtatccaaggtgctgaatccagttgtgccaaggctgacctgtctggtttcacccacgacggatctttccagcagtatgctactgctgatgccacccaagccgccagaattccaaaggaggctgacttggctgaagttgccccaattctgtgtgctggtatcaccgtttacaaggctcttaagaccgctgacttgcgtattggccaatgggttgccatttctggtgctggtggaggactgggttctcttgccgttcaatacgccaaggctctgggtttgagagttttgggtattgatggtggtgccgacaagggtgaatttgtcaagtccttgggtgctgaggtcttcgtcgacttcactaagactaaggacgtcgttgctgaagtccaaaagctcaccaacggtggtccacacggtgttattaacgtctccgtttccccacatgctatcaaccaatctgtccaatacgttagaactttgggtaaggttgttttggttggtctgccatctggtgccgttgtcaactctgacgttttctggcacgttctgaagtccatcgagatcaagggatcttacgttggaaacagagaggacagtgccgaggccatcgacttgttcaccagaggtttggtcaaggctcctatcaagattatcggtctgtctgaacttgctaaggtctacgaacagatggaggctggtgccatcatcggtagatacgttgtggacacttccaaataagccgaatagtttgtatacgtcttatgtaatgagtttcaatgaattacttatttttacctctccttttttggctcaattcaactagcctctgtagcaatctgtttgcgaagaagaacttatctaatttttcatgggttttccccacgtttttgaaaagactttgtcttaactctctgtgatcaaaccgttgtggtggaccgctgattgattgtgattcttcttccagatctagcgactctggcagataagagtccccggagtcaataattaccccaagaatataccttgaaacctccgagttggccagtatttgagataacagcagctccttgtatttgtaagtgccttcgttatcaattgatccgatgtccagcattattttgatatcaggtctcccaatcttgacaaacttttctacaatgtgtttttgaagcagttgcacaagaggagcaatatcttcaaggtatgagtcttgctggtcgccgttcaattttaaaataagaaatgtatctgagttccctgtcgtcccaataactgctacactccccaactttgtgacagagagaaaatgatgctcttgtgaagtggaatatatggcgtcaatgctactttgtaatttatggttgaacgcattctcagtatctccataaacttgaaagcccacggggtaagagacgccagatgctaattctctatgcaattgcgactctgtgtaagtgtgactcaaaagtccaatacagtagagatcactcacatactgaggggtcagtgtgtcggagagttcacctaccaatggacagtactgggctaattcggttagcaagactcgacatatcgggatcccatactgaatctcataggacattattgcctgatcattgtctccgtttccgtactcgctcaaattggttctcattgtcactagcaagtcttttcgatctgtagacgtcaaggggttgaataatggagttatctctttttccaaaacaccgtccatttctcctacaaccttataatttctcttccccgttaaagcggctatccactgagcgcatctctttgcctgggtaccatcttttatgtactctggaccggttatcactaatagtggcttattctccactatctcagtatcaggcaagatgttaggttgggcagaatcatttgaatccgttttgatcaagctgttgatatagttacggtaagtaagaatcttctgctttaattcttcgttggttgggtagagtacctgttgaaggacttctggctgaggaaccacgctgtggccgaacttctcacttaaaagaaggcctgaaccttgggaagaaggaggcctgctattggttgactgcttattcagcccgtagtcccaaacaggcggcgttctagatcgtttcgggtcgacctcttgtactgtcattgtagtttaaggacgaggaaaaaatggatgggatgagatgacgcataaaccacaaaggaggagtatcaagctcatcgatggaacatccgacatcaaggactccgatgcgagaagcatacgaggtgacgtagagaacgagagaggccacatttcatgatctttagcatccagtcaaggtgacaaggatagagaagacatctggatgctgatttcagaggatggtggtgatgtttaccagtttcagggaagccatcaagagtaatgtcctgatgattattttatctatatattattaggtaatattataaatgttaggttataactataattgaccacaactcaacttcctctccttccaatctcacactacgttccattaacttcagcctaagatgcaaaagaaatcccaacaattgatgggtaagtgatatttctggctccgctaatactcaaaagcccacctaacatttcaccctagataagcttgactcaaacgtcactttgatggtccaaaagtaccagagcattttagaactcgtgacgtcaagcgataaatctattggaacccagtcagtagagactcttcaaattgagtcaaatgcatccacaattattagactaagtgaagaactgctatccatgacaagaactctgaaagaatcttgggttttaggccaacttccgaaaatcaacgaagactcagatctgagtaacgaacacttgcgggaaaaaatgaaccagttattggaattggttagtgatgaaacaaagcagccgaaggaggaagaatccgatctttagttgctagtctaatgggttctgatctgccttctggccatggaatttctgctagacagaatgactgttaccctcttgatctgctacatttgtgtcacatgaaagtgctgagtccacttcagagcccataacgtcaggagccacaccaccagaggccaagcccaccctcaacttttatcccttatcctctccctccaagggcccgatctcatcataacatattgtatatataaatcccctttgcgcgaataagatcttccccaagtatgcttacataatatctcaactcttcctcacagaatcaaaacatcacgtataaacagtatgccgcctaaacgaaaggggtccaaaaagaaacccaaggcagacagcggcactaaaacaaacggaagagtaaacctgacatccaatgcttccagtattttgaaaaaggcaaagcaagccaattcctccttgagtcagttgctccaaaactctcaccctttgctggacaacatagacgagctgaatgaacatacgaggcattcccagcggtttgaagaggacgaagggtttgttttcaaaagattgaagaaggattccgacgatgatgtcgaatatacggaggccagcaggtccatgatactaccattgaatgaatctcctgttaagagaaaccccaaacagaagcgacggtcttcactgagtaatagaggtaaaagggtgtcttccataggaaacggtttcactgggacaccgcatgatgatgtagagatcaagcattttcataagcatttagacgagtctcttcctgaaccccacagaatgcgccagttgttgatatggacagggaagcgtctattgaaaaagaaacagacccacaaagacaatacgattgtgaacatagccaaagtaatcaaagaggaactcataagagatttaatagatggaaaattgaataccagttggtggaatcgagttgatagcgacgaagaggatgagtttgacgttacaacttttctcccaaaccagcagaatgaaaccaacaaaaagaaccttgctctgttacaacacagtttagaacaattaaaagaggaagagaaagtttgggaagaaaaattgaggcaattaacaggaacgttagctttaagcccagatatttcatccgttgatgtcagcaataatgaaacttgcagcaagacacaagaaacggtatccagattggaaaagaaagtagaagaaataggcgaatctatcgatataccgctggagaaaaaactggatctcttcgccgactatactcataaattacgttctatagagaggacgtccaggatatacattgacaacaaatccaatgaaattgcatcacttttgagcaagaagcaagagatgaaagaactaccacaagatctactgaaagcgatatccagaatagaccggagttgattccgtcagttcatggcgtggcgtggaaccttaggcattgctcgaagccgactcaactacaaacgcactaaatgcaacaaaaactctccatccccaccctgtaatattatcagaaatcattctttgtatattaggtgtataatatagtgtataatcatcagaagcaaacatactaatgatccgttcttcgttataaattgaaatactttctggaaagcattcggaccttctgatcaaatgctttggatctaattgcttcattaattgtgtagaatggggataatagtgtcttgacatacagatcattcaattcaccaaagaactgcctgattgcctcgtctgaccgcaaattctggtacagaatcataaatttgatgtttccaggtgtaacatatccgcttatactgtaattatcgtagttatcaatgttcttaaagtacaactggttggttttccattgaagatcttctatgatatccagcgccgaatggacgatgaatgggcaaaaatcacgaattggatccatctttatttccatctcatacagtggattgtcccgcgtccctatgagggccagatagagggacatttgctgggtctgtgggggctttgtgcagtgatattgaacgggggtaaacgctaccttgcgcagctgggccatcctgatagaccttctatttatccacccaaacaccattatctcgcgaaggggaaagggcagactattgttccacggtgtgtgcgccttgcctcgcttgttctatagataacgtcaggctcatctcacaatcgacccacacttttgtcacacaagtggccagccaatatgcttaagaaatacagcaactactcccaggaagtcccagatatacctcttaagcagaatgaggatcaagcttctgacttggctcccccatcacttgacagaactgttgagttgacgtctctctttctaggactgagaaagtcacttcttttggatagtcacattgaaccggcatcaacgatgcccaaaaaggtccctatgacctgtgttaaggaaggtggcaggaactcgctggatatggagtctaattctgcctattcgaaagaggacctcaaccaactggcgaaaagtttgaactttggtattaatagagagtcctatgaatataatcaagacactgctggacagattaacttgagaagcttttcaccccaaatccttgaaagggcaaaacgagtgaagctaatgttttcccttttttactggaatttggaaagaagtctagagatacacatgccattggaagacaatcccaacaaatctcaattgccaggtattgatggtgtttttaaccctcttcaaacgataaggaaccgatccatcaggcgaaagcagcattataagattcaggacctgggattcaaagcattacctcttccaagtcaagcattcagtagaaagggaaagaagcacaagtctggaaacaaatctacgaggtatttcaagtgggaaattccgttgaaagaactaattattgatatgaattggaagctagagaattggcatttgctgatagacccatcgggagagctttggtttgaacactcagagctccccgatggtcgtctgcatcatcgtcttcattacaaaagacctcatcttagaaatcataaacgatacaaaaagttatttgaagattacaaagaagatttggacgatgacttagcagacccttttaatttgtcgttggacaaagtccatacaaatggatctgtgtctatgttgaccactggttcctacgatgatggtgactccattagaacaaccagaaccaatgatgaactgaagaaaaaaacttcggaacttgaaaaatctgctagcgacactgcttcctcttatatgccttcaaggctggctaaaatgcctggacgattcttcaaaaagaaacagcaaccaaacgtcgccgtcgccaacgctactaatcccgacaccagtccaagttttgattcagaatctacccatcaaccagagccctattatgcagagctacctaaagttgtcatcgaagaggcaagtataggagatgaggctcctaggagtgactttggtagctatagttggaatcgtacgaagtttgaacctctaaaagttggttcagaagaagatcttcagacctcctcaagtacttccatgatcgaaagacactttaccaacgtagatgaaaagaaagactccacagtgtctctggaacagcatttcagttcggattccttacccagacgaacttccctggtagatgaccaagaagaacagattttgaaaacttgctaccaacgacttcgaaaaatggacatccttattgttcttggtgaagtccatatgtcgcacaaagcttcaagcctgacccagttcattcaaacgagggcagatcaactccaggaaaaaacggtaaacttgaacactagtttcagccgtctggaaaatgtcgaattgaaagaatacgatgacaggtttcatcccatttaccaaaaggccatagaatacagaaacttcgtagataacgattacttcaacaaacttgatcaaatgatggcattatcagacagaatgatcggagaaatcaacactagtgtcacacttgatattagaaagctcaacgataggatagacaagttaaatcaatcaacttctctcatggcaaccaagagccgctttgatttgagaaagattggttacaagctactagaaaaccttatcgttctcctcttttggctcatttgggtcatagtgtcagcctatagaattgtcaagatagttcttatcatgggaattcgtttcattagctgggtactttctgattaggtaatcgctccacgctttttcgttttaaaagggagagcttttagaaaacgcgtctttctcctttcacgatacaacaagaatgactgaccaagaaagcaagcgcatcaagcaatcagagcaattgaaagtgttcctaagatcagacaaggctaaaactcctactagggggtctccattatctgctggttacgacatttatagtgctgagcagactatcattcctgccaagggccaggctgtggtttccactgatcttacagttatcgtcccaattggaacttacgggcgtgtcgctcctcgctcaggattggccgtaaagcatggaattcagaccggtgctggtgtcattgatgctgattatagaggtgaggttagagtgcttttgttcaaccacggtgataaggatttccaaattgaggcaggcgatagaattgctcaattagtcttggaaaagattgttttggccgacattgttgctattaccagagaagagttggatgtcactgagagaggagagggaggattcggtagtacgggtaagaattagacgtaaacttcaacaatcacatagactaaaattagtagtagcaaattatgtaatcaaatatgacttcatttcattcctggagatgttcatcaagaccatattgtttgatcatatctttgatggagctgcttggtagctctccgggagtagctggaatggaagcattatttcttataacatctgaaaagttggccgttggaagttccagcgttccatggaacttgctggtgctactattagcagaatcggaaatactttcagttggggtattcaaaccgcttgaagagttggccatcgacttagcattctgtcctttgaagctgaagtagtctaaatcaggggttttacctggggtatctaagttatattcgtatcctttaacatcgggagtagttaaattagtctctgcaagattcgattgacttgaagatgatacttctcgctgatcagcgatgtggttgccagatagcgcaaatgagctatgaatatctcctgttttaacagaaccattattacgcaactgttgagtgttgatcggaggggtgtcagaccttactggaaccttcgatggtttcttctttgactggtgtctagttattgaaatggatggaacaggttgatggatggtgctgggtgtcgaagaactatcactattgggactctcatgtagtggtgctgagagtacttcatcaagcttggaagtgctcagatttttgaaagtaggcaaagcaaaggatgaagagttctttctaagttcttcagtatctttcaattcagcaggcaaaggagaagttgtcctttcaggaagataaatggatgactcagatgagttcttggaatggccctgaacaggctgcttcgcaacagaattggcataacgaaactccataacagtgtttctctctatcgatgaagcgtatttggtcaattccttcaagtctgtataccattttccagcgtcaactgcatctacgcatttgaaaatgtggtttgtcttggtactagtatcatgaagaacaaacttgcgagattctcgatctgattcctttaaaactactctatccaacggaagtgaagactggggcatgtattctttctttctatctggagtcttaaactcgtgcagaaaattgagagtcaggacgtagtatcctttggcatagctcttcaaaagtttatttttcttttctagatggccggatcgaatacaacgtgcagctagcttcttttgatacggatagacaatattcgaaagttttctaccgggagaagggttcaatatctctttggatgagatattcagaaagtttgccttgtcgttcaaaataaaataatcccaatcagaagaggggacgttcttcaagaatccttctttgagatcctcaactaagttcttcttgacagtgttgacttctgcgtctatcaaattggcaaattttccgaaagcattctgcacttccttgtaaaccacttcctcaagtaaaagaccagccttttgaatactaaggaatgactccctcaccatattttcttctaagagctgttgccgcagttgtaaatcaaacctcaatttcaaaacatacggatcatatttaccagagctggtcagttttgaattgtacttctcagaggtgtcaaggccagacggagttgtggttgagccccggttgaataattcgatgacattgacgtagtcacttaataattgacctgtcatggccacctgagattttattttttgcaatttgaaatcgttcttcaaggtcaaaatctcttttatctttgagttcaaagatcgtttgaaattctccaatcttggaatgacctttaaagtcagttgattgtaggtaactagttctttttcagctaaagctctatgatagttatgcaaagtattacgaacgctggtgatggatgatccactgggaggaaggaacgctgttttcatgaacttttcctctgtggttccagtgaaagcagcaagttcacctgtgggatcatcattatggtctaatggggctacgctctttgcagaaggctttgtgagaagcttgatgttgttcaacatgtgaatgttgagctcatagtagtgttgtttcaaggagctgagctccttgaagtagaagatcagttccttgatcaattttttccatatggtaaagcggttcactagctgctcaacaggatgtggattcaacggcaatgcaatatgatatggcgacgaagggtccgacggtggtggcagaggagacaaattctgcgacccattacgtagcgggtctgttgtcaaggaatcatttgaggaaaaaacggactcgttcgactccttaccatgcaaagctggtctagacccagcgaaggatgatccagatggtttggatgagtgactgaagtaggaaccagtgggcgatggtgcacgggacatttcagactatgagcctatgggagtaactcagagcaacgtggaaaactggtttcaaatcacaaacgcaattttggaagaaaaaatccctagaaacaaggtcgcaaagtggatgagatttctaatgccttctatttatagtaggaggatcgcaggggcaggagttgcaggacttagataagtgaaagattatgtaatgcacgtaatatcgtgaggcgaagttgggcagttctcgcgagggattatttcaaaattttgtcttccagctggagggtcggtcccgtgctccgggaggaatgaccgaaattttgggtgagaacacaggttaaccgaccccaactcaaattccaatcaccaacaaccgtcaactaagaggttagatggtaaaaatactgagaggccctgtgttccgaacaacggtactggtagggagaggtttactgcgttccaatatccgaccagtccacgtattaggtctaagatttcagacaagcctgaagcccaaccctccagtttcgaccataaaagatgttgaggctcagaagcccaaagatccctcattggcaggtcagagcaaggatattaagcacgtaacagaaaccgctattgtagagaccgaaaagaagctcacgttgtgggaaaaggtcaagcatgaggctaatcattattgggatggaactaagcttttggggtatgaaattaagatctctttcaagctactttgcaaattagccggtggttatgaactgtcgaggagagagcatagtcagttgactagaacaaccaccgatttgcttcgtttaatccctttttcagttttcgtactcattccatttgcggaactgttacttccagtggcgttgaaattgtttcctaatttgttgccttcaacttacgaatctaaggctgaaagaaataagaagcgtaagagtttgttggatactagaaacaagacgtcgaagttcatccgtaagacagtccaggaaagtggtattaatctccccaaacaggtgactgaagatgagaaaaaggatttcgtatcatttttcaaaagtatccaggaaccaggtgaaagaccatcgacagaacagattattcgtatcgcccgtcgtttcaagaatgaccaagtgctagacaatctttcccgaccacaattgatggcaatggcccgttacatgaatttacgtccgtttggaactgacgagattttacgttatcagatcagatataagttattgcaaatcatcaaggatgatcgagccattgattacgaaggagttgaatctctgtcaattcaggagctccagagtgcttgtgcttcacgtggtatcaaaaccgttggtgcttctcctgcaagactgagggatgatttgaagatttggctggacttgaggttgcgtcagaagattccttcgacacttttgattttgagtagcacgttcacttatggagatcacgctgatgacctggacaattactacgatgccctgttggcagtactttcttcgattcctgatgaggtttacaatgttgctaagttagagctggccgaccaggacaataagttgaagctgaatgtcttgaaggaacaagatgagctgataaaggaagagagacaacagagtaaatcacaacgccgttccactccaatcaaagacgatatcaaactagacgaatacgaggaggtgaaagaagatgaagtgaaggatgacgttactaaagacaccgtggaggagaagagggaagatacgaacgaacatgtcaaagaagaaccaaaggttgatgcaagcgaggaggtcaaagacgaaactccagcgcaatctgaagaggaggtgaaagaacccagtaaggatggcaccgtaatcgagtccaaggaccaacctcaaaccaccgacaaaaaggagtaggaaaataccagcaaataaaacagctcagcgtctgtttcaattaaatatctacaatcaatttatcacgccgaaattaaattcaatcccacgactagtgtatatagtatatgaatatagtaaaaagagatccgttcaacgacgtctacctcttctaccaccctttcttctggtagagtcagatggaactggagtaacatcctcaatacgaccaattctcaaaccagatctggccagagctctcaaagcactctgtccacctggacctggggtcttggttgaggtaccaccggtagctctgagcttaacgtgaacggcggtgattccaacctctttgcacttagcagcaacatcttgagctgccaacatggcggcgtatggagaagactcgtctctgtcagccttgaccttcataccaccagtgactctggcaatagtttccttaccggagagatcagtgacatggacgaaggtgtcgttgaaagaagcaaagattctagcaacaccaaacacctgggagccatcacggacttgtgggcccaaagtaacgttttcagtcttggaagccatggttttgtatgatgaagaggtaaaacttttttcgactgaaaaagagagggaggagaaggtttggtcgcgagacggaggtgtaattgggactcctcccaattatgtcggggaaaggagccttgggcggaggttgagagttgcctcattaggaacgcagtcacaattaggatcccgttcgcgagaaaagccaaaatgcctacaggggggagaggtagaagggagaggttcaaaggggacaaggtgttggaggattgaaccccaatgggactccctgggcggagtgctggtactatcaatataccgaaagagcctgtaactacaatccattaatgatgaataatcagtatattagtataagtacacacatctagtagacgaaacccaagatcttaccagaaacgtgcttctttctggcctcctcgtggtccataataccggcggaggtggtcaagataacgaaaccaaattgtctagctggcaacaggttgtcagtccatctctcaatgtcaccaatcttgacgttgaatcttggggagataacaccacacttgttcaatctaccgttcagctggataacaatctttccggatctgtggtcatcaatgaattcaaactctccaatgtagccgtgattttgcatgacggtcaaaaacttgacgataaccttggaagcaggtctgatgagtacctgacgtttaccggtcttctcggcgttgttgatagcgttcagagcgtcggcaagaacagaggttctggtcatattcgataggtgtgatggtaagagtagctgtgtattttttttcagactgtttttggcagacgagctgaaaaaactctctacaccagaagaagttagcaggggttagccgtaacatatgtcacatgactccttttgctggcacctaccgtacttttttttcagtgttcccactgcgattgtcgcgcacactacctcttttcctctactcttacacttgtgagaaaaaaacttctttttcaacttaccagaccacataaagatgccttctttaaagacattcaagactaagcagaagctgggtaaggctcagaaacaaaaccgtcctttgcctcaatgggttagactgagaaccaacaacaagaaccgttacaacgccaagagaagacactggaagagaaccaagttgggtatctaagttagccagcttctattcaatcaatattcaagttttcagatgttgttatgtaatgtgtatgtcctaatgtgacctcatcatccccatcattacttttttgtggaagacaattgcttctattttgttgtatttatagtacacagttttctatgggagttggctagactgcttcttcaaacacggtttcgataggcttttccatgagagaagcgtgtgagagaacggttaccgaagaggctccgatcaaccatagcaatgtagagataggactggctagaaatcctagaggcacagcaacaatgaacagtccggtgtacaactgagatgtgttcagtcttgtgaatcctagctccaattcttgaccttgtaaagcagcaataccgtagacaccagcgatggtaaacacaataacaaataggagaagcaggtttgtcagcagagagtatgtgctcaagagggccactatagcgatgtaattagcttgaaaatatcccagattatatgcaactcgttgctggacctctccaaagtttgctggcttggagacccttctaaagtcgaaaaactcttgtggcggtttcatgttggcaaatttgttggagatgttttgggcctcctgcctgactctgtcaactgacatgttctctgagagttgagaaaactacatggttagtgaacggctcgcagaatatgaaaaaggagggggaagacgacttacttgaaaatttgcaaattgggacattgacatgttgggctattatgtgtaagtcttgaccttgtgctgtcaatctatgtttacagtcgaaggttacaaaataaataatgggtaaaatcatgtaggcgtggcaattagaggatcgcgaagtactctgcctcggcctcctagcttggctgaggtgggcagtacgtgggcgggaggtagtccgacagtcgtctggtacgggcttatagatctttatgttacattgtaatcccttcgtattcttattccagttcaatccacgtcaatgaccctccggcattatactggagaccattgattgtgtaccccagctcgcttccaaacccgaactggttttgtataaccctttcttcttcgtgttgggcatcacgatactccttctcttcaactgtggtctccacaaacagaccggaggcattctggacatccaatgggacagccaatcctttatatctttcttctggatgcagcatgaaaaatttcaccgaatctccggtattgatctcacaaccagcgctgatagccaacattttacctttctctccccaccctcctcctcctgctacaacctcatagagtcggggttcagattggacggatgaattgcttaattcgatgaatattttggtatctttggaccccaggttcattattctcttgcaattctccaaatatccagcagcagattgcccgttgattcgttttatcaagttatggttatgttcagtaacggccagatcctcatcaaaactcaattgttctagcttgttccacgatctaaagcccgttggccttatttgcttcggtagagtcagtgtcaattctgccaagttgtggttggcattgattagctgatctgcgccatggcttctggtatagaacataaaacacaagtctctgaagtaaaacgcactgttggcgagactcgtagtgatagttgaaatgccattgtcactattgtgaaggttaacctgtaatctggtttgcatcttcttccagggcctgttggcccttactggtataacaccgttactttcctcgccggtgttgtcttctaaattgtcatcacgttcttccaatcgaactgaatcattgacagtgatgtactcatccagccacatttgtgaaacaccatctcgatgggtacccccggagggtatgctgtctgtggatgctgcaattatctgaagttgttcatactcggaactgatgcttcccaactcagtcagcaaattgtctatatgctgtggagtggcgatgacaaaaagtgatctgggttcgaattctggtcgcttcaacagtttactcgccggattatacgttgtctgaaggtaacgactgtaccaccttacagaactccccactcgtctggcaagaaaactcataaggatgaaatttcgatgaaggagaaaagacaaatctcgtacaaaataaccacgcccagcaaacaacacagctcatctacaatttacaaacgtgttcaaataaccatcatgattactgtattataagatacaccaaaccagtaaactaaaatcgtctatttaagcttcttctttggtctcagttggttggagtgaccacactttctcttacgacagttggtggctcttggtggcaatctggcgtagcacttacggcaaacagacttatcacagttgtacttagaagctaaaaccttcaaggatggctcaatgataccacctctcaatctcagaaccaggtgcaaagtagactccttctggatgttgtagtcagacagagttctaccgtcttccagttgcttaccagcaaaaatcaaacgttgttggtcaggaggaattccttccttgtcttgaatcttggacttgacattgtcgatggtgtcggaggactcgacttccaaggtaatagtcttaccggttaaggtcttgacgaaaatctgcatttttgtcttttaatgttagtcttcaactggactgatgtgagcggatgggtgatttcccttgttgttcggcgttgacttacctatgaattgaactggttacctatgtaatcagaagctggttaaaaaatttgagcaaatgccagagggcgaggattggtgggtgttggggtgtaaaatggtttatgcacgtggtgccacctggggctatgccctaccaaagaaaggtgttggatgttacgtgtgatttaacggtgctcgcgtacaacttgacgttctgttgtagggcgtattgtctattgtgatgtttttggcatacttaacgtacttacgtataccccacataccttttttctctacaagtgtaagtccttgcggatcattgatcgacagatcggatggtagattggctcaaacttcaagaatgtgtccttggccagttgagggtccacatcgttgagcattcgataagatggtcgaacaaatttcattcgtccgattgttcccagccaatcggccagacgctggtagtactgcttgcttctccctgttaattgtagtctgtaccagcggaaaatgacttctgcattcttggagtcgtcataaacgctatagctctctctcataaacgtcaaagcttgttccccttctttggaattccacaggaaaccttccactccttgataagatactaaagtatcaaggaagacgttagtttggttacccgtgaaattagaaatatcatctgagctgaaagttttcttcaaaagatctttgctatccttcttggtgacatcaacccatttggcagctaaatcatagcattcatcaactagcgaggtatcaaactttggctttggtggtaatccaaacttgtacaaccaagtttcccagtcaactttgtctaaaatttcatgtttatctgagaaaaactcataaagggtatccaagaactgatacgagtcaagtgatttgtacttgtatttgctgaagtaatatggaatgaaggggtcgaatactgaagtcccccctaacacttgctcaagatggaacaacaagttaaaccctttttcgtagggaactgttgaaaatgcatcatctggatcagaaccgtctttcagatcttgtatcaatgtggagtatcgttgagcagtctgacccatggacttgattgagtattctagatcagaccatccaataatagcactaaaatgcctgcttggttctccgtgcaaaacaccaacgatacgtctctccaagtaaacagtccatccctcgttcaaccagaaatggtcccatgagcagtttgttactaagtttccagaccaagagtgtgccagttcatgagcaataacatcaatattctgtttatcaccagtgatacaagtaggattgatgtgagagatttcgcaattctccataccaccaaagggcatggatttgattaacaccaaaagatcatacttagcccactcgtacttaaagactaagccttcagctgtttgaataaagtcttcgatatcatctttgagctccttctggcaagcatctattgcaataggctcagcgtagactttggaacgggggccaacatcagctccaaccaagtttcctgatgcaattgatacaaggtacacaggaattggaatgggttgcttggcgtaataaacatctccctcttgcttgtaagtctttccagacagtagagtgtatagaggagatttgaccctgaatgaaaggtgactttattgacggggtgtcaaaacaagggaacaacgaacgaatgtgaattggctctccttgagaatacaagtatgggtgatcaccgccatcagtttgctctgggtcgcaccattgtaaagccgtgcatttgtcagtggtctcaaatttggaggtcagcagcagttgctgagccttcttgactgcttgtttaattaccaggggggatcccaaaggttccttcctgggctcaatttcaaattcaacctctttgttgtcgatagttacctgcttcacgtttaaaaaagaagtatccaggattatgctctcagcgtcatccttaacgtgtagctgatacttgacctcaccagtaacggtgctcttttcaaagttgacatccaagtacaagtcagttgccttgacctcaaaatgacgataattggagtttgtagaggcatccacctcaggaaacaccttgggcaaacgagaaccaatgatatccctcaatttgggtgaaatatggcttaatgaggacatgaagagcctttgattacaattgcctggtgcggagataaatgttcttctggacaatctgtacgtgagaacgaagaaagaacgcatcgactgtatccttctagtactccagggaataggcggagagtgtcagaaccaaagtggtggttggatcttggagtaggagtgaggattaatttgtgcgcttctctcacagctcagatgtgtggatacttgatcagtggagaaatgggaaacgtgtaacaaagatggcaccagttggtagataagagtagtcgccattcttgctcatctatggttttttgttttgattttcgaaggacagacagtgtacttaatacgaaattgattaatttttcagaccaagtcttaacagtagtcatggtcggtgaaatgatttcgttgcagtggcagaatttatcacttacttctcttaagaatcttcttggtagacaaagggggtcaatttaaggcgaaagacttggatcatggaactgtaggtgaagaacttagactacgccgcaaagtatgcggccgttagtctgcgctgcatctcgtaccgtggcagctgtcaaacctggatcaagaacccccacgcataacgtatttataagtatatatatattcataagaaaacagtttattattaggtggggtgggcataatcaccatatacgaataatcattgatttgtctacggcatccaactagaatcctctcaacaggaagaaggagattgatcaacttttaacctacatatggaaactgaaatataaagtgggagtatcccattaagcccacagcatgttcaatgggaaaaccctcacaaccccagagctctacggatattcattatctgagaatctaagtgtacgtctcacgttctctagtgttcacacaaagagaacagcgatgtgtaaacattggatccaccatactcatcttcctcctcaggagttctctcttccatcaacttttccctgactttctttgcttcgtccaaacttaaggtatattgaactttattggcgatcaagtccaaaatctccgttggaagtttgctagaagtctccttgcccaagaaagaagtgatcttatctcccaacagattctcttgttggggtggcaccttgtcagttgcaaaagtatgcctattatttggatccaccaaaaagaaacaaagaatcttcctatgtcccgacttcgttttgtcaaccagttcaaatggttcaacatgatgttggtaaacgtttgggaatatcaaaagtctgttttcaatacaatcaacagatcccaaaaatctcgtcaacctgtcctcatcatgaagtccaaaaattttcctaaccgtgacatcgtcgctctgctcgtattttggttcaatagtggcattacggaaactaagcttggactctccaatgttttcggagtcataatagtacaataccgtcgcaacaatatcttcattgacggtaccctcaacgtgccacgagccaccaggatatgtgggtttttctggagttaaatgtatgttagctaacttggtaattacttttagatcaccgaaatctgccagatccaccttcttttcgaaaacaggtgttttgaactcaagagggaatctggatttgtctacgtgatcctccctttgctcaaaaattcgttcatactcctcccagtcatagtcactagttgcttctagcgcttgcaatttgttgttgaagtcttgatcatacaccaaagagtattgcatgtaatcaaatctggggtactcgactctcagtctttccaagttactcaagtgagtcaatagcaagttcaaaccagggatagctttggcaaataccgaggaaatcaaagggtatagactgccgtacttcactggatcaagattgttgatgtacgattgaatgttcacatcgtactcaccattcttctttgaaacgtgaaagatggatgggagccactgatagttttccgataaaaagtctttcccgtagtagtgagtgtatttaggaattgtcttgggaactatcaccttggagacttcatagcccttttcagtcaccaccagcgtctttccgtactgcaaaggatacaatgagggatgaaccaagtccagcacttggttattacttccaggatgccaatccttggaatcctctggcacatcctctagtttttcatacaccagcttcttcaaagattttctgaaatcgtcgtcaagggcgctgtctgaaaacagcacattttcgttgggacctgcagtgaaccctgtctcttctgcgtacttttcataccatgctagttcttcaaagacaaacttccagatggtttcagcgggatgaagtggcaaaatgtctggttctaatttcaattgaccttccatctcggcaatccacttcttcttgatctcctcgttcttgtatttggtagtccagtcaggtttcgatctgatcgtatagctcaatttctgcactatcagatcgtctacaacacgcggaaaacagacgtttgcttctgctgagaagccgtcaaagaatggatgtgggaagtgctcaattgtagttttgaatgccatggtgggggctggttgctgggttatgaagggagttttcgataggagcctcttcagaagaaccatgacctgtgcaaatgtggtgatagggtgtaagtgcgagaatgttgattaaataaacgtgcggctaggtatgataacgggtcaacgatctgtcagacctttcaagtgccaaagaggattttattcggtggattacgatttacaggtcttccgtagctgtattatacgtggtggattttataggagtgggcgttttctgagagaagagtttaagcgtgtttgagtggataggccccgttcagccgtgcgctgtactgtcagccgaacaaagttctgaagtcagttttgttttctctttccactcaatattctggcaacccataaattttcgtcaatttagcactcgtcaatcttttgaacagcgtttcatgactttatctgatacccgataatgtcccacaaagtcatgagctgtaccccttgtgggtctcaacagttgccatggcatccctgaaaattagtaaacacagtttattaacctcccccaccaacccttacaccccccagtcaccagtcaccagtcacgcgaataccacctcccttctcggaacatgtcctaggaggttgccttattgggcaaccatagaaatttctccgtcgttcgctggccctctctcggcagaatttccgaccaaataccaattccggaaaaattacttatacctcaagtttcccatatttgttttcttactagtttactaaaaactaccagcatgagcaaagaaagcggaaaggttctacaagtcaactattcggactcggaaacctccaacggagaagaccagtacgtccacaagataaaacctgtagaggatgaggacgacacgtcgatgatgatgtctttcgacaatcacaagcccactattactatcattatcttaaccgtgatggcatcgttttctggattcatgtttggttttgacacaggttacatctcgtcagccctggtgtccattggtacggatttggacaataaggttcttacttatggagagaaggaactgatcacctctgcaacctcgttgggagctttgttgtcagccatatctgctggtttgttggccgatattatcggaagaaaacccgtcatcatgggatcaaatttgctgtttgtcgttggttctgtcattcaatgtgctgccaataccgtttggaccatgattggtggtcgttttgtgatgggttttggtgtgggtatcggttcgttgattgctccattatacatcggtgaaatggctccttctcgtttcagaggccgtttggttattattaacgtcatcgccattaccggaggtcagttggttgcttatgctattggagctggacttactcatgttcacaatggctggagaattctggttggactgtctatcattccacctgttattcaactgttcgttttcttcttccttcctgaaacaccaagattcctcattatgaccaacaagttagagaaagccgccaaagtcatcggcaaaactcataacgaatctgatgaagagttgatccaaaccaaaatattagaaattcaaagcgcaaacgccatcatcccaggatcaaacccattccagaagacctggaatgccatcaaggaaattcacagggttccttccaacttcagagctttggttattggatgtggtttgcaaggtattcaacaattcacaggcttcaattctttaatgtacttttcagctactgttttcgaaacaattggattcaaaaattctaccgctgtttccctgattgtcgcaggtacaaacttcatttttacatcaatcgcattttttgtcattgacagagtcggaagaagaagaatccttctgataggtgttacaggaatgattctttctttggttatgtgtgctgtcgcatttcatttcctggacatccacttcagtggccacaacgccattgtcgagactaatggtatcagtggtactggtgtagctatcatcgtcggtatgatcctatacgttgcaagttacgctcttggtattggaaacgttccttggcaacaatctgaattgttccctcaatctgtcagaggtgttggttctgcttactgtaccgctgttaactggtctggatctctggtaattgcttccactttcctaaccatgctggagaatattacaccaactggaacgttttctttctttgccggattgtctttcgtttccttaatctttgtgttcttttgctaccctgagttgtctggtctgaaattggaagagacccaagagatactgactggtggattcaacatcaaggcatctttgaagttggccaagcaaaggagaaataagcaattagaggaccccgacaagattgtgcataaggtggtagatcaagtttaacgggcgtctcttggtcgaacgcctgccaaagctgtgtgactactgccattttttatcatctatgctggcatatttaatatatagattgggaagtataattatgcataatattcattcaataatttcaaaattataaaattagaagtgacatctcacgcccttttagtcttctccgcattactatcgaaagacaggaatctcccataatctcaagatcttcccacataatggatgaagaatcaacagtaccgttcttggaggacaccacaagctcccagctaccagaagaagtcaatgttaagaagcgaagctttgagtacttggagaactttccgtctccattgatacttctcctgacaagtactgcatctataagcggattcatgttcggttatgacaccgggtacgtttccgctgcattggtgtcgatcggtaaagatcttggaggctccctgctgacgctacgtgataaagaggtcattacatcagccacatcactgggagctttgttgggagctctcactggaggattattggctgacctgtggggtcgtaaaagggttattttgctgtcgaatctgcttttcatagtaggaggaggtactcaggtgttttcacaggttgtcgattcgatgatctggggtagattcatcatgggaattggggttggagtggggtctttagtggccccattattcatcagtgaattggctcctcctcagtttagagggcgactggtggtgatcaattgtctggccatcactggcggacagctagtagcgtatctgatgggtgctttactaagaaactggagaatactgattgcaatcgggtgtatccccgctctaattcagacactgtttttcatctacttgcctgatacaccaaggttttaccttatgaaagggtaccatgataaagcatttcaagttttgagaaggataaatcctggcatatcagatacagctattgaagacaagatattgcaaataaatcaacagaataaacagtctactcttggtttgtccccatggaggagcatttgggtcaactacatcagaattcaccgcaaggcaagcaatcttagagctctgatcattgcatgctccttgcaggccatccaacagttaacaggcttaaatgcgttaatgtattttgcaagtacaatatttcaaatggtaggctttaaaaattctaatctagtatcaatggtgattgctggaactaacttcattttcacagtgatagcgcttttcgtcattgatagagttggaagaagaagaatccttctatggacattgcccataatgtcactgtcgctgttcttatgttctgtctgctttcactatatctcagtagcttttgatccagatggacaaccaattatagctccaggaactgaaaatgtatggggtcacttcctcatattggcgttcatatctgttgtagcatcttacgcattagggatcggtaacattccatggcaacaatcggaactattttctcaagatgtcagaggcacaggtatttcaatatctacggcgacgaattggacatcctgcttaatagtaagctcgtcatttctgactgcaatgaagctggttactccgtctggaacattcctaatattttccatcattggtgtactatctgttgttttgatcgcctttatctatcccgagctatcaggtttggaactcgaggagacccaagaaattctacaagatgggttcaacgttaaaaaatctgttcaactatcattacaaagacaacgaacgcaataactacctacttgcatgctattcaactttatggtacactcatacccttcttgacctcctctatctttgagatttgttctgcccattgagccaattttggataatcattgacatcaatgtccaaaaatttcagaccataaatccatgggtaggtggcaatgtcagccaaagacaaatgatctccaactaagaacaaggctttgtgtgggtttctttccaatctttcctccaaaactgagcagagacggcgtacttcgtccagataacgctttttggcataagggatatcttccttggtaaacctcacaaaatgattagcttgccctgtcattggtcccacgccggccatttggaacattaaccactccaattcctcatagtattcttttgttccgtaagcgtacgagaatttgcggtctttgtcgtatttgtcagccagatacagcagaatagccccagactcgctgatcgaaaactgattgccattggaatcagcctccgtcaaagttgggatcctaccattgggattaattttcaaaaaccagtcttgcttgctctcattcttggttatatccagggaatggacatggtaatccaaatgcagcaattccaacagtgtggaaaccttgcggccgttaggagtgccaaaagtgtacaatttcaggtaaggagcctccaatgcggtctcctcgggattgtgttgatcgagtaagatatgaaccatttttgtggaggataactttcttgccgaacaaattgaaggggagagagtcttccttaaataggtattccggacgcaccgcaacattctagaaaaaaacaacttccccagcatttcgcaagacgataaaggatgcgaattcggtattatgatgtcacgtggagtagcaagatacttagaatgcattaggaaccactggtaattatacatcatagtattataagattattagtacgacgattacttgattactttgggaaatatttctccttgtagatccaactgactcccaccaagggcgcatggaatttgtcggcaagtcgtagccaggcggaggccttgtagagatctttcttgcggtgcttggatttgttcgaccagatcatgcccacctcacacattgcatcaacaatgcccatggaagctgaacgttctaggaacttgagccctactgcctcatccttggtgacaccaagtccggtcatgtaacattttcccagctcgtataacgctgaggcaattggttctttaggtgaggagggaatgttttccgcgttcagtgcaaagggtgaaatatcaggctctcgcaagaacgaagacaatgatggaaaatatgatagaaatattttcgtcaaccattggaacgacagtacgttatctttcctgacaccgtcgccgtatcttagggccaaagcgtacaacatcattgcctgttcgttgccctcgtgagaagccttctccaattgataggacgactctcttagcttgccactatttctcagtttcaaagccagactgaccctgtccatgttggccgtctcttgtgaacttatggatgaatgcgaattagaatgtttatggaagtttctttgggtcggagatgggaggtcatccggattgatattgagttgtgttgttaaggccgcaggtagttgggggatcgtggcatagtcgatgtcatttgagtctaaaaatcttgctaatgtttccctttcattttgatgtacgtgtaggttcaaagggtttttctttggagaggacgacactcctggttccttactcatctggcccgatagacgcttgaatagcggggaccgtatcctaggcggtgatgggatgtacgaagaggaatccgttccgaaaacggtgaatcttttgcgcctgggactttcaatctctggctctgttgcgctctgggtatcatggtcagtcattctccaggaatctgggatcgtctgtgattgtgacttctcatgagagaatgaagtcttagagtcctcgccgtacccatcactagcctcatcttgcgagttattacttgactggtcggagtcattttgtctggtttctggtttgtaagaaacacgatgttcccaatagttgttattactgacgtgtgttgggtgggaagcagactccaacacttgagcatccttccaacttgaaaggtcgatcttattcgtcagagactctgacgtatgaaacctctgcttcaacgaccgaaagttttgcgcagaaacgtaattgtttttggcagtatcacggtcgtgttcatcatccctctgttttggcatcgaaacatccttcaatgtcgaggtggacgagtttgtctgtgatttggccaacttgatcttgttctcatcgtcataaacaatagatagattatcttcttcatccgtggcattgtcgtccgacccgaccaaagactccagtccaagatggtccagtagacgtcccgtggtagctatcgtgtccagtgataaattactgagagtgcttactgttgattccctccgactcaaacattcgtccttctggatctgcctgatcctctccagcgtgctcctctcaatcgcagtaagattgggaccattattcataccccttttttaagttgaactaaaagctgaaccttacttacttttctggaggggtttcacctacaaaaaccacacaagacgcgatgctgacataatctaccaggacccaaattacgtggtaaaggcatgacaattgaagataatataatatatacagcgatactctttattcatagttatggatattattcttgtttctcgtgtctatgtatatttagaacagatgaccttagttgatgcactgtaaatagcagcttcccagaacattccagtggaacttaattaagatagtcagggcattacccagtgtggacaactcctggaaagtgacatcggtgttacggtcatttgccttcttctctgagggctgtgaaaggtatgcagcggaggatagtggtgccgaagaagaaaacgaagattgtagcaaagacgtgttcgaggagctctcagaggttagacggataaactcctcggaagtcaacaggttctcgtccttctggaaggaactgagaacaagcgactttaggctagagaagattcggtcttccaaaataccgtacattctagagttaggttgggtttgcttaattaaccagttgaaagcaaaggcaaccatgtcgttagaagggagagtagtttgggcctttccgccatctgacgtcttcgggttgacagtacatctttggacaatagtcaaggccaagtcgttgatgttctttgtccacttggagttaccgttttcatcgacaacaatagctaagactcgcttcttgagatcattcaaattgtcgaatgagagcaactcggccctataagacaagttctcatcaaaacgaagaacaagctgcttgtacaacagtatacatagttgcaagcaggcaagttgtctgatatcggctcttagcacaattagtttggagttgtcaaatgaaagagtggatggaaactcgttgaccatgttgcgacagcttaaaaggtcaataattgaatggatgatggtatattgatgcaagttttcagatttgatagtgccagccaatttgtgatatgccttggagtaccaaccaagactgtcttgaatagatattttgtctcttttgatcatttggttgaagtagtccttctcaaagtcgatagctgtggatattaacaagggtttcatgatgcgaatttgatggttagccacatccaacttcattctctctaggatttggaagctgtagccaagacctttaataatacttttcacatcggcatccctttcgaagcagcttaacatgttgtcgacaatggaatctcttgtgggagcgcagtttttcttcaaaaccgatcctagccattggaacattggacagagttgaagggtaccatttttcaagttttggatcaaaagttcaatgtccataacgtcgattattttctgtttgtcttgttggggcattaggctcagcagaatgtctctgagggtaataaaaagggttggcaacttggaaatggccaagttgaagttgagatgtgactcaaaatagagggtgagctctctttcgatggacgaccaatacttgtcgatgtgcaacttctttcttttgcctctgtctccttctacgtttggacggaactgtaactggggatcaaatatgatgtcatggcgtaattgtgggttcttcaggatctcttgcagatcgatttctcgcagacttgacaaattcacaggaggcaaggggttggtcaacagaatggagcttgtgatgtcctgcacactgacacctgaaaaccgagacatggaggccttgttgttctcgcattggctgaaagtctgataggggatgtagggaaccgaacgagaacgaaaccgcttctctatagggaaagagtttgttatggaggaggacgaagtctgctggttgctcagatgaatgttgaggtcgtctgtgttgttgccggtcttttgctttgttggctggtggccgtgggagctgtgggagctgttggagaccatttttatcttcttggtgtgattgagtagctggtttaatgtgcgtttcttggtggcgcaagaatgggtagaagaagccgacgagaccgacgtggtacttgtgtttgcggagggagcggatgcgcttgttgatggagtagagtctgaatggggagggcctccaggggcggcagatgatgtgctggtggcggtagcagttgcggtggcacttgaattattattcgtcggattgctagctaagttgtcgttttccaaatgtgagctcattttattgcaaattcttgcgaagggagaatactttgctgggaaaattcgcagagggcagcgtagttgttttatggaaggtaaaagaggagaaaagggaaaaagagaaagaggtcagatgcattgaggttcaatttcgatttaataagtaagatcaagaaagaaaaaaaaagaaatgctgggggaaggaaaaagaaatgcagagacgttccttttttttgccgtataatttcagttgggcgggcgtccgttcgatcaaattagcctgcgcgcgcgtgttatcagaaaggacaaaggtgattggaggggatgcgaggcataatgggtagcaatgaagggatactgataagatgaacccaaattgtggaacgaacgccgttgtgcgagagccagacgttgggagaacagttgtgtcaaagagaatgaggaaggaattcaagtgaagcttcggaacatcttcccagagagcagagaacaccagagaaga

SEQ ID NO: 97 - DNA, 430603 bp, Pichia pastoris
cagagaacaccagagaagatctttcaaaatctcaagaaccaagatgttatgaatcgacgaacagtatgtaaactgtggttgatgttctggaaacgagccaatttgggctcaaacacattctgtgcttacacagcttaataactatgctacataatgtagggtaagttactcatcaattattcacacacacacaaaaagtgtctaagaccggaacgatcaaaaccgactttttcttcgataccgataccttggggacgctgtgtagatcctgttcgccttgcattttgcagctcagttagtcatttttttcacgacaactgggggcagccagaggggctaaataggcaaaacagcaaaatagcagcctggttcagtagtcactgtgcaattgtagaatgcgaacaaatgcagctgtattgttctgtccatgaccaaaatgtgttgctttggttgtgtgtagaattttatgtgggttgtgtgatgccggagaccaaagtggtaatcacaaccattctcggcaattgccaaattgggatttgctctaatacccgttacaattatctctctataccattctatgtttactctctaacaagcctcaaaattgctttgtggttcttctgtgttcactctcagtctagctcattgcttgcgccgtctgggttgttttctctccagctgttgatccattggatgattcgctcaacgttgtcgtccatcgtttccaggtcctcacttgacagttcaatgacaatctctggagcataagaatctttggcttcttgcaggatcacttgcattatttcacagtcaatattttctgtgatcttggaatcggggtatcctctttgagaaagacgatcaaagagaacagaattgtcgcatgtgaccacaaccaccaaatcaatcaatctctctggaaagacgtcgcagcagtgccaatcgatgattttaccgccttctctgagatctggctccaaggagtccaccaatttatcctcatccacgatgctactgtctctctcttggtcgaacccgtcgatacagcctctttctcttgctactttgctgatttctagatgctgaaagtgcgatctcaactcgtcgttcaagctctcgaccaagctctcacaatgagaggttttaccgcaaccaggagtgcctgttattatgatgttcgggtacaatctgctggtcatatttacactgaaggggaagagctgagataaggtttttttttttttttttcacgttctttacgcgacatccagcatttattttcaacttccatccaacattgaacatcgttttcttccctcgataggtacgtctccaactaaaccatccaaaacctgaccaacgatcattcatgtcagctgcagagtcaacacaggagtacgccaaggcgctctccgaggccctcaaaatgcccaacaacgatcagacgacacttttgataggaacagaactcaacatgttgggcctcccggatagtactgggctgatttccagatcctttacatccccatggctagagacttccagatcacaagtggatccaaattgcaagcaaatagaatcgttcaagttatccaactcagagcttcctgaccctgctatgaagatctccacgttcacggacgaaaccctgtttttcatattttacacatgtcccaaggatacgttacaagagcttgcgtcacgcgagttggtgaaaagaaactggagatatcacaagtatttacaggtttggttaactaaagattccaatcacgaacctgtgcctaacggattgaacagtgagagaggggtttacattttctttgatccgcataactgggagagagtaaagaaggagtttgtattattttaccagtccatcatgtagatggtctggctgggctgaacgtcgatatagaaactgcagagctttaatggggagagtagtgataacatgggaggcttagtggaatcctagtgatttgacttccgggactttctctcgccaactcgtctgttgtcaatcatttacgaatgtataactaagaggaaggataatagtgaccaaaacgtattatttaatgatatatttttaccacggtaaggttgtctccccatatccgtagcatggatcaagaatccatctattctgtctttgcctacctcacgccagcctctctcctctcaccttgcaccttctggcaatcagcgaatttccttgaactggctctgtttttcaacgagaaaaatttcagatgtccctcaacaacatcatgttcatttcaaggctatttgctacctcaagaaggtatgcctcctctgtaatacatgtcaacaacagaatatcaaactcctttccattcgggctgtccacggccaaatcggtttctccactcaaatacatcgaacctcaatcttcaccagcttccagcatagaaatgctgctagactctgtcatgcgaaagagaagactgaagatgaagaaacacaagcttagaaagagaagaaaggcgcaaagagccatgagaattaaattaaagaaataatccataacctgtatatatacgaagagatactattcctcaattggctgtagagtttttgactttctgatggagcagggaacttctgtgctcggcacatgtttagtacggatcaattagttgcaccttttcaagtcacaacgtcacatagttcatgacactgtagatgtatggcatcctgtccatctgactgccactagtctctttgagctcgcgcgcctagatgcactgatctcccttctaggaatcggcccttctctcgctcatctcgttccttttgccggatctgccaacgtatttcaagaactcgttcctttctccgatctcccagtttataggatcctttcccgttcaaaaatggcccctcaaatgaaagggctgatgcaattcatctcagacgttcgaagctccaagaacgctgccgaagaaaacacgcagatccattcagagttgatcaacattcaaaatcatttcaaagacaaaaacctgtcgtcctaccaaaaacagaagtacgcctgtaagttgatctacatttgtctaaatagccaaaaaaaggataatgtcgtgaatttagactttggcctgccgcattgctgttcaatgattgaatcggaaagtctgagtgaaagaaacatcggatatttagctctccaattgatatacgcatcccaattggagaacttgagtgaattcaatttgttctcccatttagaaaggaacttggattctcaccaagaagacaaggttgcccttgccctgcattttcttgccggtgtttattacgatgagttattcactactaatgaactggcgaagatcattgagttgctcctacagttgatcagagcttcgaattccagtgtcttggtcaaaaagaaatcttctttagccctacttaagattttaagagactcttcagagtcggtcaaggttcatgagaggtttattccaaggatcttatccctattagacacggacaacattggactcatgatctctttatgttctttggtccagcaaatcagtaaacatagaccaaaggcgtgcatacctgccattccagtattgattcagaagttagaccagttgatcgaacagaaggacatcgaatcggattatctttacaatgggttcccatctccctggttaatagtgaagattatgcgactattggaaactttggtatctgataactttgaacaggttgatcaattgcaaatagagcatcttaaccggttagtgaaagactcaattgctttggtcattaagttatttgataagaacgataagaatgccaatcctcagttcaaaaattcaatattagcggtcttatttcagtctatcagtctgggttcttgtttagactcttcattgcagtctattagcgtggcttttgatgctcttgggggacttcttcgttcttcggaagttaatacgagatatctggttttggattcaatgattaagattattcgaaataaccctgccagtaacatttacattgagaaggagacctctaaatatattgaccagttctttcaatttttgtacgacagagatacctctgttcgaaaaaaatccactgaggctatcttcctgtcgacaaactcaagtaacattgtgatgattgtgaagaagctttttgagtatttgcccagatgtgactacaccttgagacctgatttaatactgaaaatttctattctgttggaaaagtattctacagatgctacgtggtatgtgcaacaaaatttgaagctggtatttttgtcaggaaattacctgaaggatgaagtatgggaacgcgttgttcaaattaccatcaataacgaagacattcaacttacgacagctagacttgtcttggactacttgaaacaaaaagaatttcccgaaacaatgctgaagattgcagctgtggtatttggagattaccatagatatttaattcaagtccaatccccgctagctcatgagaaagagttactgagtttattataccacaagtatttttactgctcagtgcaaactagagccatgttattgacatgctttatgaaactctttattgcatacgaagatctaaggccaagaattttagacatcattgagaaagagacgtgttccatagactccgagatacaacagcggtccgttgagtacttgcaactttccaagccacataatcatgcactattggcaattcttcttcaggaaaatcccccgttcactttgaagagcaagttgtactcgattccaaacatagagaaaccgccagtgccacctccttcaagaaaaagaatgctgacctccaattgggaggaaggctattacagattgattaattacaaccagggtattttcttcgaaaactcgttgattaaaattttattcaagtgtgagaaggacagacacattctttcatgtcagttaattttcatcaaccaggctcctactgacattactggtttcactgtgtctatcgacaacgaagccaccaagaatttcagtgtgcaaaacttatcattgcctgacagtgtaattcctttgggtaaaagaagtgtgcataaatttcaagtcaccgtgaagaaaccatttgtgacgtccccgctgattcatatctcatttatgtgtggaactttaacgtcattaactttcaagctgcctacctgtctactcaaatgccttcatccacaaactttgtcctcgttagatgagtatagctttcgttggaaccaaattgcagggttacagtatggtgagtacgctactgacgtcaaagtgaagcacagattatcaagagaatcgttgttaagaattcttgagaggattggagtatcattgattgatagctttgatcccaacatcgttctgggggctggaatactcaacactgaagcatccaactacggagtgcttctcagattggagttgggtccttcagatgcattagcattcaaactgataataagatgcactggtgataacatttcacacattctggtgaccacactagctgatttattcagccacggtgtataagcatggccttctcaaactacagttgagctgtattatataagatagttcctcccataatgatcaatttgatcactgcaaaaagacaatactacatagagagtgctgaatccgattagaacttatcatctactttgacagaatataccaaagtcccctacaatgtctttcctctccttctgggattctgggcttttctcgaatgattcaatcatgtgaatattttcctatgcttaagcactctgtaaaaagattgatcctccttcgaacgatgtctaactaccctaaagcgactgaagaaagatctaaagagcttttagagaatgttaatcatatattggaccagataaccagtgtaaagtcgcccaacgggaggcctgtcaacttggtttgtgtgtctaagctgaaaccatcaagtgatattatggcactttatgatgctggctttcgccattttggagaaaactacgttcaggaactggtttcaaaagcacaagagcttcccaaagacatcaagtggcactttattggtggtctccaaaccaataaatgtaaggatttagctaccaggattgataatttgtatgcagtggagacaatcgatagcatcaagaaggcgaataagttgaacagcagccgtgatgcatccaaacctaaaattaacgtcttcatccaggtgaatacttccggtgaagaacaaaagagcggcatatcctcttatgacgatcttctcgcattggccaaggtgatcaagaatgattgccccaatctcactttgaagggtttaatgaccattgggtcaattcaacaatctacagcagccggtgaaaggaacaaagattttgaccagttgacggcacacaatgaaaaactagaatctgatttaggaaccacgctggagctctccatgggtatgagctcagacttcgagcaggctataaggcaagggtctacaagcgttcgtgttggtagcagcatatttggtgcaaggcctcctagaaatgggcattagaacgctacatagagtgtacatatttggtaggactgttcaagatcaggtaatatttcaagggctctagcccgtttttcccccggtggtggatgttccctaccagtcgattttgttccagcctcgaaaggaggtacctaccatatttttttatcaaagccagccgccataatctgatccacctgtcaaactattccttctgcttattccaaaatggcaaagaaaaaagcggctgctaagcgtcccaagaagaccctgccgcctgcatcgtcgaagcctttaaactcgggggagaatcctgacgagagccaggcagaatattccggcctccctcctccacaactcagcttcaaatcagccattgtggccgagatgacctcggtgataagtaatggaattaccattaacaaagttatccaagttcttatcttggcctacattgcgaacctgctctatgtgaaactcgatttgaactttgactacgattccaaggttgaaattgggattggatttctaagtattctgtcttcaattttgattatttacgtttccagaaaaagaagatggaatacaggagtggaattgggctctatcgacaaggacgatccagaaaaatgggttgaattgcccgagtttaaccttatttacgcaattgttctgcccatttttgtcacgtacatagttgataagcgatatttgggggtcaacttggtcaatatactgttggtgatcgacatcccaatcgcctttaagatccttttggctctttcaatggaacagcaggttcttgatgaaagtgggtatctgaatcaggggtttgtgactaccaggaacaacttgttgataccagtagctcatgttggatttagggaattactaggatattatggcggatcatcattttcaaatacagaaagtgaactcttctctactctgtttgtcaatttggtgttatttgttgacaaatccaacatcgagctgtttattttggccaaattgactcttgcattcattggttcattggtcatttgcactgcattgtaccgagttctcatacttttttcaccaaaatatgttatttcgttgatactgcacccggttttcactgctttggtgtactatggatcggtatatcaattagctccggttcttggtaaacacccatgggactacttggtgaatgatatcatgaatgagcagaggattcatttcctttattcttggttgattctactggtggtagtggttcctccagttttctactttgtggatgcgattcctttagattttagaagaaaaatatggcatttcacgatccttatcattttgagttaccccttaagtatcgatccttcattttgtgttatagcactggggggtgtctttgggctgttcttggtggttgaaattttaaggagcaccgaaatgcccccctttggacaaattctgagcagaaatcttgagaaatttcaggatgaaagggataagaggggcaacataacaatctcctacttatacttggtgctagggattgttcttccggtgatgtttgatggatccagttgtgcgggattggttagtttgggattgggagactccatggcctctatggtgggtaaacggtatggtttggtgaagtggcctggctctaacaaatcggttgagggaacgtttgcttttatcgttgtgacctttttgggacttttagcggccagaaccttctttggctatcaattctcttgggagatctccttcatcgcagccgccctggcaggcgtgttagagggtataagtgatttcaatgacaacatcatcatcccactagtcgtgtttacaatattgcatggtcaatagaatggttatagtctcttaatatatagaaggatgtatatataaaaagttgactaactatatagagacgttttatactaaaactgatatctaaagtactactcattcgctaccccaaactaaaccttgttggtggagcaagttgtgtgaatggatgactttgccaagctcaaattcatcgacttgtctaccttatgcgtttccaggaataaacacctgaagcttcccgagcaaaactctgggcaactgaaattttttgagaagaaccagcacttctttgatgtgcgagtgtatgatgacatcgcgtggaacaattatctcctagaaacaattaaatcaaacaccgacggagtagttatactatttgactgctttttagaatggcacaagattcagccgatgtttctgaggggctcccaatctaatcatttatttgtcgtttcggagtttactgcaattgaggaattgtcgaacaaactctccaagtttgaagatatcttgctcaaactggatgtcgaggcaaggaagttaccacttaagggcattgtgctaaccaatatgtcagtttattactggcaatcaaaagataacggtaaaaagacctggttttctgtggttgaccaattggaacgattgcaggccaaatacgggtgcacgattatacgtggaatgtgggactttacctctaaaagggaataaacgctactgcctgcaattaacaatgtcttttgacccttgttcattcaaaagctaaggctacacatccttcttgctacctttaaactagaagacactatttccaaatcaggaaataacatgtccacttttttcttcattcttctcaaattttttttttttccctttaaattcttctctctaagaaagatccctaaacccccgatcaatgtctgaagaacaatcaaaaaaggagatcctggagcaagtggaattttacttttccgactccaacctaccaaaggacagatttttatacactacagcgcaggccaacgaaggatgggtgtccatctccgtactggccaactttaccagaatgagaaagttcagacccatcgagctgatcgttgaggctctgagagagtctgaaaaccttctagaggtcagtgagaatggagaaatggttcgcagaaaggtaccattgccatcaagagaggaacagatcaagattgcccaaagaagcgttgttgtggaagatgtcccagaagacgcaactttggaacagttacaggaatttttcaaaaagtatggaaagaccaatcaggtcagaatgaagcgaaaccgtaagaccaaggaattttttggaaaggttattgtggaattttcatccgttgaagaacagaaagcattcttagaggccgagccgaagccaactttcaacgagaaagaattaaagatcacttcaaaggtcgcctacgacgaatcccgtgaatcaaagagaaccgctggtttcaacggtagggacaaatccaagggaaagaagagagttaaccaagacgacgatgaatccaacaagagagttaaggacgataaagaagtggaagccgacaaggaaaccgcagacgatgctgcaaaagaggccggagaggatacagctacagaaccagaaaagactgaggtcccagaggaaaacaaagaagaatcaaaatagaataatgtgtacgaatataattcccgttgttattactaaaatctgcttatgtaatggtcaatagttgacatcttacttagggacgcgctttgaaaagtagacgcgtctcttcgtattactcattggtattcaaacaccagtaagccatgactgtaggatcagaaattctctccaagttcgggaggaaagcagatgatcccctcataatacagaaatgtgaagatctgataggaatattcaatttttccgtggaggagcttttcatcaattgggagtcctatgttcttaccagtgctagcgatgtcaatcttcagctatccccagagaacttggaaaagctgaaagattacttacagcagaagctggtgcaagctgcagctcaaaagaataatagtgccactccgatgatgaaaaacaagatagttaggccggttgccagaggaaatatcaacggttctagccctctgatggggctgaatactccctccactccagtcagctctcataagaaaaggaaacttgtcacccccagcagctcttcggcgaccccatcaaagcatcctcccagctcttcaccaataaagaaatccgttcaggtttcaggaaagatcattgaatcattgaatgatcatattccttccattggtggcctccaaaatgatactgatcatacaccaaatatttcaacttcgaacgtcacactaacagcaaattttgatcctaagaaatatcaatttagaaccatgaggcagaaattactagacacggcagatgtcctggatgaacagatagattctatggcaaagactttgcaaaaacatcacaaaattgcagaatcggattttggaaacccttgcatagcctcccagttttctgtatattgttgtggaagaattgtgcctgattctccatttgctccagttgaacttcgtctgaatccagattcgttgtttttggagacttcaaggttaggtggaattgggcagagaatttctattgatgttcaatctttagcagaatactctttctttccgggtcagattgttggtttcaagggaaaaaatccaagcggagaacgcttcatcgtagagcaagtgctggacattccatatttaggggccccagtcagtaacaaaactgagttattggagtacaaaactaacctcgatggatcctctatgaaaaccacggttctgtctggaccatatactccttcaacaaaaattgactattctctattggaaagttttgtgcaaaaactaaacaccgagatcaagcctcattccgttatcatgtttggaccatttctagatataacccacccttcgattagagatggttctatcgagtcggttccagagctccagggaaaaaaagtggccactctagacaatttcttcagagctgtgattacacccattctgaagaaaatagattctagaattcaggtgattttgattccttcaaccagggattcaatcagcagtcatgctgcttatccgcaaaattctttcgaacgcaagtctctacagttgcccaaaaactttaaatgcttcccgaacccatgttcttttcagttgaacgaatgcctcataggcgtctctaatttggattctttcaaagatatcaaggacgtgaacagaggtaaaattggagacttgaacagatttgatcgtatagcagaccatattcttcaacaaagaagatattatccgtgtttcccagggtctttgaaaacaagaaaaggccctgatggcactgttgagcatatatgtggtgcagatctagatatgccctatatgggactgtcagaactctacgacgttcttcctgatgtattgataattccttcagagatgagatattttgttcgggttgtgaaaaacgtggtagtcattaatcctggttactttttaacaggcaacaatgctggaacatatgtaactctgtctgtgaaacctccaaaccctgaggtggacgatgatgacctcacctgcattaacgacgacgatcgactatacattcataacatctggaagcgtgcccgagtagatataatcaacgtataataataatatttgtcttctacaaaaagatctgataaagttatgcatctaaagtcctttcttgaaaagtttcttcagtgtcctgtgtttcttggaaggggtgcctgaattctctgaatagctggaagaagagttggttgtctgttcaacagcatcgcttacttgacgaattactggaggcgtgctagtgatttcctgttccgtctcggtcttgcttgcagtgactggtggatcttctgcgattggagcttttgcggttggagcttctgtgattggagcttctgaggttgaggctgctgcttttggtaatggaagagaggtcctgctgttcatatccttaggaattgtagctccattgagaaccgaactgccgaccttatctgcagcatgaatattatcatcaatagtgctgaccactttatgtccagtttcctcttccttggcaatcacaaagttgtcattaacaccgaaatcagggtcttgctttaaattggacttggattcttcaacggaactcgagagtttctgcgttgagggaacggttgcatttgtttctatcgaagttgatactgcctttggctcttcattgactttggtccttttcttctgggctgagctcaaatctgactgtaattctacgcttctagttaaaacatcagcaatgatattggaaaagttagatatttccaagtttgagttctcattagtctcaaaaaatcctggtactgttttgtttatgagctcctttctaatagttggatcgacacttacaacgtctcctctgtcggtcaatcgctcagaatctgttgaggaagcaacaaaagacctgatgacgtattcagaaatgttcaacaaaagagatacaatgtgttcagtaaacagagtaattccaacgactttccaccatttgatttgccccaaagctgaaccagatacagaagaaacgagctctctattgtacatcagagataatgcagtggatgtcactgcactgagtacgatcagccatctaattatcaaatcccaggggtaaatcgagtctcttctttccggaataggcacacgtccaatcttcagggacaacaactggaacttgtaaataaaagttctagcgacaataaaaataagagacacgattgggcccagagaccaagcaggaccaaacaacaccaagtatccaaattggataataagcgttctgtagttggtatcataactgatttctggaagagcaacataagacctaaccaaggtcagataatcgtgttcttgcggaaaaacctcattgtctctcttttcaatggtcttgtcagacgaggcaggttggctcaaaaatcttgtagcaatgtttaatccagcaggcactacaaattctaaaaccaaggcaacgatttggttggtcaatataaagtattggaattggccgttcaatctgaacctgttgacctcaaagtttttgtccaatactggaattttgtcactaacatagtaatggatgttggagtgaatgtgaggaagcaggctgttgactttgaaaccaaagggaaggtacacgaaagcactaatcaataatggaacataacttgcagtaaagttaaatgcaaacagtttgatcaatttcgagttcttaagtgaagaattgttcggatgttgttcccagtttaaagatcggtcaattatgacattgtaaatagcagcgataattggtgaaactccaacaattaaagccgtaggaacaaagcttaggaactttttaaaggggccatcgtagatctcgttaagaaaaatttcaataacaaagcatccaatctgtgcaagtaacaagacaccggtggatagcagagcagcagggacaaaagccaattctttcagaacggtcttgtacacgggaacagatggcctcttttgttccaaagcattgagataactaacattggtaggttctgtaaggctgatatttctaacatgaaggttcagagccaactttgattgaaaaacgtaccagtaaagataaaatgctatagaagacagcaaattgaagatcgtgaaaaccaaagagtatcgtcccaagaatttgtgggagaggatgcctacaaagctggttactataagccaattggtgtatttggacaaaaattcaaagaaaaaggcaacactcaggccaaacttggatcgaaggtaatcgaatgaagaagaatcgtaagaatcggcaatttttgtcaaattcactccgtactccttcagatcattaacatggtcagccaagtttccaacagcggtgattgacttgacaaatgaccaatcaccagagccaacagtaatcccagcaccaccttcagaagggtgcttggttaaaacctcatagataattcttgccttttcggcataagagaccactgtacccttttccaattccttataagaactgagtagtttgagatcattggtgataccatattggtaatcaagggccaatgagctgttgacgtactttaccaagctgtcctctttgacggagacaaaaaccaagatagagttcaaagtgttctctctaatctggaagtcgaaggatttcttcaaaagggaggccagaagcttcttcaaatcatcttgagcattcttggtgggggtagcagttttagcatcaaatggataattgacgtctagaacaaagtcgggatggaaggcttccaacgggatctcctgcgcagacattgtttgtatacaggactataaggaacaacagtgagttaataagcaagttgcacttttttgaagcctaattgagagggaatgaacaagtggttacttgctaatttcgtaataataacgcctggaatggaaagcgcggagaagcatcaaaaaacaaaacgcttgtcagcagcgcagcgctaaagctcacacgcgccttaggatcgtggaacgattaggctgtctgtgcccttagcagaacgatatggagggagggtttcttcgtacagaccagacaggggcgatgtttattgaggacaattttggagttgaaagtatggagggtacatgattttacagtactaacgagttcaactgagttgaccaggaagagactacagaaagccgtttcccttttattgcgtgtatgaattggcaatggcagttgagctgagacaggctaaagcagtcttttttgagagctgatgtaaacacaccaggagtagttcactgctacggggctgtcagataactgtggctgaatggtagatattgccatggttttaataccagatcaatggcaggtacaggcatactatttcatcacccagcaatcaatgttaggatgccattgcaggaatgccctgctgatactacgcgcaaactgcctccagtttggtgtagtttgctaaccacagcagaggccaaacagacataacgcaagttaatacagatcaataaaaacatgagatcagaacctacagtatcaatgaacaacatcatagactattcttactaagtaaacacattacaatgcctttaaaacgctgtcaacagcagagaccttaagtccagtgttgtctggttcaacaaaatccttggcgaccttaccatcggaaccaatgatgagagcgcttctcttggaacgattgttaccaaagacagcggcagaatcaaagtccaggtccaacccgtggatgaaatcacccttagggtcagccaagaaagtcactggaacttcagtcttgtcaatggagaagctcttcaacaatgtcttcttccaggcattggtcacgaatgggtcattgacagacacaacatacagatggttgatgttcttggacttgaggtccttgagtctagtcaaataacctggaacatgggtgtccgaacaggtgggtgaaaaagcagcagggacagtgacaattacggagttgggctcaatggagccagactcgaattggtcacttggatccttaacgaaaagggtggtcttgggaagagattgtccgacttgtaccattcttgctgaatttgaggaaaagtatcttctaagcatctagaataaacgggatgggcatcgaagttaatttatagggaggaactttagctttgactttgctccggcataactaatgttgggatgtagtggggaaggggctgtttgcggtattgcgtaatgtgttgattatgtaatcataagtaacttagatctgtcattaaagtgatggctgaaagaacagcttggctgcgatgagtatgttcctctctgtgtttgttcggagactgggaaatttggcgcagtacgttaacaagaggaaattgttagatcatggctggattaaagccgacaaattgttggaaccgccgtttaacaagttttacaaggtgagcttctctcggagttctgggcccggtgggcagaaagttaacaaaacttcaagtaaagtgaccttgaccgtagaccagaaccaattttatcagggcgtcaagctgctcttgcccccggatgaattggtgaagccgtcaagtgctgtggatgaaaagcaagttcgaaaccaattgctgtcacttctctgggcaaataacaggtatttgaaaagtcaagggttggtgattcaaagtgacgtctacaggagccagtcggagaacttgaaggaatgcttggacaggtttctgggtgaattgcagaatggtttgaaatgtctgggtctactagacaaggagaccagtgaagaggataaacaaaagtgggaaaagcgtcatctcctgaatagagaaagacggcttgcagagaagaagaagcattcagaaaagaaaaaattgagaaagcaggctttttggtgataattacaactcccaaagtacatagcactatcaaagtacacagaactaaacaacgaacagaaaagtcaatcccttagaccatttttcctacatcatttcattcattgatgtattttccctgccagacatccctaattcctatcaaggaggaaatgacaccggccaatccaaccttctcatctttgttttgtaaggcaaagccgttaagagcgatataaccatccaacagatccctgataagagttattgtcgtgctaccaatcagtttggattctgactcgattaagttgatggtctccttggagactgtttgttctccctccttgtctgaagtgacaaccagctcttgtttgagagaggccactttctgttgagacaatctgatctttctcagatcattgactgctccaccgacaacggcgacgaaccaaaataatgaggccagtttttgaacttgaggcagtcttttagtggaggagataccgagctgcttgaaccaggaaacagagtccaatgccaggtagacagcgtagccgagatctcgcaacacctgtgaatatctggtgaccttgtcggttagtttattgtcaaaagttgccgaagcagatttgaggtggttcaggggcttgaggaatctcagagccttcctgttcaaggttgcaatagcctctattcggcgtactgtctgggcagtaacaattgaatgtccattcttgatcaggtagaaagagacaaacttggttaaatattgcaacagacggagcaatttgtctctacctgccgagctgtccagatactggataaccttatccagtgtggggtggtaaacaacagtgtctaaaaccatgattaagagaaagtccaagtcgaagccaaaagtttcagtatcagtttctttgatgtaaaaattccgattccacttcgaagttcaaacgggatttaccatatataaagggctggctctggaccaggttatgttgtggggttctacagcaataggctaaaatgcggtcctgattaaactttggggtggttctgctaggagcgaacggtaagttcgtggtgcatgtgagaggggagggcagttagaaacttgccgaaaggcagagccaattgttagggaagcgcgggtaattttaacgtgtcttatttctactgtcacgctggttaaggtttttacatcagcatctgggataaacaatctctcgttgcatcgcataaccaaatcccctttgatactcatcatgggctactacgaccttgatgagatactggcggacggacaaaagataccgtgtcggtttacgatttctgtgccgggcctcggttatttagagaacaacccggggaagcctgtgattcagaacaccaagttggacctaccactgtggttggcagagattctggcaatttgtgaaatacagagcgaacaaaatgacccaaaagaagatccagatcaaccaacctatttcattgagcttatccagccggacttttacagctccaagatcatcaatgctatcaaaaccaatgcgttgaaaatcgatttgcatcaattgttgccctatttctacaaactgtcagtgaaatggggaagcatgtttaatgacacagaactgatggctattgttcaagagatgttcaaacagagggcatgtgccatcaacgattactcgtcagataataaccatttgcaattgctaaactcagagtttgggctgcaattggatgagactgaacggatgttgttccgtcaatgtatagagagtcacagagacctgaaaacctggctcagttcataggtgtgtatattaataaacggatggaagaacggtcggttaagtttgctcttttcaaccgtgagaataataaaaaaatatcgtcacagacaggattcgaacctgcgcaggtagaacccaatgcctaaactgctttctagcgaatagcagggcatcgccttaaccactcggccactgtgaccaaagacaacaaattcgaaaaacattaacctaaatggagtaaaaaattaattaataatcttttactaatttttcaaccttcagttctaaggacagctttgagacaaaaatattaaatttacaaattatcgaccaactatctagtgtttaattgagttcacgattgaatacacggtaattagtaattacttagttttaaaaatagaaatggccaatgtcagtttcaaaatgcactcttcaaacaccataagccccatgaattccgttttcctcccgtgaaaccaataaagcccacctagaaactcaatccactcctaatccctttttcctcaactgctcagcctgtccttaagtagtcccccaagtctcgtaattttccatgcttatcaataagcttgacaacaacggccacctgccccccactcgactggccctcggagcaaatgtgcttaaattcccctggtaactaaccttctatgcatcttgcacgtgatctgtgtttacatttacgcgaaccttagaaaagtctgtttcaaaggagagggattccataacattaatacctaccaagcaaaacaacaactggaattcgtagctctgagagaaccaatcagttttatcgttccacgtagcttgagacattattcatgaaaatcgacaagagtagaaatttcctttaaaaattcctatcgttgtgtttatttgctaatttttgaagaagagtccgcaatatgagtgaccggccatttttggagtcttcaccgtccaagatgtttgaccctctgttgtatagcatcggagaggatccaagcataacagacagtaaacagaggctcaaacctggcgatagagatcgacaggggagtgactccggtggagtagcaatgaccaatgggaatgctatcactggaggatcacttcaaggtttagtacctacagttaatactaatgttattagtactggaagtggatggactccttttattgaaagagctaacaacgacttatatctcaccaaattcaatagcttgaacatgtcttccccgtccaatcataatcatctttcccaaactcctaacaacattgagaagtcttttcagttcgcagatttcctgatggataccccattaggagcaaacaattccaataacatcaccaacagcttcgactcccctgggagtttttaccgaactttgctcggaggaagtgccaagaaagaaaacatcgactcctcactaaagttctggaaaacacctttgaaaacaagtagtaaccaacttctcagtcagttatctccagggctaataaaaggcaccagtaatgtcaataacattctttctttcaatactccctcgagagataatgcagggagaacagtgattcgtgaacgcatatccaacaacaatcaaataaccccgaacatccatgaagcttcgtctccgtccacaatcgttttaaagagctcagaagttaatacagcaaagaaaaaagatcataacagtactaatctgcctgatgcaagcgtcatggtatctccaactccggccaagattgccaaggtgttaccaactaaagttggcccagaaggaacctctatgggtcctgtgatgggtatttttgctgattcgaagcatcgtcaaccattgatgcccaaacatttgaatcaaggacaattcaaccagaaacagaaactcaacgtcaaatcccagaagcaagagcaggcaggtcccaagaagcgacaatgggataacatcgagagtggtatgaacaaatttcagattgtatttacagacgttaagcagatccacaataggtctcagaagaaacgtcgcaacaataacaaccagaatgggttaaccagggcgaacactgtgggagcaatgtcgaaccctgggctcccacggccaaataacactcagatacgttcggaacgagccatttttcgatccgtgtcagttccagaccagcagtttaactacgcaaatccacaggaatttctacatcacaataccaatggtaataccacgacgtcaaggaatggaaacgacgacttggaggaagacttcgtcaacctcttgcggagtacccgaggctaagacaataagaagaaaaaaaaagaaaagcggtgggggagggattattaaataaggattatgtaaccccagggtaccgttctatacatatttaaggattatttaggacaatcgatgaaatcggcatcaaactggatgggagtatagtgtccggataatcggataaatcatcttgcgaggagccgcttggttggttggtgagaggagtgaaatatgtgtctcctcacccaagaatcgcgatatcagcaccctgtgggggacactattggcctccctcccaaaccttcgatgtggtagtgctttattatattgattacattgattacatagctaaaccctgcctggttgcaagttgagctccgaattccaatattagtaaaatgcctgcaagataacctcggtatggcgtccgaccccgcttaattattttaactcctttccaacgaggacttcgtaatttttgattagggagttgagaaacggggggtcttgatacctcctcgatttcagatcccaccccctctcagtcccaagtgggacccccctcggccgtgaaatgcgcgcactttagtttttttcgcatgtaaacgccggtgtccgtcaattaaaagtcgcagactagggtgaactttaccatttttgtcgcactccgtctcctcggaataggggtgtagtaattctgcagtagtgcaatttttaccccgccaagggggggcgaaaagagacgacctcatcacgcattctccagtcgctctctacgcctacagcaccgacgtagttaactttctcccatatataaagcaattgccattcccctgaaaactttaacctctgctttttcttgatttttccttgcccaaagaaaagatgcttagaacttctccagctactaagaaagctctcaagtcgcagattaacgccttcaacgttgctgccttgagattctactcctcattgcctttgcaggttccaattaccttgccaaacggtaagacctacaatcagccaacaggtttgtttatcaacaatgagttcgttccttctaagcaaggtaagacctttgctgttttaaacccttccactgaggaggagattactcacgtctacgagtccagagaggacgacgttgagttagccgttgcagccgctcaaaaggctttcgactcaacctggtccacccaggaccctgctgagagaggtaaggtcttgaacaagttggctgacctgatcgaggagcactctgagacccttgccgccatcgagtccttggacaacggtaaggccatttcctccgctagaggtgatgttggtctggttgtcgcctacttgaagtcctgtgccggttgggccgacaaggttttcggtagagttgttgaaaccggaagctcccacttcaactacgttagaagagagccattgggtgtttgtggtcagattatcccatggaactttcctcttctgatgtggtcctggaaagttggtccagctttggccactggtaacactgttgtcctgaagacagccgagtctactcctctgtccgccctgtacgtttcccaattggtcaaggaggccggtatcccagctggtgtccacaacattgtgtccggtttcggtaagattactggtgaagctattgctactcatcctaagatcaagaaggttgccttcactggttctaccgccactggtcgtcacatcatgaaggctgctgccgaatccaacttgaagaaggttactttggagttgggtggtaaatctcctaacatcgtgttcaacgatgctaacattaagcaagctgtcgccaacatcatcctcggtatttactacaactctggagaagtttgttgtgctggttccagagtttatgttcaatccggtatttacgacgagcttttggccgaattcaagactgctgctgagaatgtcaaggttggtaacccattcgacgaggacaccttccaaggtgctcaaacctctcagcaacaattggagaagattttgggtttcgttgagcgtggtaagaaggacggtgctactttgattactggtggtggcagattaggtgacaagggttacttcgtccagccaactatcttcggtgatgttacaccagagatggagattgtcaaggaagagatctttggtcctgttgtcactatcagcaagtttgacaccattgatgaggttgtcgaccttgctaacgactctcaatacggtcttgctgctggtatccactctgacgatatcaacaaggtcattgacgttgctgctagaatcaagtccggtaccgtgtgggtcaacacctacaacgatttccaccaaatggttccattcggtggatttggccaatccggtattggtcgtgagatgggtgttgaagctttggaaaactacacccaatacaaggctatccgtgtcaagatcaaccacaagaacgagtaaactgagtatttatgaccttatatattattaacgttcaatgatcatcatgagtgaaaaatcttattattagtcgtgttcttattgtaggcagccatgattctctctacatgacctaacgggttgtgtaatgctctcacgctctttactatgtcacccctagtcattgtgcgtcttctctttggatgtgaagaagtgtcgtcgttttcctttctcttttgacgactggggtcgagcgagaatgattcattctgtgcggcagctgaaggatgggaatgggtccttcgcaacgtttcacctgtgctctcgttgagatcgttggccactgaagactgtgctggccgtagatggtttccaggaaaggatcgtggctctgtaaaataaggtttatctttgatgcttgagagccggattaaagaggtataattactctctggtgtactttgtgtagtgctgttgccgtttgctgaaggtgaactcttgttggaacattccattatgggtgttcgccttgataaacttgaatggtcgctagttagtcctacttttgtgattgcttttggggtctccaattgtccgctggaagggggatcttgttcatatccatgtacaaaggttttatcgcgttgaggtggtgaagcatcttgtttgaccagcatcgaaccagtcttcttttgcgaatgagagtccgaattagttgtggcaattgcatctccagtagagcggctgggctgagctttggaaagaatgctttgaaaaactccccaggcctgcttccaacttgcttgggaacgggtatgagtatctaaaggaggagtaacagacgaggagggagtagacaaaaactttgtcgaggacgaggagaaagactgttgagcctgagtcgcaggagcatctggtcttctctcagcgtcattagacgtttcatgccgtgggtcaactattaatatcggtgcattaacaccacctgaggggttgtcttgattgaactgacgattgatttcttcggagccgccttctggtcccggtttgtgcatatcggctgtcattcgtttgttgactgtctcaagaattctcaaaacaccaagctcacgcataaatcggatttcgcttccacttaatagacccaaatcactcaggatattatcgagttgtgttctgtgttcctttgaaaaatgttggacgttatccatcttttttccaaaatctttgattttttcgcagaacaaaatagcacggcttgattgtatcgcaggctggggaatccttgtggaggtggtttcagatgattcagaatcactaagaataatagtctccgtcgccttgggcgtcttgttttcaggtaccatttcagacttcatcggaggttcatccatttcttcgtccgaactgaggctaattggcggaacaggaacggcttctggagcattggtatcgttaggtctaccaagtagaatggtaacttcatcatttttgtcatcaagcaagtgttcttccgtaggttctataggttcaagtagtttttgtagttgggtagcatactttttgtagggtcccaaaaactttacttgcatttctttaaataactctctggcatgtgacaggggaatccatcttccattaagggttgttgctctgccaaactgaactctttcgaaaggaagagaatacaccatctgatggtaatataactcattatctacgtttgtatcattaggagacatagccttcctcaaagagcagcagacatttatcaggatagacgcattgacccaggaatcagattttctttttaataccaccagctttttcgtaaggcctctcttgacattgcaattcaattggactgtgtaacatacatcttttagtgtaatcggttttgaggttttggtaaaattcgggattctgaaactttcaggcagtccataaaaaactgagttattaaaagattccacaatccacgtatttgctagacgttcctctacgctgttcagtggaatatattccttagcattcattactgggaacgtcgaaaatcccagaatcggatctgtatgctttccaagacccctctcgttgctgaactggcgagctacgttcaatggaacccagaagcctcccaataaagtatgttctgtggactctattcttactccttggtagcatttcaaaaaatgtctccttatattcttttttacttcaccgtctggagaaacaagcttatctagcaaaaagagaccctccatattgaccatattgttgtcgcatcttcgtagaatacggacgaaaacgtcaaagttgatgatcacaaacatctctagcaattgtactccgcaatgattaacctttgccactctatcaaaccccaacaagggtcgcagctgatcatatatggcatatttcctagcaagttctcgagctctattaagtggaacccaacatccagtataagcaatgttgatactcttcccacgaagttccaatacgttggtatcttgttccaattctgccctaaattcattcgtacgagtcgatctgaccaacgatagataacgtgtaacgttaacccagccaccgatctttcttcttaaataagtccccttaacacccgaatatttgaatccgtagtactcatggttatccgataagtaagtgtccaacagatccatgctgggggactgttacttagtagggctgatctaaatcaaaacgtaatgccagctggtggagtgccgggtacaattgaaatctgataatagtcgcgcatctcactttgaataatatcagcatcaaacatccctcactccacctacccactacagaggatggaagactcatccaaggcaatggtttattcagccacatactctggggtgccagtgtatgagcttgtgacacccttgacatcagtgatgcgtcggaaaagtgatgattggataaatgccacccatattttgaaagttgcggatttccccaaagctaaaaggaccagaatattggaaagagacatacaagtgggcacgcatgagaaagtacaaggtggctatggaaaatatcaaggtacgtgggttccgctggaatctgccgtcaagatcgctgaaaccttcgatgttagggacatcctagagccgcttttcgcctatgtgcagaggaaagggtctccatcaccacctccagctccaaaacatcagaatgcttccaagggatcagctgccaagaagaaattggaattgaagaagaagcttagtgcagctgctggtaccgtcccagatgagaaagtcaagaggagaggaaggccccccaaacctaaagatgagagtggaaattctaccacaatcttggacagtaatatcaaaaaggctccttcgcaaccaagattggttcgaagacaacaaagctctaatccaaattattacagaaatcaggtacaccaacagagaaatatatcaaatctttcggatctatcgaggagatctctcaattatgaacaaactcccttgcaattgttgcctcaggtgtcaagggaaggcagttatcttccatctacgcaagacactagaataaatttggccaattttgacttggagtcctcacccgtcccgaaagaccttcacagtgacctaccggactttagatccccacaaggggaacataacgaagtcgaagaagatctatccaattcagagagtgaactcatgagtggagatgatctcgctaatgcgttgagatctccagttaacaaaaacagtgctaagtcgcaattggaacaatcattgatcagcattggaaagggcacagaagataaaccacttcagacatggtataaacccaactcagaccaggattatgtacatatgctgttggaatactttttggctcctgatggtaactacgaaccgaaaataccatactttttgagttctgaaacaattcgtcaggcttcagatagctctaagtttgatcccaatttacagattgatcatgaagggcatacagctttgcattgggcctgtgctatgggtgacctgaggatgtgtacagctctattgaattatggtgccaacaccagagcatggagtaacatccaccaagtgccaataatgagggcagtttgtttcacaaatgcatactacaagaggtcttttgcacagctgctggacttactacgagagacattacttgattgtgacaaggataataggaaccttttgcatttaattgtttcccaaaaattaggttcttccgcatctagatattatatggaactggtcatagccaaagtttctgaaattcaacccagggaaagggttataaactttattaatcagcaggactcaaatggtgacactgctttacacattgccgcccgaaatcacaacaagagatgtatcaggcttttgatatccagtggagccaaagttgatatagaaaatgaccagggagagagtggccagacgattctggagagaaatggattgctcaggtatgatcaaaagtccgacatcaatggccatagtcaggcatcaatacatcagctttcatatgtttccgatacagccttaaaaatggttcaagacatcaaatcacagttttcaaataaactagatgaacttgccttttctgttggcaatgaatacgttgagaaacagagagaatacgaagaatcgtacaaaacggttaagaggcttgaagaggaatatgcacagttggagaatacgatttctcaaacacagagtagaatcatgaaattaatagcgcctgattcaaacactgatagtccagaatataccgaaaaacaaatagagatcaagctggaatcatgtttgagggaagtaaatgaaaggtcgtcgttcttgagacaactattggaacggagagaagccaagaatttagcacaaatgatagaaagtaaagaaaagaacattcagtcctccaacattgagcaggataagttgacagaccaggaaaatcttgacgcgttgattgttttgacaggacttcaaatacggagaaagtacttagttgatgagcttgccttgcaatacagtgattcgtctgcggatcccgagcggatgaatcagtacaggaagctgataagcctgtgctgtgaagttgattttggcgaagttgacggactcattgatgaaattgaggagattctgaggaccaactgatagtcgactcactatcgaaagagaaaattgtaataatatgtaacactaagagattatcaataactgcccgctcgtcccctcgttagggagtcgatgaggacggatatatcatatcacgtgccctcacatttcagacccccgattctaggctgtagcgttattaggagcgctttctgtatttggccttatcaaatatcccataccaacacgttgacaatgactgaaggcaaagccaacgaagtttcactatggattcccgtcatcggttctcctgaaaagcgattggctgcaataatcaccattccgaaccgagagagcgttgatgatgcgttccttaaaggattttctccaagaaccagaagactggctatattgatgcatggtctaggggggcataagaattacacttatcatagaatactggcagagaagttagcccgtgatttgggaattttcagtctaaggtttgacttcagaggatgtggtgattcggatgacagcgatgacgccaatggaagggttctagaacgagatgtacatgatatcgagtctgtagtcagattcatagaacagggaggctatgatggcatcaatttcaccttagatgctttggttggccattctagaggtgctttggctatgttcaagtggaccattcagcattgggaaaagttccaaaagggggaaaaagcgtacaacgtgcccaatttgatcaattgtggtggaagattcttcggtaaaggactatgggaaaggtgtcttcataatcatccagattttcaaaccacaggagggttttatattgatgctatgagatatggtgtgtaccaaaaggtattcatcagcaaggaagaaatcaagagtttaagtgctcaggatatgtctattcagtttaaggcccattttgagcccttagtgaacgttatgagtatatatggactagaggactccattattcccatgcaggatgctgctgagtacggcaatgcccttggatcttgtcacaccttgaaatttatcactggagctgatcataattattacggtacagtcaaaggtcatatacatccagagtatcctttgaatagtcgaggatacgtcaactacaattacaaagttactcagctaatactgaattatctttctcatactgaatctctacatcgtttctacaagtctactcaaacgttgaaaattacccctcgatggaaaaaggttgaaggtatccataatttcagatctttgggagggtggagaatcgatagcaatcattatgtaagggaaggcctcatctttcgaagcgccaacacatcaggggttacttcaaaaggaatagaacagttgagacgtctgggtattaaagctgtatttgatttcagatcaacggaagaaatcaaaaacgacggaagatttgatgccgaccagatagattggattcatgttcctgcgttcaaagatgtcaatctttcaccagatgccctcgttctcaggtacaagagtttattgacttcctgggcaacctataaagatatttacagtgacacaatatatcaaggaaaggcttcatttaagaaggtctttgaatttatcagggataatgagaacacaccaatattatttcattgcactgttggaaaggataggacagggctcatggcaatgctgatattgttgcttgtgggagtggatgaaaccatcattgcacgagaatacgaacttacaacattaggcctggagccacttaagccccatattaaggagaagtatcgtcaccagttgaagcgtataattgacaatcttgaaaatgacaaacaaggaagagaaatcctaatcaaccagataaccaagggacgagcaaactttgacttggagaacgatgggtttgaaaatcttgtcagtagtcgatacgaagccatgttggataccatcgagattgtgaacaaggagtttggcgggattcaaaattacatggaggagcatctagggtttaccccagacgatattaaagttattaaacgtaacttaacctcaacctcagactcgtatgatattgccaatgagatcagtaatctgtaaaaagctgacatgatttcggtcgacttggctgaaactaagttatatgctattctgactgtggttcgttaaatatgttattaggataacaacaggttttatggttggctgggtaaatgaccaaagaccaagcagagaggaccattagattcgtatgaatgatccagtattcggctctgtaagtatcatggaggggacttggaagtcttgcatttgcaaaacagaatttaacgatagtaacaagactgattggtacaccgctctcacatcagctattcaggaaatggccataagagattgcgcaattgcagaaaaaaaggacaccaaagcgatccaatatactcacgaacaacaactgaatactattagtgaatatttttgggaaatttcattccatttatgcacggctcaggcgcctgttttggtagctcactgtaattgtggaccacggatccagccacccagtaatccctatgattcctgtagtattcatgccatgatgcaatatcccccaactgtctctctgttaaacctcgtaaatcccatgtgtactcgtttggattagtcaagcatcctgtccccaaggccctggagccatccctgcctgcaaatcgatggtaggagcttcccttggaatataggtgtctgttcttcgtaacatcaaaaattgtcccattgacagccacgtatactggaagatgctgtttatttccgttgaatactgccaactgggcgtctgtaagtacaatattgggcgttatcaaatgcttgtaatatctcggatccacgtactttccagagtaattccaagttggtgaagaagtaaaaacgaacgagaaaatacagttcaggagcagtacgcctccagccactctcaaaaggtctatcaagttcagtctagttctcattgggaggagatgcagtcagaaatatcaaacgggaccaactgaggaaattgagtgagttagatataatgaaaaaaattataaattaaaaaaattagtatatagattacggttacaattaagaaatttatacataggaagcaccattagtggagcctattagtaactgaaacgtccatgcttccagttttaaagtcttttgggggccggctcagatgaaacatgtcctgccatgtttagatcagcaggaactagtaagtcactccaaaactcatcgctgagagcccagtatgacatttccaaacttttgtccgactgcgtccctgagggatcttgatcaaatgaattgatatcattgctgttgaaaagcttctgaaagtctgttggtttgtttgtatcagtttcttcagtatagtttttatttagatcgtgcatctctgcagcgttcgaaagaatttccaacggagaacccgggtggtatccttgagattgagttcttggtgcccatgtagttggagacgtcagatatgccctattaggagcttcagtatgctgctcaacttgattggtagtgacttcaggagtataccgttcatgtaacggctcctgctgatctggctcttgtttctggtgcccaacattagaggccatttgcaggctcagcttcatttgcctccaattggtaacctgtgaaatcgaagtcttgagaaacagcgcaataattaacacctgcttacccaaaaagacattacctggatgctcacgagcactattaaccaccacttcagtgaatcgcttaatctcataaagatactccttaggaacaattccaatattggaaagggatggaatgcagaacgtcaagtatctcaacctgagtaacataccagaagtgtaaatgactcttgaagagtagaataatggcaagactgccacgtcctctggggcaagggaacaaaatagtcgaatagccgaaaaacatgattgagcgcaaagatcgatgctattcacaacataatggggtaactgtgttgaaccttggaccaaggagtggatagtcgcaaatttctgtagctctggctcgtataaatatgcctgcacactgtagtaataaattccaagataaggatcattattgatctttagtttaatctggtttaactctaattgcacctggttaattgtgtaccgtattcttgaagaagagcattcagacgatataggatcctcatgggaatgaattgcatgatatattttttctagaatgtggttcaatctcccatagagggaaatgtacctatacttggattcattagatgactcaagcaatgcacaagattgttccaaatattcagaccaaacaactctaattggcctcctaaggaacaatgatgtacagacagaggtggaaaaaaccattagtaacagagctctgcattctatcgtatcgttctcgcttagtctttgggacttcttgacaataccttcctctccactgaaaaaataacttgccaagttggttaaccctaaatctgagaccattacctcacacaaagagttaaagatgtgatatcgtctatgatcaaacagttccggtgtattgtaccaaatgttcagtaacaatagtgatttcaacaactctaatgtcttctttccaataattaaaatttccgccgtaatggcttggatagctaattgatccaagtacatttgtttctgatcgacactttttgaaacacacatagaagttatcgacattacagtgataaacagaataggctgctcattcataaactcgtctatggacgcaaaaaacggtatgtcaacaaacggaaacttcttgtgcaattttgtgttaaagacatgcagtctctcttcagcctcttcgatagttaatatgcccagtttgataacattgtatttttccttgctatacctattctccaggtagcttgtccgagtgtcagcaagagaacgcacttcagaaatcttttgtcgatccacagcattatatatatcatccagtaaattgagctcgtcttgataggctccttcgggattcagatagactttttgctgctgggggatatagttttgcgatgctgctgaagagttatcactgtgaacacttgcgttgccaaattgctgaggtgaatttatgggataaacttgcggtatcgacccggtatttcctgggtgatagcccagtttgctattaatggccttttgcttccgtagttcattctccagaaagattacttttttttctaaatctgtggtggaagtcgatggtttatcaacttttttggttttcttttttcttagttgactaacatcaattttgcactctcttttggccttttcacaccgaatacagggacctccaggatcgttcacatctaccggaacgcatttgactttgagggaatgacatgacttgcaggcaacagctcttctcttgagggcggaacctgaaagatttccttttgtatctgaagtcgtcccattcagagtaggagactttatttccggagtttctgaggaactatgataggtgtcctctacgtttgacatgtcctgccctcttgtcacctatacgaaaaatattgagtgcaggttccaggtcctgggatgggactctcgcgggcatggggggtagaaaaaaaaatggaatggaaagggccatctatggggtaaggggtaacgagaaaaaatcacttacagcaagtatgagaaggccatcgtttggggaataatggtggaaaattccccattcgtcgggctgctactgtgcttttcttaggaagctgaaataaaacttatattaatatcttaaatgcctaacttgtctcctctgcaagtttggcaagctttctagacctgtcaaagtataaattgggatgtgtgatcaaagacaggtcaaactttgtcttttgagtcgctatttcaatctcctttttgtgcgtaagctcaaataccttggtacaggcgttagtgtaatctcctctggatgaattgtcaactatcgtgttcacatcaaattgatctgtaattcccatcttattcaactccatagtcagcttctcagatgtaagatctctgtatggacatccatgatattcatccctggaaggacttgctttggaaagaatttggtgacaatcccagggcttgtagttaattctaccaccttccaaaccataattgtgcctaaagttatacctgtactctttgttaaattgctcaagattcattggacccttagtgaaattaaacgaccaaaacttcaaagcttcatccacactcagtcctatacctttcaaaaatagagagagctgctgtctacccagatacttcaagtggtgctcttgactaagtcccttcattaactgagacatacatagtgggtaatgctgagagacagatttgctctgtacggtctcggcattgatgtcaccaacgtcagcatcaccatctttgaaatctgattggtattcgttggcgatatatcccttggatatgtgattaaggacaggaagtagacggtcgtcttcatccagttttggaatcgaacgcacggtgatctgtagggattcggccaactggctaacgaattgattagctatgagggacagctgttggaattgaggaacgtagccaaagcctttatgcataaatatagagtgagaactaaccaggtctggaatgaactcaaatggtacttttaagaactgttctttggcacaaaatgctcgtactgaatcatttgtgaccatgacgttagtctcttgggataagattccacggataggaacagtacaagctgccagcagctgctcaaaatgcgtctgtttttcttcctcgttcacagcttcccatgggagatgcaatccattgataaattgcttctgttcttgagacgataacatcttgtatctgagcttgaaaagcgtgctttccgcccgaacgaatctgtttctgagatcttctgatctacaaaaagctagtcgaagaatatagtgggaataatgatctttccttctttcggcaacgagttggttgacgtctttagtgttggtggacaaaggtaaatgcttctctaatatcggttttatacttgattccaactccttcattgttttgtttctcaaatgactggattcaatttctatcaacaccttcaaacgatccaaagcccacttttcaaactcgtctagtgttatctcttcaaatggtggaactgaatagaagctgagcctattggagtaaacggtctccagaagctctttactcttcaaacccgcatttccagcatagatatgggagccctttgaatcttcaaagtttcttctccccagagttcttcttttcgtttgtctgaacatgaacgacgaaggttgtttgggtggtaaggtgtgatattttggtactaaacgcgctttcgtaagatttctcccaagacgcgtaccaagtgttcaggcaagtatatgtattacgtaatacgacttactatagattttcggagaatgcctccaagttttctgtaatacaggaatgggatagtcaagctgagcctttttatgccaatctcacaccataggtgggatctgtccactctttttgatcaaggaattatcacttcaacactgccattgatgataatttcggtctttggttttctctaccattacagtgctttcaagcaaatgcattgcaggagccaagtatcaatctttggtatcaaaggcttgtgagactctgtgaattgttttggaaatcaaattgccatgcagccttgttcgttgacgatttagatcatgtcgcctagcatatcttgtcaaaatatgaagatttcagtatacactctgtcttataaacgatgatttgaggcagctttaaaaataccatttgaagtgaacaaatattaaaaagaagaaccattgaatgttttcaattcaatagggcttcaaccttaccagttctttgagaagaacgtatgtggccttcaggttcacgttcagtcatggcttcaaattgcttcaaaatgaaaccactggactgggaacataacttgcaaggaacgaagtatggcaacctttgggctgttttctctaacacagtcctctaatgccatgaacgaagaaacagaagaatcgatccatagaacgactttcagaaagcgatctctacaaaactggagaaacccaaagatctatcaaagttgataacctgtcactttcaaattttcatgggatgatgaaaccattgctgcgctctgaatcctacaaggcaaggcatccttcgactcctccccttcagtgcccattcctgtaaccagtaaataccttcgagcaattgccagtagcttttctgctatgcttgttcacttttttgtttttattgttccctaaaaggaaattcatctctatcgcgtttcaacctccaacatcaaaccaaattgtccaactcaatacagcttcacgacaataaccacctcctcatgagaacactccttctggacccggaggaccgagaggacaagctgtgtctgtccatgattaaccagaaggtttccaagtccaagaaaatgctctgcttgacaggcgctggaatatcttgtaacgctgggatcccagatttccgctccaacaagggtttatacaaccttgtgaagcaagagaacaaaggagtcaaaagcttgaacaaagggcaggatctgtttgacatatctttgtttcgacaagaagaaacgattcagattttcaaccgttttatgcattcattatatgagcactcccgccaaattcagcccacagatacacatttgtttataaaacatttatacgagaggaaaaagctaataaggtgctacacacagaacattgatgggcttgaaaggaaactggggctggtcacagacaatactaatgaactcaaatggaaagacttacagatagtccagttacacggagatttacacaaactgtcttgtactaattgctctaacaaattctcctggaatctagaatacgaaactcttcttcataatggagagtctcccgaatgtcccaaatgtttggagttttactttgcaaggttaagccaaggaaagagactcagcagcattaacataggaatcctcagacccaacatcatactctatggtgaaaataatgagtacagcgaatacttagtcagaggattcaaccaagacttaaacaaaagacccaacattttgttgatttttggcacctcattgaaggtcaatggtgttcaaagtctggttaaaaagatagccaaaaatcttcacgaagatgatagcaagggaatagtaatctatatcaataagaccccactgaacagctcttggaactctatagtggatttccacattcaagcagattgtgacgaatgggtccaacatcttagagcaaattttccagatttgtttttaactcagtctcaactggatcttaggaagaataaaaagaaaagaagcatcatcaaagaggagaataactgcaccacaggcgatatatcgttaacacctccagtgactccgacaaaagttaagtcggaaaatgcaagattaactaacctgaaaccatctgataatatacaagaatacattagcttactagacgatacagatcaaggtgagcttaccgatgaagatggagaaaacagcaacttactaccctcccctatgaattccatgaactcgatgaccgaacaaaatacaaatataaagcaagaaacgaatcctatcacagtccaatccaaacgcataaaacccactgttggttccacgaggcgtgtactcaaagctagaaatatcccccggaggaaaaacaagattccacaggcagagactattgcaatataagtaggtggcccaccatgatttattgggggccaaacaatatagttacttacataagcaatgattcaccgcgaacatctatgtagaatttatttgatcttatctctccactctttccatagaaggagcaatgtctgcccagtctacaactgccaagctattatataactccagccattcagtgctaaacttgcaaccgttgagtcataaatatggcaggaagttccatgcgtttcttgaaacagagggactgaaaactgagcaaaaagatcccgatgagttttctaccaaatactgcaaacattgtcacaacctatttatccctggattgacatgtagtatacgaatcgtatacaaaaagagtgctgaaaggaatcgaaagaggaagagagaattgacccatgaatgtttaaactgcggatttattagaccttatgccattctccaggaacaacctaagctggaaattgaggatgaagacgacgatgaaccaaaacagcacaagttgtctcttctgtcaagtaaaactggatcaatgaaaaagaaaaagaagttgagcaacttggaagaaatgttgcaagctaaaaggcaagcagaacgcaaaaaatccctgagtttgaaagagtttatgcaaaacttctagttattcaaattttacaactccaatgctttcattttatgtggacggtgtgctatcaagaacaaaatctcgcttacatgtccttatccatcgtcttcttcggtattcctttccagtagattcgtaacagttggaaagcttcttcaaagtactcagggagtcttttttatcataacaccatttaccatcatcatcgatagacagcacgccctgaagatagttttgatggacccatccggtaggacttagatccaaagtccacccatgaatatttgtttgtcttgaaacatcagtttcatcactggtagtcgaagagtcaggattcacagaggaagatggggcatcttgcaggtcaaatttccatccgatgggaggcattatactttgtaatgataaacatcctttaatacttttttcgttatctcttctagtggagttgatggcaaaaggatcgttacaatagcacagcagtttccattcattagtatcctcatctaaagtctgcaattcaaaaatctctatctctcttatctcattctgatcagagtcaactctgttcgaaaactcgtttttcagacgagtttccaccttattggacattgtttgtagtttcaacctgtactcttctgaatacaatagagccaaaaactgatccaagttctctggatgtagtaagaccatcaatccccaaattcccaccaatagtgtgaacttggcagtaaagctcaatatttccagggggatgatattcacactggtgaacactatggttgccagagcaaagagagccagaaacacaaaattggatacagcatcgtctttgaagtagaaaaactccaggtttatcgagttgatgaaatcgaaagtgattacatacagcaacatgcggttctgtaggtctgtcaaattcaccacaaattctctggacaaatcgggaactggtttggggagagttatatctttcactggctcaccatacgcggggattgggtttgattccaaaagctgattcttctccggaggatgccttttcaagtatgcaggtaccattatccctgatagaatatagaacataggaaagacagtcagtagcgtgggcttgagaatcaacagtgatgcaattagcaggacactcaatgtgtagtacggtcgtttccaatttatgatacaaacaacctcgtcaatcaggataaaaggaattgacagccttgagttcaattgtatgaagttcttcgtcatgatattaaccgagaggggtggcctggactgttgattctgtagtctttcttgtagttgttcttgatatgtttcgtcggtgtaagccgttggaagtgccattgatatgattctctctacaaacttgtccattagagcactgttagacgtaattgaacttgaagatgagtcctttggttggtctgaagttaacccgaagagctctgtgaacatggttttggtggaggagtctgccatggtagcataatctgtccacttcttgtcctgtatggattccgatgtgttcatagagtccttcatcggatgagttgttgagatcaaggatttgttaaccatagaaggaaagtcaaggagatgatttgattttagcgattgctggaggcatgtgatagcggtaacagagatagggagagcctaggccggaaaaataggttagcgcagggcgggcaagctcaaagaaagttggaggcgtagcagaatgattacacggatcgttagagaaattgtcacggaagctagcctagagtggtctagtcaccagtttcttcatacctcggtgatgacaatcaaaggaagagtattaagtaatcattttcaactcatcgtgactagcgatagaggtcaatcagaccagttcattactatttagtcagtcatgaaagtccatggtgaaatctctacaaagatctcgttatcggttacaattaatccaagtaggttccacttatttcagtccctctgctttcctatgatacccacgccttttgctggagaaaacttgttcgcgcgatggctatcagaaaccagttaacctctcatgagtacccagaagccagttggaattctaacgtcgactaacatcaatgatgctggaactccgtctcatgtcgttgcgtcaaaaataaatggggatctcttgctctatcagattgaagacatggacacaccttccaaccaaatcacgctggatactggtgtattatcgtcttgttggcatccgacctccaacacgaaggcctacacgggacatctagatggaaatatattggaaattgacattgaaaagtcgattgccaatctaacaaactcctcacacatgttgggtgttcgaaaactgatttttctagatgagaatcagatcttaagtggatcctgggataaatcgttggcattgacagatatacgctctccgctcaatcacaaataccgtgttggattaccagggaaggtgcttgctatggattccagcttcaatggctacgaaactgttgtttcaatgacagatagaattattcatgtctatgacaaaagggatttctccaaaccagttaacgtaagagaaagcggattgaggtaccaagtccgggatctaaaaattctacccaacaggaaaggctatgctacttgttctattgaaggaaaggcttctattgagtatttttcagaacacgatctccatctaaactacgcattcaaatgtcacagaaccccccaggaagaagcagatcttgtatcaccggttaattgcattcaattcgatgaaaaagaaaggctattcactggaggatctgactgtagaatatgtgaatgggattatcatcaaaagaaaagactaaagcagttttcgaaggaaccatggtcagtgctgacgatgagcatcagggaaaagtatctggtttatggagtgagtgatgatgggtacaaaaacatggtttctgaacgcagacagtactccgttgagggatccttggttggacttaagatcttagagtaggcctgaaaaaggagaaagcatattgccctaatcttttagtcaaaactctcctctttcgtgcccgaatattttctcacagttaaatctgactccccaaacatgttcaagccaggattagtaactcacgtagagctacgtcctaatcgtttagagtgagtttgccaagcctccccccagaaccccagacctttaaggtatcttctcgaactttttagcacgtgacggagtattttttttgaattgtactaccaagaatggcattcaaactctcaacctatatgagaaccaggcactatcatggtcttcttcttattgttccttgcatccactgttagtgctgccctggttcaatcgttcaactgttttgggatcgacccagcaacgtataagatttctcccatgctcacaagtgcgtttttcgatcaagacgacaaatctctagagttccagcttgatggagttgcgttggaagacattgacgatattgacgaatccaccaacatgttcacgactttgcgtgtcgtcgttgagttcaccggggacacaatcgtagacgagtatgttcggttgtgtgattatgtcaaagttgagcctattgtcctcaatatctctgctgacataggaggtccatcttctactgttgggacaacggaattcacgtccgtccccacaatcacagcaacagcaccagcagtagagagctctgactatgtggctagctcgtcttcatctgacagccaatggataggtgtgggaaaacgtgattcagcatctgcaacaagcgtcccaactagttcatacaattttccagaggagatgccttataaattcaaatttggtgtcccattttctgattatgcttttaatggatcttgtcccataaaaaagggtaaccctttaagactatcatacaagttggatgctggttcatcccacaactttggatcttataaggctactttctacgtgatttctccagacaggtctcagaatctaatttcttgcagacaaacatacgtcacaactgttcagccatcttccttgatcaagggtgccgcgttgttatcattgctctttgcaatatttttggctgtatgcaatggctctatactgatgttttcacctcaccaggagtcaaacaacccgtttttactcacagcatcagctatatgtaattcgtcactactgcttagcatttctcccaacgtgtttgatttcctgaggtatatccattttgcatttttcatgagtggattgaatatacagtacccaggctttttccaaccaataatgggttctatgcgtatggtggctctcattgaaattctcacagttaattcgaatagcgagctgtttaaactagacggcgtatacaacacatttcacaggaatggaattttggggctgtttttatccgtgagagataggatgtctgagtacgaatggatctttttttttgcaaactttggagcactttatgggatcttgatccttcttttgactgtcgttacttttatcgctgcagtttatcgtccgaacctaaatccgggtgccaaatggttgaaaaatgtcctcatattttttctttcaaccttgataacccttttacttcatgcgttcgtgataccatttttagtattgactttctatctattcagtactttttccagtgatgataccgttgaatacttgacttctcccagggcatatatccttgctcttgcaattttgatattttttgcatttatttgtttggtatcctttttcatcttcaggtatgctttatctaagagccggaaacaaaaactttattcctctttcaacacaatgatgctgtggggtctgctatactttgagtatgatcctagattattatttttctacattttcgaagttgcagaagttctaatattttctttggcggtgggtgtgcttcagggcaatggtactgctcaggtcgtactaatcttagtgctagaggtgatttacttggccgcattgttcagtattagaccatattttgcaggctccaaagcatatgcattgaaattagcaattgtgtgcgctaaggtgattaacatcgcattgtgcataccctatattcgttctctaggtgtttctgaaaaaagaagaagtgaagttgcttatacacaactgatattacagttggtggttattgcatttttgttcctactaccaacaatattgaatgtaatccggaccttgaaggatctgagacgagagcatattttcaaagttcctgatgataacgacgacgagtatacacctgatggcaaagttggattactgaatcaaaaagaagaaaattacaaaggctcttctaagctagaaacttctgcttactaccgtaaacggaggataagtttgaattccgatgttactactattcccaagttgacgaatccactgttgacaacaaaacacctatcgactgcctccttgtccactaggtcttcttcctcagtattggaattaactgacaagagggttcttccaggtgtgactatcaatcctggcgcacggaatccattcaacaagtcagctgagcttgcttataggtcgaacaagcaccagaaaagaaaaagggagcaccctattgattactccaagagagaagctgatatgctatatcaatatcttggagaatcttcagttgacccagagcttcagcaactatgggatgaacgagaggaacgtattaactcctctggaatgtcgacagaggggaaggaagctaaaacgtacaggaaataccatggattctggccagttaactggcttggaaaagactcgaagagaaaacaacaagacacagaattacaagtaggccaaggaaaatttgaagtccgaaggccccgccaactgaaagtgaaaaatttaccagtcgtcaacgagagttcatcgaatgaaaaagaaaaagaaagcgatagcacatcattaaattaactgaaccgacctagaccaatctttcgatatccaagctgtgcgcacttgatcagttgacctttattaatatggtgtcaaattagtttcatgcattatattaaatagttatccaagatttctcagacatagttctactgtacaaaataccccagcattaacaggcgctgctctcaataaactgctggttaaacctgaccaaaaacctttccatcctgatgtcttgtatacgtacatgacaacttctttcgtattgtgaaactttgcttgtaaaccaaattggtcattctgccgaatagttttcactacatcaattggataaacagatagccatagtaaatcacccgctatagctccgtacactaagagctcccataatggtatatcttctctcttacattttctcagtccacaggatctttcgatcaaatattcgtaagtaagaaaccatactccgtgtgcatgagtatctctggcaaatgtaagtccaagccctctaaaaagaccggataaacctgcctgtttccatatctgggctatgcaatggctaggaccattgaacagtttaattccgtgaggttgagcttgtaacaggatcctaattccttctaccggagtattaatgaatgacgtgagaccacccgcaatggttccagaaagatatatctgggataatgtcaaagcacctgtttcagaatgctttaatatgagtcttctggcttcgaagcaaaagttgaacatgatagcattgatgaccccaacccctagcaggggaaccaaagaacctttatacaaccccaatactccttcattcttaacaacactcctggcagctgcaattggtgatttgaactgtcccgtctgtatcaataccttacaaagatccaatggttggcctatcaatgtctgagccaggcctccgttgaaagctgagaacgtctgtttaaacgattcgttcttcagaagggggcatacgtagtgagtgagagggttacttatggtagaatttctgctattatcctggttcaagttgctttctagcagcatttagtacaaatcagtcgcattgctgggatagttcatgtctttatagggataggaccccattcatccagccacatcggatgtgttaaaacgcgcgggggacggaccgttgggtgcagtgacaaaaataaaacaaaatatggtatttaccttatctattcaatcagtaaaaatctgaaaaaaggagccaaaagctctcttgatttgttcgacaatgtctagtactaaccttttatccgtttgtttctctttgacccttcctcttcttcaagttttctcttcatgatattctttatgagtttctcatcctgaatgactttgaaggactttaacccttcatctttacaagcccataacgctttgtattcacaaactaaaaccgtctctgccatagcttctctgttcttctttttaggaacaacaagttcctgccccaccagttctttaatctcatcaggatactctttcagacgaagatcaagtattctgccgatgttctctttgactgattcagtgatgatgttttgctccaggagttgatagcacttcttgctagttctgttaatgaatctgctcaattcacttcctgtaggatttcttttagaaatgcgaatagtcttcttgaaccatttcaaatcctctgccttacaaagacatattgaggtcagcagagtgactaacattaaaaattctggcaaaatctcaccgtctttgtaaaaatcataactttcaaccacaatggatccatcttctccagtaagatgtaacagatattcactgtcagcaataattttgacaatcaatttgagagactccttctcgaccgaatacgtagagatgaaatagttttcaatcaacgaaagcctgatttctccaaaatcaaactttgatccagtccattccacataaccgtatcgtctaagaatttcagaattggggtggtttccataagtgttgtaaacttgttctcctttcttaattggtttaatagctttcatgacaaggttctctgattggtaggttaaattagcattgcagagattagtatctgcattaagtgtatcggcaaatggaaccattgatttaagaatgtggtcatcaaattcaaacgcttcatctccactttcactctcattttcactctgattcttttctgtgttttcatcttctgcctcgttatagttgtcatggttctctttttcctcttcctcttgttctgcatcttccccttcctcttccccctcttcaccttcttcttcatcctgatcatcgccttccccctctacatcaaaagaataagacattatcgtactggcaatcttgtgaaattccttcaaatttacatccttcaattcctcactcacacccagttctgctaccacctttggaaataatttatcatacatagcttcggcctctgcagaaccaattctgtccaaaattagtgacggtttcaacgaattcaaatcttgctcattccaaaatattaagttgttgaaagaagtaggcagagtatccaaatagcctttccatctagataattcacccaaagatctttcgtacgccaggcataaaatcaagccttcccaatgattcaaacgcttcaaaataacgccattattgtctttcacattggctaaactactagtttgaatatttaggacattgtctttggagatactgaacaatacttcatcctcattaatatccctcgtggctacaacacctcttccctcattttgatcccttaaatcttctattttcacatttccagcaagctccaaattagcttccagccattttttatacgcttcagtgatcgtttgaaagttgtctgtcatttcaagtcaacttttcaagtgatccaactgtacaatatttcaaatcgatcttaggaataattttattttctgagagatgacatcctaacaccttttccaaatcggaatattctagaaactctaacaggagagatttaaaaatcacagtatctctcccgctgatcagttttttcccccctcaaattaatcttgaatttcttagaacttagtcttcaaaacaatatcaagcaatgtcatctgaagaattcaaagcccagggaaaccaggctttccaagccaaggattacgaaaaggcggtgtcatttttcacccaggcaattgaggcctctcccacccctaatcacattttattctcaaatcgttcagccgcctacgcttccttaggacagtaccaagatgcattggatgacgcaaataagtgtgttgaaatcaatggttcttgggccaaaggttacaacagagtcggtgctgctcactacggaagaggtgagtgggacgaagctcacaaggcctactccaaagctctagaattagaccctgctaacaagatggccaaggagggactcaatgagacagagattgcaagagatgctggtaatgatgtgaagaacatcttttccgatgccggcatggtggaaaaattgaaaaagaacccaaagactgcagaactgatgaaagacccagagttggtggcaaaagtgcaaaagttgcaaactgatcccaagtcaatgtctcaggaattgttttccgatccaagattaatgaccgtaatgggtgccatgcttggtgttgatttgggtgtccagccatctcaacagtctgccccacaagaggacactcctgtgcctgacgcatacccagagccaagttcgaagccagaaactaatactacttctgcaaaaaacgcagctgctccagaacctgaaaaagaggccacacctgagccagttgacaattctaaagaggaggccgacaatttgaaacaacaggcaaaccaattgtacaagaagaggcagttcgatgaggctattgagctttacaacaaggcctgggaaactttccaggatattacttatttaaacaaccgtgctgctgcagagtttgaaaagggagactatgatgctaccattgaaacctgtgaaaatgctgtcgagaaaggtagagaattaagagctgactacaagctggttgctaaatcctttgcacgtcttggatctgcctacttgaagaaagatgacttgccaaacgcaatcaaattctttgaaaaatctttgacagaacaccgtagccctgatgtcctcagcaaactaagagctgcagaggcagacctaaagaaaaaagaggccgaggaatatatagatcctgagaaggcagaggaggcccgtttgcagggaaaggattttttcaccaaaggtgactggcctgccgcagtgaaagcatacacagagatgattaacagagctcctaaagatgccagaggttactccaaccgtgctgcagctttagccaaactgatgtccttccccgacgccgtgaaagactgtgacaaggcaatagagctggacccaagctttgtcagggcttatatccgtaaggccactgccttgattgccatgaaggacttcaacaaggctatgaccactttggaagaggcaagaacggtcgacgctgacactaatgagggaaaagctgccaacgaaatcaacggcttatactacaaggcctcgtcccagagatttgctgcaattgatggggaaactcccgaacagacttttgaacgtgctagcaaggaccctgaagtttcggctattctccaagatcccgtgatgaactctattctacagcaagcaagagagaaccctgctgctttgcaagagcacatgaagaaccccgaagttgcaaagaagatcaacatactcattgctgccggtgtcattcgtactcgttaatctccttatgtatataatcgtagaatttatcaattatgatttatatatatatatacgtatctatttcccccaaagtctacgtatggaaaatcttctgcttttcttcttgtccgtggaaccttccgctccagattcagacctattggaccagtgtcccttagaactaccttctgcggttttatcttctgagctgtatatggaactggggccattcttggtaatgataggcatttgagaatggttactagaagagttagaaccaatcttaaaaactggaggagatgggcattgattctgtttggccacagtagctgaattcgaagtctttggtgaaacatcaagcaacatcgattttgtgtgataggcgcttgagccgacagaaggtgcccctgttacagttcgtaccagttctgctccttctcctcccatccttgctgtctctgccatttcctttccgatcttgtaacccgcagtggacactgtggctaatagttctttgaatgtgtctttattaagtggtttcttgcgaatctcatacaactgctctacaagattagcttcagtctgatacaccactgctctcatatgttcaatattagtagtctcttctaatgaggagtttgaataaatgctgtctgagtcagaactgtgattctcggacttcggccttaccattcgtgtcgcatgaggttcgtttctgctccgagttcttcccgtccgtggtccatcgtattcttgaggttcttcattatcataatcaagatcttcttcgttagtgtcttcacttgactcggtgctttcttttttctcaactccatcctctagtttaccagacaccgatgccgtatcaacgtctttcagttctctaagatccctttgcctgatatttttaagggcgagttcgaattgttgtgatgtaggaagctggatgtcatagaactcatcttccaggtcaacttccttcacattatgttttgccttttcatcgtagatacggttaaggttttcaaacaaaatgttctcaaaatcatccatatttgcagctgggacaataatggtagggatggggtaattcttaaccattctatcagttaatctggaagatttccaggatctcagagcactgttcttattaggtaaggccgaaataactgccaaattaggttggtacaactgaagcatatctctaagaacttctttagtgcttccaacggccaactccactgagatcttcacaatctttcttgggtttactacactaataatgtatttcatcaagttaccagtaaccactttgatatattggggaccagttttactcacgttgtgtcgcttgtgcaatttattgggtatatgatgatctgggtttactgctgcagcaatcacgatttcatctccatcttgtaacaaactgcgcaaacaccaatcaattgcgacccaagtatgtcttctgccgctagcataaactaggatgactctgttcggtaaagcaggtttcttgtttggtagttttcctgcatataatagctcccagtctttatgaatcttagtaagggtacaggaatcatgctcaataatgggggatgttggataatctctcctgaaaccgccaaacagaccaggacctcctctactcaagggagcaggggaatgaattcttcgttgaggggatctcattggggaatgtgttggtgacattgcaagagggctactagtgcgaccaccggtcgatgccttggatagcgaacgtccccttcgacttgagtccaaagtatccgtccagccacccaaaagttgggcgttacgagcagtggagatatagttgtactcatcctcatcatcagaacgagcgtctatcgcattggcgtcagagtattggaggttaactgtgtcgaatgaaactctagttcggaacttttcattcgagttgctggatttgtgatctgttttcttgataactgagcgaatagcggcacgatggtgcttactctgttgactagaaggtgatttttctttttgagtttctaaaggttcataatatgcagttggtactgtcgaatgcagcagttgttctgatcctaatcttagtttaactttcttgtatagagactcagaaacatcatcgataaccttgtgttccgttggtggtcttggaatgtcggttgtcgacttgaacttctgcaaatctagcctttgaggaactttgatagttattgctcggttatcctggtttggtactagagaactcatagaccttcgctctctgtagtctattattggtgctggctttccgttgctatggcggcactgatttcaaaaagaatgctattcaaaagaattgtactcaaaaaacctgataagataaatataacactttctgtctagtgggggattggttgcgtacgttggcaagtagctgggtactaactgggaaaaagatgggtggactagataggcggagaggttgacttaaaagtaattggtagtgcactacttacgataaagattcggtctagcttcggggaaggtgtaaatagtggggggttgagggaatattgataccactggtatactattaaaatagatataaaaaagcctaaccttgactattcacggcaagttccatgatcagcctcgtagctaaatgcaagaaggggtaggcgctaaatgaactgatgtcatcgtcgtctttgaactcagcagtggactcatcagagttctcccaaccatcaaatttaaaatcaactaggtagttgtttggctccaattgaaacaattgtatttgcattttcattagatcaggagtgactttaacattctgttgttcatcggcatttggtttatacttccatcgcactttgatagtccataactcttcttcagagggttttatccattcagcgcctaggtttttcagagctaagtaaatttcacccatgacatcgagtggataagatcgagatctaataccaaaatgccagcgagttttcgactttttcgtagaaactgggttgattttgttcagaggctggttgttcttatcagccttgttaatcatataggcacggtgaatttgaggtagtgatgatggaagaatagcaatagtagagttcgtcggcatatgttcaggtgatggattaagcgcatgataggtcaccgcacttccttgcgaaactattttatccattgaatcagacttttcaacgttttgactcttaatgtcgtccaccaatgttttgttctctttcataagctcataggcatcgaaaacttcattggtttcatctggtttacggccagttcttatcgcatccaggatttcttgtttatcgtatcccattgcaacggatagcgcatgaattacgtcgtcgtctacaggaacatctttgggtttaggcagcaaattctcggggttcagatagtctgggaattcaatcttgaaccactcatcctccattatctcacgaatggttatacgattcaaaggattgacaaccaacatcttggttaataggttcttagcagactcgttgagaaaacttggcaatgtgtaaacaccattactgatctttctaaataactcaggaataaagtcgtcatcgaatggtaatctaccacacaacatcacatagaggatgacaccacacgaccagacatccacctctggtccagcgtaaagcttaccactaatgacttccggggctgcataattaggagatccacaacttgttttgaggaaattaccatccgtcatgatgttacttaatccaaaatcggcaattttcacgtttaactggtcatccagcagtaagttttcaggtttcaaatccctgtgaacaattttgtgcctgtgacaataatctacagcggcgataatttgctggaagaatctacgggcttcattttcttccattttaccccgctggacgatataatcaaacaattctttccctgcatactcgataaccattattatctcctccttcgacttgatcacatcgtatagcttgataatatggggatgtctcaaaagacgcagatacgaaatctctctttctacccttccttgcatgtcagactttgcaaggactttcctattgatgatttttagcgccaccctttgacctgtagagatgtggtaagccaatttgacctttccaaaagacccttctccaagggtctttacaatttggtacttccctatcctctgggcaggctctttcgattgttctgcggccattagcttgatgaagaatgagtggagtgcagcaattacatcaatgaaggatgcgtggagttgtttccgacagtggtgcagggatggaacaacaattatgtaatcataatcttcctggttcaagacaacccaagatagtcctgatcacgtgagagaatcgttaagaacatgaaattttatttttgccagacattgttccctcaatctaacgagctcgtgcaactaaatggtgaaacaagacaacatctcctggaaactggacatcctggaagtcatgtttctgaggacaaagcccagatatttgaaaaccacattgtttttgaatgcaagaaaccagaagaaagtgtcctcagtgttggacgtgagaaagttcaacaagaacagtgccataaatcaaatctccaagtacaaaagcgagctttccgagagaaagatccattcagccaaagtgaaaatgcagaggaatttaaaaaaggtcatcaaaagtgaaactagtaaatgtcaagcgaaacttaagacttctcccgatgatgccaaacaacaagagagattacagattttgcaagatattgatctggatgacattatcaacagaaagctgattagaatattaatcaatgttttcacacccactgaggaattgcaggaatttcctcccacttatctgcccacttgggtcattgactcaataaaggataagaatagcaaatacaaccctaataatactacaaaaggcgattctcaggcaaagattaatatcgtatcacaattgatgaataataaagagctgagagaaattctaagcactatagatttgacgttgcggttggtggagggccctgttgagagacctgatcaaatcaaagagaagagagaaaagagagaaaagaaaaagtctgacgacaaagatacagcaactactataaagaaaagcgaaaagaattccagttacagtgacaatgaagctgaagaccaagatcaagatgaggactctgaccattctgacttagacgacattaatttctctaagtatgacggagcactggctgcatcttcagatgaggatagtgatgacgaacccgcaacacaaaagaaagacacctctagatcgttagtcgaggacgatttctttgatttttccgtggctgaattgaagcaaagggaaaaagcggatgccaagaagaaggagcaaaagcttgaaaaagaatacaatttgcctcaattgactagtggatacttttcaggcggtgagagtgatggtgattacgataacgacaaagtggtccaggaagcaaccaagcctcgtaagaatcgaagaggacaaagagcacggcaaaagatttgggaggccaagtatggaaggaacgctaatcatgtcctgaaggaacatgatcgtattaggtcagaaagagaacagaagcaggctgaatatgaggagagagtgaggaagagggcagccaaggcagcagagctcagagaaaggcaagcctccatgccccctccaaagatacaaaaagttgcttcaaagggcctgcatccttcttgggaagccaaaaagaatctggagaagaagcagaagaatattccattccaaggtaagaaggttacttttgattaagtaagtcatcatataatttcatcctcgaaatatttaatagatagcatagtagtactcaaagtcatctcccatccaactgctcataagacccttgcagcctatgtctctcattggtaagaaagccatagtaacaggcggctctagaggcctgggacttaacatagcgaaaaagctcagcaaacttggatgcaatgttgccctgttggctagatcagaggatgttatgaggaaggaagcattgccccaacttaccaccaaattcgatggccagaaacacaattgctacaaagttgacttaagtgatcgtaatgagctatctcagctacatcaactatcagtatttaaggaaaaaattgacattttgattaattgtgcagggattacacacaataagctactgatccagaccgatcccgatgaaatcgacaacattataacaacaaaccttacttcaagtattgtactatcaaagttagtagctaggaaaatgttgagtcaaaagtcgggccacataataagtatttcatcagcattggccaagaaacccatctcaggaactgtagtttacactgctactaaacaggcactgataggacttacaaagtcactagctgttgaattgggaggaaaggggatacagtgcaatgctgttctcccagggtttttaaaagacactttgataggacaaagtgtcaacgaatcattgttcaaagaattgttaacgaacggccacaagttacaattggacgacataagtgatgccgttgtattcctgttaaatgataagactatgactggtcaatgtttaactttggataaagggttcagcctgatttgaaatttgaagttaaaggtccagcctttaaatcaaatctcagaacttcttaaaagacaaatattatcccggaatcgagtttgattggggtttggcctcacaggcgatttgatttttgattttacatttttgatttgttttgctgttctagtgtccaaaataaatctgatttccgtcaacatatgagcatactcttcgggtctcattgccaggtactttttgatttccaaaagtgagcgtgagtctaagcttggtataatatcgttaaacaattggatattcaaactcaaccatcgaaacatagttttgttgtggatgtagattttcccataatgtgtttcatcccttgctgaattcaatttcagagactttgatatggcttttagggcttcatattggtttgaatttgcaactttatggtacttatgaatgatcaatataacataaactccgttcaaaaaagttggtgcatcaacggtaccgtacattttgaaaaaatcatctagcatgttagataatatattttgactgaaacctatccgtttcaagtctctcagcaccacattgaccgtttgaaaaatgatctccatgtacactggtttactttcaattacggtccaacagcgattttccatgaagtaatacaagtcacttaaagagtttagcttattgacacaactattgtagagtattgattcgttgcaaaaatgaacagaaggtaagaagtctctaaaatggttgaataatttccagaatacaaacgagtctatatttttcaatgctgctttgaatagccatctagctgcatacaacatctttctctcaacaaagtaatcaaggacatgccacaaaataggtaccagatgattgatattatctgccataaactctaaaccaaaacccagaagaatccatctgttgtagagagcagaaatagcactattcacgtatagtaagttgccaaattttaatttgtccgatttgtcagatccttcatcacattcactttcagtgtcactaccactactgcattctagttcatcaaagttccttttcttggagttttgatatttcaaattattctggatgtgcctcaccagcatattctttcccatcttaatgcttgtaagatgctgtaagcgtgatggctcttgatagtaaacagtgtcaaaaaataaacatatctttctaaaagaagacttgaattccagttgcatttcaggcgaaagactcaagagagactgaaatttaactttagaggagtcaagatctgtaaattcgttaccttgaggatcataatcttgatctggatcatctggatcagatttgtttctgtaccataatgtctcaatatcatcaattgatttactttcgtcaatgttagaaaataaataaatgcctcttaaatgaagtatggttgaggtgaatggtctggaaaccctgttgcacttggtttcagaccacatttgggtgtgacccataaaaaccttgatatgtaaatgcttcctgcaaatgtatgattactctcgccagatctccttctggatgttccttccagagtatctcgactccatgtggtcccagtaaaccgggtaattacccaattaggaagcatcttcttttttttttatttttttttttgcttgtcctttcttttttcagcaagaaaattttccttctttccatcaattaacaatgattatttacaaggatatcatctctggagatgaactgctgtctgatgcgtacgacgtcaaagaagttggtggagttgtctacgaggctgactgtcaaatggtcactgtcggtagtggtgatgtagacattggtgccaacccttctgccgaagaaggtggtgaggacttggaagatggtgctcaaactgtcaacaacgtcgtttactcgttcagattggctgagactcaattcgacaagaagtccttcatggtttacatcaagggttacatgaagagaatcagagctcatttaactgagaacgctccagaccaagttgaagcctttgagaagggagccagtgcttacgccaagaagatcttgtcttcttttggtgactgggacttctacaccggtgaatccatggatcctgatggaatgatcgtcctgttgaactaccgtgaggacggtgttacaccatacgtttccatctggaaacacggtgtgaaggaggagaagatctaagaagagttgtgatttcatgtttatttttagtccatttataattaactctttttcaaaagtagtaaacaagtattttccaaactggtttcttcactcacgtaatgaaacaagtatgtggtgtaatttgtgattgatgcccttcttgcttcatcgattgttctccttgctttgagacctataatttttctctcggcaaggctataaccactaacgtgatcttttccatcttggtctgatacttctggcctttttccgttcgtcgcccacgaacatattttggtcaaaaagttaaactgtttttctgaaatgtcgaagttagaagataagaacttttttgatcctgaaagtaggttatcatagtgacagcaatggcggcaacatagtgctatcaaacaacctgccagtttggaatctgagacggttttttcataattttccagacattggagggttagatctgttgctaccccacacaaatgcttcgaaactacgataaaagggtcattaacggagtccaatctgcatagggccaaatctttaatatctatcttgattctttgacaatcgacattgctatgttcattcttggtgagttcttggaagtccttctggattttggagtccatttttagacgaggtcttgttctgtcaatcaatgtaaagctagggtagcttttgtccttgtcaaaaactgattggccaatgtatcttgatagttctgctctcccacatccaaactccatataacggtactttggacccaataacccatttttctctagatgttgtatcaacgaagactgttgtatgatatgcttcttgtttgtgagcaaatctaaccgttgttgaatcataatggaagaatctgtatactctttggtctcaagttcgggaaattgcattttgtcataggaggataagaactcttgcaaaaattgactgagttctccttcgtcaaatgagcgctccttttgcgattcaactttaccgtttatatcgtgaacaaaccacggatctagattgacttctttttttggactttgcatttcttgatgtgttttgccagtttgtgtttccaaacaaagtgtgagttatccagaggacagggaattctctggttattggcgtcttctaaggacatatgttcagcacagaacttttgatctatctttctcgtcatggcacagtttcgcttcttatttaccaggaagaactggcactgaggtctttcctcatttttcctcttcctcttcttacctgaatcctcttctgtcattgacaagcgtcttgtgtgttataaggaaggaagaaaaagattcctagaacaaagagaggaacaagcgtcaagcaaatggtgatgtcggatgtcagttacaactagggccttggggagatctgcatcagatacaagacaatattatattcttagcacatacttaatgaccctttacgtaggtggccgcaaaccttttgtctaggtactccttagaggtgataagcttggtaatttttctatctctttggcttacgattggactaggaattggctccaggacaacattgttgtcagcgttcacaaaaaagacgatggaataccgatctttgctaacagtactggatggaaacttgaccctgtgcatggtggatttcaaaagaccgcaagtccaatagctgagctgatccgcaatgtttacaatgataggcgcagccttaccgggatacttggagggtatatagggcaccggctgccattgatttttcaggtaaagctcaaggccttcctggttctcctgctgaaacagtagtgtcacagttccgtagtctgtgtgggcaccagctctaattggttcattcgcatctagagatgaaacggagggatacctcagaaatctcaaggtggtaatagactcttcgtccggaaggtgcctttgcaaaaaccagtcatgcccacctttggccggatcgatttctagagccattgcgagtagcttaagcaatgcgattgagagatcgtacagcttcttggaagtggactctagtaaccttctgttttcattttcttcaaatatttctggcaaaggagattgacgaatttttcctgtatgaaagtcaaagtctccaaaattgaaggcttcctttgggtctcccttcacttgggtgtcaggatctagcatctcctgatggtaggcagtgtatcccctgtcgttgctatcaatcggaaacttctccttcgtatcagtatctagcttaaagaattcagaactgagattgaaaagctgttcgacttcgacagaagaaaaatcatgaccatcaatgtacaagaatccttgggtcaccgcggcatccaatagctcttttgcgttaccctggttcaaagtggaaatgtctacgacttttagtggtgtactcatggcaagttaatacgacaagacaacagcctgatgatgaggtcctttatatagatcttgtagagctcaatcttccaggacacagcctatcttagatcgtttaatctgtcctccttgataattcacctcgaaaaatatgggcgtagataagatagaccccaaagaggaaagtgttcgaccgacgggaatcggttgtggagttagaacttccaaaattgaaatattcaagggggtagcgctcactgacattgaggattatcgccaggctctgagtttgaataacagataagatcatcgccttgccaatctgtcgcaactccctgcacttaaatggttacacttagatagctgaggagacaagatcagatctgtgatgcactcgcattatcattcgtccaatctattcactggctaagttctccacaatcaagaacaaacgcctttgaacctacgttgaaatatcgcacagttaaaacatgaaacacgttgtttttttcttcatacacaagtagctcattttttagattcaaggaccctgacctgggtttccaaattcctgatcgatttttgcagagcaagaacatccgaaagcaccaagtcactggagttcttgtattcgttcaaaagatagtagtaaccagcgaccccagtgatggtagttccaaggagaaatccaaatagtcctcctttcagactggaagtttttctgggagcaacctccgtggagtagcaacgaattgcgttggaagatctgacagcagctctggaaactagagaaatcataatattatggatgatgggtgttctttggacttttttaagcattgcgatttgctaaggaaatcgatgagaaatgagagcactacaattcgcgtgtggtggagggaggttggatgtctaatactaacctatatacctgtatttcagtcaactggtgatcaagtcaaggtggcgttatcttgatgttgatgttttttttggttgtaaatacgtccctgaacttggacgtataggcaggtaattccgccgataacaagggtgacaagaactaaaataatgttcagaggaacaggattcattttgaaagtagtgtgcgtagcttggtccaaaaacttctggccgaagttgaacattcctgatatcgtcatgatagctccgtaaacggttccaaaagtctcaaatccgaaaaccttggcgcagtaatctgagatcgtggtatagaaaaatggtctgtaggcggcaaatatcaacacgttgagaacacccagagggaagctgcccacaagacccaaaactccaattataagcgaaacaactaacaacgctgttagaacaacaatggtgggacagtggtccaaaaataaacccacaaatggaatagatagaactccgcctaagggtagggcaatatcgaatatgctgttgagcttttctgccagctcgggagagttgaaaagataagcatactgagagtgcacggttgcgacaaaataattcaatctcaacatctgaattgtggaaaacagacacatcaacaagaaccaataagttctgaattggtattgagatgggaatccgtgtaagattccaaaaacactattagtctgtttacgagcttcctcttcagcttcttctgcataagctgttttcatagcgtcaccaagcgaatcttttctttggaattttgagcctacagcctccaattcatttgccacagattgtctgactggtagaagtgttgttgtctctgtaggagggggagctgaacggccagacatgatagctgcgggtggtgtcagatacgaatctccttccatcacaaatatttgtgcaagtgtaataaaggtaggaacaactaggtacagtttgaaaaagttttggatagtaaaagctggatctttaaggaaagacaattggtaaaacaaaaatactgccgacgaggcatcaaatgctcccgtgagcaaagctaaaacggaaccagatttctttggaaaagcgtttgataactgaaaactagaaatataagcaaatgggcctcccaatgccataaatccgtatccaaacaaataagggtcgaaaagtgtgatggaatctgaataaataaagatagaacaggaaataaataggaaacaagcacccagcaatccacagactctaggaccgtaagagtccaaagttcttccaatgatcagagcggtcaagtttgtcaaaacggcaccaacggtgaacatcatattcaactttaagtcctgttctgtacatttggccaatcccaatttaccttgttgcacgctaattgagccagacgattgagcaatggtgtcaattagagaagtggtggagtttgttaacggacaaatatcttcgtaaatgtgttgttgaaccaaaactggcttaagagctgcaaacccaaaaattggccctcctgaaaagagacaccataagatggcacagctgacttgggccaatcttttattccgtggtacttggaagtaaaacatagtgtttagaaatgaatgttcaaccttgaggttttttttcaatgtacttagttgaaaataggaagggaacgatgatggggttgtatgaaagttgaatggagtgtgataaggatatcgtaatgcgcgaacttccgagttaatgcataagtgttgtaaaaaaaaagatacaattaacagatagggagggattgccggcaattgccgctgtgatgaagtcgaaccctttttcttctattggaggtagagtcaccagtcactgaatggctctgcgctggaaaagtcatcgttctagttttgttgtctttccattttggtcggattataccgtattccggagctgtcaagcccccctcggacatatccgactattttcttatggtcttgagtccatttctccaagtatccagtctatgatgtcaggtatatcatcaccttctttgatactggttaggaaaatggcgaaatcccgatctagctctcttgtaaggggttgaagagattctgatgcatttgtagtagttgcagtggattcgtccaacttcacggatatggacatatccgggtgtaattcaagacccaagaactctgcgaatatattgattctgccatacaactgttttctcagtgaggatatgcttctcgatgaccgaatcgagaacccgctagattccggctgggcatctgctaagtaatcaggaatttggtccctattggagtaaaacttacctaaaaaatttctatttttggtactagattgtgaggcctggatatctgatagcttgacgcctagaaacgttgaattttcagtcacttcgtcgatcttattgccgatgacaaccatgggagtttggtcggcctcagtatcaaatagtacctctctgaataactttctagccgccggcaagctgaacttatcactaacgtcaatgacaaacaccaacgcctggatatccttgttgaatggagttatgttatggcaacagaacgatggcttgatggagtcggcactcctgtagtacttgagccattcggctcgtagcaaccttttttgtccaccaagatctatcagcttcagtttgtagttgctattgttgatgtgcttgtagatggtcgttgtaattgctgaaaacgtggggattgagtttcgagagaagggtttcccgataactgcgttgacaaagctggtcttgccgctatttgccaaacccatcacaatgacatctaattgagaataggattcaaaccagcggcggaaaaactgccaccaagatgaggacatatgctactggattgaaatttgtaggtacccgatccgagatgggctgggtaagaagcgcgcgatctttcaactgataccgatacccgtgcagagtagacagacgaccccttgtagcttctctgcccagtcgaacatgagcgtcgttcccatcagccaagaagcggccaataagaagaagcagaaaaaaatagacgatgtgaagtttccgaagatattcaagaagtctgttgacttgaagatggttgatttggaagtgatcaatagctgggtcaagggtaccattgaaaagttgctaggaactgacgatgacattgttatcaattttataaacgagatgctcgtagatgagcttgatatcaaagagatatatctccagctaaaggggtttttggaggatcaaacgctccccttctgcacagaattgtgggaattgcttcttgaagcacaggagtcacgagatgggattccagaaaaactgaaaaaaaatcacaataggattgtcaatgcaaatagacccagatcaggccgttatacggacagaagggttcgtagtgactcccgatatcgaaggcattatagagaggatggtgagacacgagctagagttggagataccaagaggaatgaaagaagtcatagggactacagtccgtccagaagatcctgataatatctaccctagtgtgttataacttttcttaaatcgaaaagcttttctttgtgtcaagaaggaagcttttttcaagtacatcataggattttgcataggagttagtattgacagaaaagtcatttgacaatataaatatgataaatgtaataaatattaatactattgaaaagagcgtcctgagtgctggaaatatattttaattataataataaaatacttttacttcattttataatacttaatattcctgactactactcctaacagtagaaaggagaaacaaaaaggaggagtattcaatcaatgggctgttttcacacttgagtcagctccatccatatcctttcatctttgcctcacagaatggagccgataacgacaagtctccttccaagtttccctgccaaggaggttcctaccaaactctttttgcgcgacttaaactgacccctacgaagtaaatctaagttcaactgccaatgcaactagttggtgccgaatgaagaaccaactttcaaccattaagctttgctatttttatgccagcctcaaatatccactaatttaaccaaacttttgttataagttgttccaacatcctcgggtggataacgggcaatcatccatccccatcccccttcagggcctccactctggttgctcgcctccaccctcaataaagacatcctgcagcgataattagttaccatgcattaccaacggcatgagtcattcgattatccagctacgcaggaagagaaaagatctggatctaatctaaaccatcaagccccgcagaggctgataaatacagcgatgttcatcttacagagtacgttctgccgcctacaaatgaactggcaccgagacccttactccatacaaacttcgatgcgtttgctgaaatttcgtaaagtagtttgaaacgaccaagttcgacagagctgatcgtaaggtaaactacgcggagaatgctccttccgttttactgtacccttatccacagacggtaaaccaccaccttatgtcttcttattcacttgtaattggccgtattccaaccaagttgcaccaatggcattctgataactgaaagaaaaccccaattggcaatcaccgacagatccttttggtaatttgaatctttactaaaacgcgacgattcgtccgaaaagttcacctatcggtctttaacacgcttcttatgtggctcttgcaggagagatatttttgttttcctaatgtccatcaatcgttctgccgatgtccccttttacgcagccgctactgatgcagatattttcgcaacccctgaaattatttaattgacttggtgtttattgtcaatactacgcgctcgcagctacctgcatgataacgttgaacattacccttgaaatatcgacattatgtctccattggatagaagccacgcaacgcaatattcatataggacccagccaacaataataagctgatgcgatgcatgcggttgagctattggatattcacgcagacgagcagaccaaacatgaaataatttcattttataaaagaaccttaccctaggaattcatactttctttaatcccaaggtttgatgattcttaaaggcctggtaggattggcatctgctttagcagtttcgaaggcttttgaccttcaaagtgcaggaagcgctcctgagtttgaaggtaccgacctccctggtagatacattatcgaatatgaggaagcatctacctctgcctttgctgctcagctgaacgcagaagggttcgatttcgatatcaagtatgattactcttcgagttccatttttaacggtgcttccgtccaaattgctaatgataacgaaaccacattccgagatctgcagaaacttcgttccgtcaaaggtgtctatcctgcccaaattatcaagctggacgacactcttgaaaccggtacctccagaccatggaacccacacgcgctgacaggtgttgatgctctacacgagcaggggattactggtgaaggtgtcgttattgccgttatagatactggtgttgactacacgcatgaggcgtttggtagcggagtcggtgattcgttctctatcaaggctgctattgatctgaccgatgagactggtagtggtatcgactgtaacggtcacggtacttttgtttcctctcttattgttggaaacactaaggatgccattggtgttgcgccagatgcccaaattgtcatgtacaaggttttcaccgaatgttctggagatacctcaacagatctggtcatggctggaatgcaaaaggcttatgacgatggacacaagattatatccatttcaattgggtcggatactggtttctccagcacgcctatgtctctaatggctagccgcattgctcaagaaaggaccctcctaattgcagctggtaactccggatcatatggtccactttacgcctcctccccttcggcaggaagaggggtcatttctgttggatctgttcagcaaactcaactaacaactttccctatcacgattacttcatcttcaggcgaagagagagtttatccttactattcttataccggtcagcaaattcagttttctgccgacctcgagatcgagttcacggaagtgagaggatgcaactttgttgctaatggtcaagataattccaacaaggctatcttcgttagacgaggtatcggatgttacgaaaatatcgagttccataatatagctgcaggtggctacaaggctgtgttcctctacaactcatatggaagatcgtggtaccaccccgatgttacccctctctttgatacatacaacgcatactccgtggttgaagaagaggttggaacatggcttaaggaagagactgatgctggaaattctttaaccgtaaagattagtactgatgatcctatgtatcctattgagaattcagtctctcttggagctggtaaaatggactactactcttctcagggacccacatatgagcttgactttttcccaaccatttctgccccaggtggtaacagttggggtgcctatcctggtggagaataccgcgtcggatctggaaccagttatgcttgtccttacgctgccggtgttgcagctcttttcgaaggttccgtgggtatttctgactcacaagattttcttaagaaattggtttcaactgctactgatctagacttgtacgattggaatgccgatgtacttgataccagcttcaaagctcctttgaaccagcaaggtgctggaattattaatgctgttggtctgtttgaagctcagactgtggttgtttctgctccgtttttggagttaaacgacactgtccacagagccagtgaacacgttgttcaaattagaaacgagaactctgaatccgttacttatcaagttgtacacgaacctggtacctcacttctgatcagatccaatgaagtcatggaagggttggtcaatgagaattttgctccatacacacttgatgaagttgcaacagtgattttatctaccgaggagctagtgctaggtcctggtgaagttggggaagttacagttaatttttcaaccgaaggggtcagtgaagagactgccactcttgtgcaaggtaagattgtattctacggtgatgtaggtaactctgttgctgttccatatatgggtcttgaagctgatctttatgagtggacggttcttattgaacagcctttggcagttcgtctctaccgtgatgatggtactctgggatttatggaagacgatccaacgtatgaattcgatgtatacaaccttgattccccaagattttactacaatatcagatatggtaccagagagatctctattgacttggttgatcctgaatttagtattgaaactgactgggagtggcctttggttgcaaatcaaaacaactggattgactcaattggatatgaagaagatgtcactcttcctttccaaccacgtcgtttccaacagcgtgtcaacgctctaggatacaacacattcagcagatttgccaactcttctgtgattccgggaggagattataaagcattatttagagctttgagaccagggggtgattactatgtcaaggaagactggcagctcttcacctcatctgtattcaaaatcaaagccccaccctcagatgaaaccaacactgaggaggagacctccaccgatgaaccgactgaagaagaaacttctactgaagaagagaattcaactgaggaggaaacctccaccgaggaggaaacttcttccgaagagccaacctctgagtctacggaggaaccaactgaagagccaactgaggaaccaacctctgaggaaccaacttctgagccaacttctgagccaactgaggaacctactgaggatgcaacatccactactgatgatgatgaaacatctaccgaaacttcgactgaagaaccaagtgctgagccaactggtccttacgctgatctgactcttggtgaggccattaccaacgtcaacgtcagtagtgagagaacaaccgaagcatttggatacacctctgactggttaattgtgtctttcactttcaacactactgacagagatattactctgccaccttacgctgttgtacaagttgctattccagatgaacttcaattcatcgctcatccagagtatgccgagttccttgagccatcgttgctgaatttctacaccaaaaatgataatttgatcatgcgtagtgaattcaactatgacaccaatgtcattgacttcacgttcgataatcgggaccaggtgacaactagagtggagggagttgttttcttcactatgaagctagaacaagatttcattgccacattgagcccaggtgaatatgacttcgagttccacacttctgttgacacttacacttcgacctttgacttcctcccattgattagatccgagccaatcaaattgatagcaggcgcagcagatgaagtggaatggtttattgatattccaggcgcatacaccgatctaacaaccatagacattagctctaatatcaacactaatgcagattgggagcaatacttctatgattgctcaaagctcaaatacacaattggaaaagagtttgatcaatggaataactttacagctggatcagaaggtaaccagtacagtaatactaccgatgggtacgttcgaattactgattctactggctctccagttgctgaagttcaatgtttgttggaagaaatgtcactgagtttcacaaacccaatagctgaggatgaggtactgagagtcgttcttcattcttctgcatttagaacgggtacgttgtacatggccaacgtaataaacgttgacattacaactggcggatcagtgaagagagaacttttctcttatgcactggatgaaacttactacgctgataccagatctgatagattagcatttgacgcatttgaacttgctgacgaggttgtagaacctacagaagaaccgacctctgaggaaccaactgaacaagaaacttccaccgaagaggaaacttccactgaagagacaaccgaggagcctactgaggaaccaacatcggagccaactgaggaacctaccgaggcatcaactgaagacgaaacttccactgaagagtctaccgaggaacctactgaaggagaaacttctactgaagagtctaccgaggagccaactgaggaaccaacctctgagtctactgaggagcctaccgaggagccaactgaggaaccaacctctgagtctactgaggagcctactgaagaaccaacttctgaagcaacttctgagccaactgaggaaccaacctctgagtctactgaggagcctactgaagaaccaacttctgaagcaacttctgagccaactgaggaaccaacctctgaatctactgaggagcctactgaagaaccaacttctgaagcaacttctgagcctactgaggagccaacttctgagtctactgaggaatctactgaggagcccactgaggagccaacttctgagtctactgaggaacctactgaggagcccactgaagagcctactgacgagccaacttctgagtctactgaggaatttactgaggagccaacctctgaaccaaccatcgcaccaacaggcgagccaactaccgatgatctatcaactgagtcaactgctgaaccaactgaggaaccaactaacgatgactcatcgatcgcacctactgctgagccaacttccgactcatcttctggacaatctgtggtcactcgaatcactacggccactcagacgaccatcacttcagtctgtaatgtatgtgctgagactcctgtaactatcacctacactgcaccagtagtgactgacgcggtctcttatactactgtcacctcagtttgtaatgtatgtgcagaaacaccaatcacagttaccttgacattgccatgtgagacagaagagaatgaaaagactcaaggaccaaaaaccgtgacatacactgaggtttgtaactcgtgtgctgacaaacctgtcacttacacttacactgctccagagtacacccaaggtgctgaacgtacaacaattacatcaatttgcaacgtttgtgcagagacacccgtaactgtcacatatactgcaccaaaacaacagtccactgtgcctgctgaagtgtcaaccgctaaggagttcagctctaatgttgttggaatcactacagtctcttccaggccagctggttcacgcagtgagtccgttatctctgctaccgctatagttggctcggcaacttcagccctatctgacactaccattactactcacattactgagacagttaatagtgtactttcagtgcagtctgagtcagtcagcaccaacgttacagctccaaccgtcagtactggaaatgagaactctggtgccagattttccgctgctgtgattttctcaattcttccactggctttattagctctttgagcctagcgatatgataccccttttgtctttattatttactataagccacggacatctaatgattctatagttcgataaatttactttattcttattcagatttggggctgacgtcaattttctagcaattcactgtcttgcaaagacgtttgtagcgaatattggcttccatggattgagattcgccatcatgctgttatttgatgctttagtatttactctagaatatttggcattttacgtgaggtttaactagcgaccccacattcagatctagcacctgtaaaacaaagagtcgataatggggccgatctaccgcccctttctttaattatcgtgtctcaataatatccaaaaaaaattggtgacctttctcagagtacaggtaccccaaaaaaagttaccgtgcaaaaagcgtcataacgtctaatgggacctggctactgggcgatgattcatcatgactcagcgaatctgtcaaagagccaacggatattctcgaattacctgtgaatcgctaagataagcaggcaaacatcggcttcttgtactctttcccattacacattgcgcattattggtcgcagattctatcaatactatttcacgataatagcaaggcagacgacatcatcttcaagtcgataacctagggttgcatcttaactacaaacgccagaaacctgtatgagcgccctcaccggtagaccaatggcccccatcacgggtgaagtgaatgatcagcataaagttctattccacttgccctctgccattgcttcgcagaaacctatgttgatgtcatacactgcatccattttaagtacaacggtcgggtttccattggacagtttaaagacccgaatgcaaactcattcgttcaacagtgcatttcaatgtttcctgtacaccataaagtctgaaggttacagaggattgttccgaggaatagcggcccctttggttagcacttcattttctaaatctttgggtgtctccatttacatattcttcaaaacgcctgtaactgaaatcagagacagatatctagcatacaccaaactcaaagttgacgaataccctcagagaaattccatactgaataatattcctacttcactgtttgcagggttcctatcaggatcgctggtatcactgtttgcatgtccctttgaattcaccaagcttttttctcagatccaaatactcgttaccaagtccactgcttcagcacataattctgcacaagctgctcccaagtcaacgctgagagtagctagggatatcgttgccacagatggtctgaaaggtctttactctgggtacagatatcatctgatgcgagattcaactagtacggcactttttttcacaatttatgagacattcaaaatggcactcggggccatatcaccggatgatggttatgttcaggggtcgtctattccaagtgcccccatagttataattatttctggagctctttctggtgttttcacatgggccacggtatttcctattgatactgtcaaggcaatgtatcagaaagatattgttgccaatatactcagaaagagaaatggagaagagagacttcctttgaagaaggtcaaaattcaattgtttaacagaagaatgtatcggggacttggcccatccgttaccagatccatcataggtacagtggttttttttagtgcgtttgagtacttgatggccaatgtcgcatagttcgtcacagattctcagggctgtcacctctgtttacctgaataatatttataaacatcttatcatatagatacttcttatagagcacaactacaatcgatttgcgtcaccatacattagcttattcgtttgactgggagtcacctttggcttggcctctacctctgcctcttcctcgtcccctacctcgtcccctacctctaggtctacctctcacgagtgcacccctagctcttatcatctcatcacctcttcctctcatctttaaagtctccgactggcgcttaggtgtagctttttttgaaatgcgacctttttggatcttactacctccaacactgtctgttccgtggataagagcttgattcttctccgatttgggttcctgtgcaaggtcctgcgtaggtcttaaagtgttgagatctcctccaaacaaagctttgtctgcctccaggtgcttcttctcgtcgtctgcagtctcatacaacatttccttcgatatatctgttaaaacctttgatatatgaatcttgccggaggcaatttcactgattaggttattctgaaaaacctcttcattatgggcctcctgtagttcttcaacggtattggctccaatgaacttcccacttcttgtcctcatataactgtgatcgggagaacctagaccaggagtagcaattttgggagtggagagttgaacttttggagacgtaacaggcgttacctgattctccgcttgctctttgcttttagactctttctttagtgagtgagggcttgaagctttagatttcttggcaacaagaagttcaaaattgtcaaaaggttctggcttcccttcggagactgtcgatatttcccccgcagatatagattgctcttctttttctttttctggtccaggatggtgcacagtggacaacttgttagggttgttaggcgagctccacccgtcattagacgattcaactggagactgcttagatgcagcattagtttgtaacagtctaccggagactctcctggtatcaggagaatacggtgagcaaagcacaggagacttcgaccgggtcctctctgcagggggtttagcagagcttctagtaaccctacttgttgaaggtatacgctgatttggccttgaactcgacgtagaaacatataacggcttccgggacctagatcgagatcttcgttcacctgaatcttcgctggcctcctctgtgttctggtttatatcgttcatatgatcagtttcagcaatactagttgctggatcattttccaaagtggtatttgtgcttctcagtgactggtcatcatcctcggaaataggtgaaaagatttccgtttcctcccttttcactacaagggtctctgttttgtaatcattgtgaatagattcttttgtgtcgttactagcgacgctaacaggctctgaaggttcttgattaggtgagtctctcttaaataattgtgtgaatagagatttcaaaaccttcaacttaggacgctcgctcagttcttccagcttatgttttctaggtgacgatgcagactcaattgtttgatccaaagagttagcacctttggtaggaaataatgcactttcctcataattcaccctttcttcaacattgggaggctgaacagaatctgtgattgaagagtgctggagatcttggagatctatttcttcttgactttcaggcttggtttggatattgctttcagatgcaggctcagactcggaggaggctgccagctcattcatggagtcaggagggatttcgtttgaatttttatcgccaacaacaccgtttgaactgctctcattagaacttccaggactactatttgggatcacatctgatgtcaatgctatagcagcagaaactacttcatcctcttcatctgattgtacaggagtttctagtgcgtcctcaccttcgtcaataccagatttcgtttgatcaactgaaatctgcatcaagggttcttcagagttgtctagcactgcatcagagacatcaacacttttcaatactgtgaaaagtttttcaggaacttcacgaagcctggaaaatattgaatttcctagagacagttcattcttaaatgcttcagtgtctcgtataaaagtggaatcactgtgaacagtttcatctgctgaggtctcattaaatttgctgttcttattggggtcatctatatcagatacagaggcatcgacctgtgaatcattatggtcagatccggctctcgaagccacactgaaagctaaaacatccttttgctccttatcctcggcagaactttgtttggccatcaaagatccttgattcctagcaacggaagttatttcaagtgactcagaatcattcgagtcgttttcttcctcacgtttatcaggctcatcggacactgcaccatcttcctcactctttctatcaattgttatattctcagaaaattctccagggatattactggattgatggtacaaagggcccagaccatttaagttggcggctgtaactgattcttcattttgagcctcagcgaatgattcgttttggtatatagcagattcaaaagcagtgtcttcttcttcacaaaaagtagaagaacgatcactattccgtgctatggatgcaatggttgaaactacatcctgttcattgtttgcgccacaggttgtttccactttttctggctccgtttttgtttcattattttcatccaaacggacgttttcatcttcatcaaaagggaaaaggtcatattcaacagcctcttcaattatttgttcaacaaattgcaagctttgaagaacacttttcacttttgagacacctgtatccaatggcaactcatctttctcatctgttacactattaggttgcaaaccttccagatttacattggtcaaagcttgagtagaagatatgtccctcatttctgaaatcgaaggttcaccattgaaatcttctggaaaatggctgtttgtatcttccaattgctgggcagtagtttgaagatcttgcttctcctctgatgccacttttatatgagcatcttcggcaccttttgactgtaaattgttttgaagatttggtgctacttgttcatgcttactgtgttcgttcttgtagtgttggtctctgacggtaaaagaattatcattaatgttgggttgtatttctggttcttccagttcctcatgttcttcaagttcttgatatccttgatattcaatgttttgcaactcttggtgtttcacagactcttcaaagtctttttgataattttcgttttgcagagttaaactgtgatcagctgttgcatctgccagtgcatttgcagtatgaaattcagaactggaagaactgtgaatgttcgttgcaacttgctcatctaaagattccatatcttctacgtttgggctagaagctggaagggttggcaagttatcaatattgctgtcaattataggcgttaggttttcgtcttcatcagatacagggtgatctatagtcgtcgatttcgacacttcacacacttcatgaggcgatttgttttctatctcagcttgagacttcaaaagttcttcatatcgatcagtagaattgcggtcttcgggattatctgcgggcgaaatatgtaagtgctgagctggcgattctgatttgtttgaatcatttgaagattctccctctagtacaaaactggcatttgcttccgagtagctattttctgccgagggttgtgaagaaagagaattcaaattagagccctcctgatcgatcggcgaagatgttgccttaagatcctctacaaaatgtgcaggttctatatcttccatttcacccatactttgatcgatctctgcttcgactgttactgcaccatccaggtttctacacgcatctccaatatcagcattagatttgctctcttgtgttgacgtagattcaactttgttcgattcatgttccaatgaaagatgggataaagccggttgttcattgtgagcttttaaagaagagctcaacatttcaagaacagaaggaacgaaaactggaggtgccaccccagcttctgtttcggagtcactagagctatcaaacattgttggtctttgttgcgctatggtacttggaggttccttatctgtagctgatggtttattagcagattcggaattagacctatattcttgtgaattttcttcacccgcatcgctttctgaatcaattttgtcctcctcaacctttccccgggattcactttgattcaaaagttcctggttcatattaatcatgaactcagcaatcccttgaatgttagtagagtccaaaatgttgagatcggtatcaacttgagttgttgtttcttcatcttctttctgatgtgtcaagtactcagtggtgttattattagctgtgaagtaattagtgtcgtgagaaggagatgatgattcgtcggaagtgttattctccgaatgtgtattttcatgtggagaactcacattgactatgctctgagacgtttcggctctaggttgcatgaatccatagattgaagaagatgagtatctatagttagcttctggaatatcatctttatcctcagaaaggtccgattgcgtgtcttggtcctcatcttcttcttcactctgttcattgccttgctcttgcaatccttgcaattcttgaatttcttcttctttttcttcctcctctccctcctcttggccctgttcttcttcttcttctgaatcttgggtctccaatgcttcatattctacaaagggactttcctcttcctggctgtcatggtgtatttgcgagttgaagggctgaatttgagtttggccaaccgtactatctgccaattctggaaaacgggcgtctgaatcatcattattttctgattcttcgggttcttcactttgtattcttgcaatcttctcagttggttcagcatattcagcactttcgttaagcagagaggtcaaagcgtaagttacttctgactcatcatattcgaggtgggtggaggtagatgattccaccggattgtcttttagatcattttcattctcagaactctcgtactctagttcttgatcagatcgaggtccgtctgaaaattcctgctcatcttcgttatcttcagacgatggcccatcatccacttcaatgatttccaggtcagatcccaaatcactctcttcattctgaggctccttgaattcatcatcttcttcaagctcaggaacttcttcatcttgccactgactctgatccactattggggtctgttcctcctcttctacgaagctcgattcagattgggcactcaaagtatctttgttccttttagcactggctagtaactgacccaatttttcaaactcagagtcgtttacttgcacatgttgattcaatctttctctttcactttgtaattgtcggatcatctgtttctcttcagtttgagtctccaacaatgagttcttagcctcaactgttatagacttcatccaagatactaactcatcttcattcttgtcaccattcgtgagaagatgagtgtgcttctttgttggcaagtcagttagctttctgagatagcttgacttggaaatgatgctatcattcagtgagaaactcaatgaaggaagttgaggcaagtggcctggcaatttatgtaaggaattcacagtagatgccttctccttccttttcttttcggaattcgttttactgtccattatttattgaccaattggcaactttaagccgtttggtgctttaggggagactgaaaaggctgacttgactttctttctgtacagaaagatgttcgtgggctatcgcgaggaagtttcttacataatcagtatctatcctcatctcttcaaacttcaagttcaagcagcttccacgcatcacttggacaatcctcttcccttactgtgagtagccatggattgcaagattaagatcggtgtttatgaccctcttggctgcagcgagcactgggaagagatgctcatgtcgaagcagcctttgacaaatttgcattggaaactggggcctcaaagcgtgttgaaatcacttccaccattgcatctggacatcgtgaaagaggtcccaatttccataaagaacatcaaccctagtactatacaggaagataatgaccagtactttcattccgttttattggaaactaaaaatacggccagtgtgcccgtgaagatcatgatcgttggaagcgacagcttggatgactatcgttccaggataaggcctctggtcaaggagtggttaaaagcagaagtgcattcaaaaataataaagcctaagtggcaaattgtcttctatatagacgcgtctacgaaagacagaacttccatttttcaaaagttaaaaactgattttggaggagacattgaggaaactgttgagaggtgcattaagttgaaagaaaaatatgccacaaaacaggaagagactgagagctggacttcatttgtatctggacttaaagatatgatattacagcattttacgtttaaattgcagttcctagaaggtattctgcagaaaataaacctgaaaaggaatcttgcaaatccaatatatccattagcatttagacaattgatcgcaaccacatacaaagatatgtcattgtttaacgactcgttggcaagctatgagatactgagaaaaaactttgaaaatttgttggcaaagaaggagtttgtttgtgaaaataatgttgaatgggcgcaagatatagatggatttttttccaagtatcaggaattaaaccttattgatgagttattgaagaaaacagttaccaagtatacgtttcacacttcagttttcctgcaagagtttgacttgtaccttcaattgataaagcttcccgcaacattaacgtcttcgaaggcccggcttactacagaaatgttcaaacgatttaaatctttcatgacaacaatactagcaatatcgtcagaatcagaggagttgcaaaactatgaaatggtttatagattgatagacatattcttgagtcatcctgaaattttgtcattaacggagttggctttcaaacacatcaataccgatgatgttcaagatttatctgattttcctcaagtgattgagttatgtggagaattaagattgtatcaaagaaccaattttaagaaactgggcgaagcattcaattaccatgttgcagatatccctctgcgggatgttcaccctactaattacaagattcgatcagcagttttaaagcagtttttttcctctgaagaatctttccaaaatcatttcattgagctcacagagctcaccatccagcattttattgactgtaataatcgaagacggactgctgacaccttgaccacagaactggccataatggcctacgaaaaaggtgactatgagaaaacccgaactatcattcatgatgcaatttactattttaaggaacagggttggaattttgtaagcggatacgccttgaaagtgtacatcgattgtttgcacaagacaaatgagaaagacagtttgttgtttttgggctcatatcttcagttgtttgccaccaactccttagcaccgtcgcaagcagaccaatgcgtgaaagaagttaagaagcgaattgacaatgttccagaaactgaatatgatttgacaaatttttgttccgtttcagttggtactaatcaaatagttaacactgttgacacgtattccattgagataacgttgtataacaccgtccagtctgaaaatgagcggctagtatttgataagatgtcactgcatcttgagtccaacgatggaaagaaaagacttgcttttgagattgattctgtggagctgaaaaacgataagattttactcaccagtaggcagattatcaatgatgagtttgttgttaagaagctgatctgttacatgggaaaactcaagtttgtcaaatcgtttagtgattggttttccactagtcgcattctgctatatcaacagttgaccacaaacgatcttcaaacgaagaatacgatattgtcagtggatctaccaactacgagagagctgaatatggaaagaattcttgtgaattgttacactggagatcaggatattcaaaaccttgtttttgactttacggaaacagaaattgaccaaactttggaaggaatgaaattagtgcacaatggcgaggaagtttcttttgagcttctggaaattgctggcagtctcttaaaaccgattcgtttgaatggcaccatcaaaaggaatagtcaccttgagctgtttataccttattcaagagtggaatatgacacaaaagtgttgttcaatgtcacttgcaggtatgaatcaaccgaaggttttgaatttagcaacagttatcagagaaatcttaacatatcgttatcgattgctgtttctgtgcaggatctattcaaggacaggtttctctactccaatttcacaataggcacctcaacgcaagataaatatctaataatttcagatacaaagttctattctccggattccaaaaccgaaacagatgcaactttcagaataaccacaggttatattccagattctatacttgcaagttacgagcaaagagtatctgtgttttacattctcgagccatttgagaattgttctgttcaaaatttgtgtttgaaagtgacttacagaagtatcgaattggaatgtcgaaagtactccagagctcggttgacgcaaattttgactgaggaaaagttactcaactacttctttttggtggaatctatttgtgatgacttagaatttgatgaattaacttattacaacaaaaagatcgtaaaatcaaaatcagtccctcaatggcaggatcaactgatggcagaattccagaataaagacaagaaccttttcagagccgttaatcatttcttggacatacttgctcacggaatatatgccgacgatcattcggtagtttcaatggaactttttattgatgttcctatgccgtcgatcgatatcttacacgttgtcgattttgagcctatagagcaaaatgtgcaagatttcagggtggaagagcctatacaattcgcattaaaactcaagacggatactagatggtccgatatggactttggaaagcaagaaagttgttcagaattatcgaatgatgataaagaaacggtggataaaactacaggggaagagaaaaaagtagaattgaacagaaatataaataaaaagtattgtttttccttggaagtccaggattctgatacttggttgattagcggaattaccacatttacttacgaggtggatttctccagagggaaaaatataactacctttgatgaaatgcgatttgttttgatacccttgaagaccggacaacttttgcttcccaaagtcgaaatcaaacatggagaccctggtgagtctttgagatatgaggtggattacaagaatggttccgaaagtattttggtggttagtgcgtccaaaaacgcaacaacagtctcattttgaagtaaggctcattttgtctttagtgcactttttgtatagacaatagtaaagagataggctctggcttaggtgccacaacttttggtttcaggtttttgcttagaaggtatttttctgtggttggcccgatagatgcaatattaaattggtctttggtgtgttgaagatacgttacaatgtcctctgttccttgaggcgaaaagaagaccacccaactggaacttctttgcgattggtcgatgctgtcaacggcagacttgaatctagtcacgatatcatccctaggaagagtcttgtagacaatcttttcgtaaagttgaaagttgttagagagtaaacatttgggaattatgtctctccttgtttctcccgtgaaaaacgttatatgcttgtcagaatcttcaattccagtgtaaatgtcatcattcaaaattatctgggctagaatggatccgtttcctgccttatctccgcctcgtagatccacgaagccagcatccgcaagtattctgtaggtggcagggccaactgtatagacaggtttactatagatgatttgtgtaatttcaggatcagtacgtctcagtatttgcatacactcattcagcatttctacagctctttgggacgtaataataaacgccaaagttttatgcaaaaagtagtcagtcttgagaaatgcgatgatctcagatttctccatgtgaatatgatctaaaagtggtacgaaatcggtcgagtagccactacttacgaagttctccagataaggatccttcggtgtagttttattcttcagaagaatggcttttggcatgatatgggacaacaagaagacggtactattaactacggtcaaagtgagagaattttgatggtgttgattatataatcacaccagttttcatctgaaaagaaatgacatatttggcaaagaaagggggtcaacgtagttagatgttactgactaaacttctcggtacctgctgaaacataaatgcaaaaccggactggctttggaaaaagggttagagagtaatttgcagcagctcatcgtcatccaccccaagattagagaatattattcagacccaatgcaaaaaaaaaaaacgtgggggttcgagaaatacacacttcactcagacatcagatttgctacgaagcccatcatatctaccatataaggactactgctaaactgagtaactatgcactcattaaagcatgatccgccagaacctagtactgggtttggtcatgtcctgaaaagctttacaaaatcattcaaaagctctacatcgacttcaggaaagaagtcagttcaaataaatccattaacaataggaggagacccaacccaaaggggtctgcttgaaaaagtcagtcaaggctctactcagagcaggactgagcatctttttaaactgtatgagtctattggaagctactctgtgtcttcaatcccagaaatttggtacctggtgaaggatttattaggttccaacaaccctgacgatacgagggtagctgcattaaatatgctgattctgtgtataaaactggatgaaagtgcaatatcatcaacaatcatgtactatgatgatattcttcgctactgtacgttcactcccagcggattggataggcactttaacttgtttttgaaagcactgacaactttgacaatcaatggaactgatatacacttgcttgccacgtatgaaaagaaaccgttaggtaaatttttgagtcaagcaatggctattgtggaaagttcactgagatccgcttctcacaagaatgaatcaacggagaacatcgatgaaacattatgtcagatattggtatatattactgattgcatcaagttcaactctaacagctttgaatcttttgaaattatacactttctttcacaagtcattacttttaccaagataactaccaatacttctattctagaaagatgtttattctttattgagacattatccttatatggtgtctttcccatggatcagttaacctcagttatttccactttggcaacagtgtacacttcagaagaggaagagtttcaagagcttagacataaggtaattcgaatattagacacgttgatccaaaactctcaaacaaccattcccaccatttttgccatctgtgaattgattcatcaaactcatttcgtttcagaggtgaatgagaatgttatagttggctgcttggagttcttgaaactattgattatgcaagaaattgacggtagagctttgaacaaacatagaaatgaccgactgaacatgtttcttgacacatctatgagtcatttattagaatcttgggagaagtcctcggagattccaagtttagttgttaaagtagctcttttgaatttttttctagagatactgaacacttcttctgattactacaagatttttggctcgatgttctggtttaactcagacagttctttgtggcgatgttttgacaacctggtcaatttttcatatgacgaggatgatgatgatgccgacgactactatcgcttagtaagttctcttctttctgttttgcaacgcctttcagagactggcaaggtgctgggaatgaaagacaattgtatgaacttttttaataatagcttcaggagactttctgactctcatgccaccactgtcatcgaatattatgagaaaaatctattatgttacgaattcaatgtcgattgggaaaaaaattctgtcgatattctgcagagatattttatcaacaaaaatctatcccttaccaccagattaaaggcatttatggtggtgaaagatgcctgtacatacactattcaactaaaaacggagaacacatttgtttcaacctacctgtatatactcttcttgaagtttgaagatgacgtttcagccagtgatgaaaaattaaaagaaagaatcatagattgctgtattgatttatgccgagagattgattatgactcgtttaaagaattaatttctaatctgactcaacgttttgaggacacaagagatgtcagaagacgaagtatcacttctctatacagttacacttctggcagccagatgtctagatttgcgaatccacgtctttccgatacagctagtaatgagaaatcggtataccgatcttcaaagtctattgctatgctcataggtaagctctttatggtctccacaattaagtatcgggataatgataaggtgttacttttatatgactccctggtgaagatggcaacttttgggatcaagatgaagttttacagtaccacgctaatcatcctcaaggtgctaattagagtaaggtcaacaacaacatatgacctttattttgccaatcctatcgagactgacggtcttgccgatgccatgcacaggaatgtttccactgatccttccatatctgaatctaaatcactgaagtgggtctatccagagagtgacaagttacactatattccattcgattgtctagataaatgtgtgacgtgttcaaagaccagtgtgagtaaggataccagcttcgtggacgtcagaaaatggtttcaaattgtgcttgatattctcacaaatttctatgactgggagctgtattcttatgtcctggctcatttctgcgcccagttatcaaatctgtatctttttgacgattcgacaaagtttgttcaggattttagaaaagtaatcacagatcaacttgagctaaagttacccagttcgttgaatccgcctgaaaatgttgccaaaactgatattcaaattgcttcaatcagggtcctttcagcattagttgcctatcactcgtgtttttcaaaacaggatcaagaccagctagttgctgcgttaattcacggactttcttcttgggaaaagactgctattccctgtcttcattctttagtcatttgctgttacgagttaccaaggtctttgaaacgttatctgtcatctattctgacggctctgcaaacccgtatctctagtacctttgccattgcccacatcttagaatttcttatggctttgtgtcagttacccaaaatgtcgtccgagttttctctacttgagtttaagagagtatttggtgttgcattcaagtttattgagtatgccaaagacaagttttcgaattctgactactcggatgagagtcagcccaaccaaggaggctatgcaaagtatggccaagaaatagagtttgataaattaccctccaccaaatcaactgctgtgactccacaattgctacaatatattatggctttatcttacaacgtgatcactagttggtttttggttattcctttgaaggagagaaagtttctgtctccttttttaataagaaacctgctttcttccagtgtgaaaagtgaggactctgatgtttcagacgaagcattggcaactatagattttgtctcaaggtatacctattcgaatatggatctgacctggacaggagacaagcaggatcaaaaaagcactagtgactccgacgaagaagaacttttcagagaggcaagctggatctctggaatttcaattttaaccataaaaacaaacaaagtaactggagacagcaccatcacagttagaaaaccaatcggtacgagcgagttcagcgtttctgtccaaggtcaattgccggccaatatttacaaggacgatgaagaaaatgagaaccttcccaaacctgccaactacactccaaatttcttacttttgcaatttatgcatcctttaggcacaagggtttgcaacaaacccttgccgttgagcaatgatgacagtgtaaagagatcagtcgatttgtttgataaagtgcccgtagttactgctttgaaagcaggtataatttatattggtaaagggcaatcgacggaacaacaagtgcttagcaatcttcttggctcagacggctaccataaatttattacagagattggagatgttatcaaattgaaagactcgcaacctttttatgttgggggtttagacactacaaacgatattgatggtgaattcgccatatcctggggtaaccaaattactaggcttatctttcacactacaactttgatgcccaacaacgaagacgatccgcagtgctctatgaaaaagaggcacataggaaacaatttcgttaacatcttctacaatgattcagagtctccctttgatttcaacttgataaagagccagtttaactttattaacattgttattcaaccacattcaaggaatctgcacaaatatgagtctaatcattctgaaaacttttacaagatcaagatgtacaggagagctggtcttcctggcgtcttttctactagccacttcaaattaatttcggtttctgagttgccagctttcgtgagaaatacaaccataattgccagtttattcgccaacgtttggaatgctgacggcggttacatttcgaattgggctcatcgggtttctagaatcacaactatcagggataaatcagttgtttaccacgaaaatttgaaggaagagcagggtgaaaacgggtctgattggttagaaaacagtcaatctaggtctcattccaatacagttgttgcccaatccttcttggatcaactatctcaactggatattagtatggtgccctctgttcctaattcagctgcttcggcagaggataaggacgagaaaaagaagcgattcaagttccagtacgttcatgaaaatgatagtgagctctacgaaagaatggagttcaactcattcaccacctaaaaagtattcacaagtaaatttcttatatacataataaaaacaaaactttaagcaattcccttaagtgcggtttcacttagcagaatcaatttttcaatgctggcaagatgtttagcataagaggacttggaaatctgtttcaaatattgcttaatcttaataattaacaatttcttgtcatcctcatcaagagcgtccaccatcttttgaacaacgtaattggcaaatggatctttcatcatcagggccaacgccgagttgtcatcaacagttgtaacttccaaggacttattatccttcagtagttcgttgaatagcatatggcgatgctccttatttccataaatgatacatttctcaacagcatttgaggcaaatttgtgttttgaaaacataaccaaattcttggtgacaatctccgtgatagtgcttcgatagccttcttctccaaattctagaatgtgctgaataacgtagtttccatactggtcttgaatcaaatagaaaatatgattgctcagtacttccagaatgaatttttgctcgctctcactgcaatactccagtaagcgttgaataactctgcaaccataaggatgcgtggacaagtggtaaatatgctgtctcaaggactccaaaataaatgaaatttgatcaaacgatatcttctcaatcgatttttggataacatgattaccattctgatcctctactaactgcaaaacattatcctgtaattcggaggcaatttcaatttgctgttcaagttgcacaaattctagagctctctgaacaacacgacatccgtacatctgcaaagaaaggctttgcactttccctgtcattattttcaacaaacgagccttctgctcctcgctaccatgctcaaagtatttctgaatgacataatttccaaacacatcggtcatcaattcgtaagaggtaggttcgatctcttcaaaaattgtgtccttttcttctttggtggccttactcaattgctgctggatgaatctggaaccatgttggtcacgagcaaattctggaccgtgtccgtatatatcccgtaatctgtaatcctttccagccttgttagaacgaaactcttccaaaaggggacttctataaatatgctgggctctaggtctattcttggaagctctgccgttcttggctggtggttttgaaccagaattattagcagccgcaggaaattttgggggagcagaatgctgtggaaaaggtgacggaacttgtcctgacattccctctggcagcattggaattgggggagacgtcgcatcaaaagaaactgacggcatcattccatacggcgaaaatggaggcataacaaacggagagatgggagcacagtttctgtcgtcgttattgaaattctgttcaggttcatcagttaacacgctgcttccttcaccagaagttggcttaggatgtttcagaacagttgctgaaggttgaatgccgtcttttgttttctcagattcaacctcattcatcggggggaatggactcattggctggaacatatatggtgagtaagggaagggaacagggttaaacacgggaggatattgacggggttgaaaagtgttggatggatgaaatgaagttgcgcctgccgggttccagatagtattatgggtcttttcttgttccgttatagatggagtatgatcggaagagatggatagacggtgggcatggggagagctgaggtaactatcaattttttcactgaacgactggtgtctagagccagaagggttagagggttcgttgacaagaaaactggttcttctggatccactttttttggcagtattggtgccgatcgcaagagacttcatattgaattccacttctctagttttctcagtaagggaaccgaacttttccaagaagttactgccggctgctgaagctcctgtgccattagcatacgaagaaaattgacctccggaaacagaggcggctccgaaaagttgatttgggaacccattgcttttgttgttgttgttgtaagttcccaaaggagcgctgatagcactcaacgctcctttgttgaggcctaccagaggggattccgcaaatacatcgctttcagtatcactgacaacagccgatccctttggaatgttgtttgctccaatggaagaagtgctgttgaagaagttgctacctaaagtgtttccattcaaagagggagccatatcaaatggcgaaatggatgggacagacttttttgagaaagcgcctgctgacttattatcccaagggttcaacgatatattttcatccactgacatgagttcttgagttacacaggttgctggtctcttggcaacgggttaatttctaagttggggtggaatttcgtttgataaacaaaatggaagacagaaaataaatctttgacgaccaaaaaaagagggaaaaaaatcagctttttatatacaagttggaaatgaacagatagttggacggcctctcaaacaaatcaaccgttggattctagtttgtgtggctattggacgtaaaagtatcgatatctgatgtagcggaacttggtagaggacgacggagcgataagttcgaagccccgacccttttgcgcgcgcgaagagaggagactattttggggaggctgatcgctggtgcgtagagcagaaaaggcaaatactactacaaaattacgccatgataatcagttaaataatcaattctgacggagtgttaattactgtacatatgttcaagtattaaagggtataagcaaccagcaaattattaaaggggaaggtagggaaatagatgttcttagttctttccggaactgctgccctccgttctttcttcgagggctctgtcataacttggaggtgactctgcgggtgtgggaatgtacgttgctccgtagtgggggttgaatcctccattgcttccctggtgcaggcactgctgtctgctcgatggtctgtcaaccgttgtaggagaaattgctcgttcgactggaggattgacgtaaatcacaccagcctgacccagctctgggtccaaatcgacgtagtaagcttccggataccgggagatgatataccatgaatgtagtagacccggcagatatcccaggatacacagcaaaatgttgatcactgagtctgctgaacagagtcctctcttaacccacaccgggaacggggggaagaacacagctattataaccaataggcaatcacaacaacacatgatggttggtcttttatcttaacggggaagatctatattgaatggtggggtaaataaaaggtgcttttatagacttgaagtaaaatgaaaagaaaagttcttttcctcggggaggttctaagaatgatgggttttctaatcggaaagcctagtagatataaaagcaccctattctcaattagtttggacacgaccttgggaggcaacccgagccttggccaacatccagcatcggcatttgagcatcggttttcctttctcggttctcactcgttctcgctttgtcaccaaaatcaactctctctctccagccaaagaggttcccaaacaaaacacgcagatatccacttagttcaatccaaatatcaaattcagaaaagagatggcaggaggtttgaaaaaattcatcaagtctgttcgaaattccaagactatcgctgaggaacgagcggtcattcggaaggaaagtgccaaaatcaggacttctttcaggaatgtccagttggatgaccaaactcggaagaagaacatacagaagctgctgtatttgtatataatgggagagcctactcattttggccaagttgaatgcctgaaattggttgcgaccccgcagttttccaacaagagactgggatatctagcaacgatgttattattagacgagaaccaagaagtaattactttgataaccaattccttggacaatgacattaacagcacaaatcagtatattgtcagttcagcattgactacattagggaacatagcatctcctgatatggctcgtgacctttacactgtcgtggaagcccatttggatggaaataatgcatatttgaggaagaaagctgcaattgttgctgcaaaattgattgaaaaggaacctgatttggttgaagtattcttgcccaaagttgaatctttactagacgataagaaccacgctgttttgcttggtggtctccagctggccagggtgatccacgaaactgactcaacatcccattctacattgtctgagtttgttccaaagttgctttatcacttgaaaatgttggtgactacaggttactcaccagagtatgatgtaggcggtgttccagatccgttcttgtgcgtttctttactgcagacactgacaatgctttttgagagcgaccacaattgcccacatgtggaagcataccacgatctcctcactcagatagcctccaagattgataccggtaaaaattctggcaatgttgtcctatacgaagctgtcaggtctattttcagaatcaatcctgattcttcactgaaaattttgggagtcaacatccttgcaaagtttttgaaatccaaagataataataccagatatgttgcactcaacacactgctgagtgtactcgaacttgaacctcaagctgtgcagaggcatagagctactattgttgcctgtttgcaagatggcgacatttccattcgtcgtagggctttggaacttacgttcgccattataaacaaacaaaacattaggttactcgccaaggaactgttaacatttttgcaaaactcggacactgatctcaagccatatgtgaccacacagttcacactagttgcagagcagtatgcaccaaacgagaaatggttttttgaaaatctcattaccatgctcaagtacgcaggaaactacatttctcccgatgtttcatccaatattataggtctcaccatccaaatcaaagatagggagttaattaagtttataacagcagagctatttaaggctagtgttgaagaccagacccaatatggactcaacctaattactacctggtgtgtgggagaatatggtgacttgattgaaggatcgattccaagtgcaaagattgtgcagctgttagcaaggttcattaatttttcttcatatgatgacgaatccaaaaatacccacttgatcggatattgtcttactgcttgtttgaagctttctgtgagacttactgatccaggctcgatagagcagttgagacagttgttgaaatccaaaacaaatgatatggacttggagattcagacaagagcaatggagtatcttcaaatatttagccaacctatgagtatcaagaaaggaattctcgctaagatgcctcctcctccaatgaaggagaagcaatcaatctccttgatgctaacctcagacaaaaagacacaaaacaaggccaaactcgtagattccaatgatctcttgttggatcttttaggtgaggatgttgatactcccaccatttcaaatggaaacactaagagtgttagcacaccagagaatagtttagacttgctgtctgatatctttggagacaagccaaacaataatacaccaaaccccgttaatagcgcagctacaccgcaggtcaacaaaggcaatgatcttttgttagatgatctattattctccccaagtgcttcagttgcggctccaaaagtgaacgtggtcgtagcttttgaagatgcaaatatatctgtcggcttcattacagttgaaaatgggggaggagcagctagcttggaagctcatatatcgaataagggttcgaacaatatttctgccctttcattactgttagcagtgccaaagtcccaaaagcttcaactttctcctatcagtactacgactcttcaagcaggaggtagtgccctccaaacgttcaagatcactggtgctgaaggaagcaaaatcaagctgcgtgctaagctaggttacagtacagttggacaagctgtcaccaagcaatttgaattttcatctgcctccactctttagacagacaaaataccctaactaatagaatataaaatgacccactatatactaatgcggtaaaaagttgctgtccattttttgcgcgactcaagatttgatacatcgcaagcctggtcaaacttcgaaccgaaccaaaattgccctaacaaattaatccccttgatctactctgcgtgcaaatcgttaaaccatcacactggaaaaaaatgtcacaagtacaacagtttttaagcaacattgacaagcaattctccaagattggaattctggatgaattcgaaagcaaggccaaattgcccagatcctacgcagtactgggtggtgcctccctttacggatttttagtttttctcaacattggaggaattggccaactgctgtccaacattgccggatttgtagttccaggctattactccttgaaggctttggagaccacaggcaccaaagatgatactgagcttctcacttactgggtggtctttgcattcctcaatgtgatcgaattttggtcgaaggccatcctttattggattcctctttactggtttgtgaagacaattttccttttgtggttggttctgcctgccaccaagggctcggccgtcgtttacaagagtgtgatccagcctttggctcaaaaatacgtcaccaacaataatgtttctgatgatttgctgaataaagttaacgaggctgccaaggccacatcaaccggctttgagaaatgagcaatttcggattatgattacgtatcgtgtatggaaataagattattttgacttcattggtgctttcaatggcacccattcctgatcaggaatctcaaccccagccattgacaatcccacactaattgtgacagtcccacgttctactaatctgcagttgaatgatcaaggaaaccagccatcatggcgatcccggctgcagagaattaacgtattacagtatacagtatcaagctggtattccctatatcttgcgtcaaggttctggcatatttctctcaattagttcacttgcgtggacaactcagtagcggaatttcccgaacggaccgaccctgacggtagtgttccttagtcacatgatctcttgcatgtatgacgaaaaaattgactgcacgggaagccgagatacatcgtagacatcaatctatttttagataatgggtccaaacaagaagatactttggttaatcttccaggaacaacaccgacttggttaggggtcataagcacccagagaatgttcttgctgaagtttgctctattttgtctgctttagacagatattcaacttccaaaaagggcatgaggacttaccaaaaatggcttgctcttaaatgcaggaaacgtttgttcgcctgcatatcatgcattaaaccccctccatgtgttgaagcgaatgccatttagctattagtggatattttcgactacaaatagaccaagaatttccctcaattccaaattcttcactaataatatagactacttgaacgccatgtcttacttgaaaatttccgctttgctttcagttttgtccgtcgccttggccgaccagcgaatctctgtcaccgttgttggtgatggtatcaactcaggactgagatccggagggtctcattttgaggctggaccaaatgctgctggtacccccttagatttgatcctgtatgagccatctggtttcttggtagatgcagcagatgcttccaagtacgttggttgggatgttgcagctggcacttctttgacttttttgccacaagaccaaggaggcaaagattggggaatcgttgccggtaacctcagattcaacgttggaggtactacattctatgcttgtgagactaggaccggtgtttgggaagtaaagagttacgaagctagtggatgcaaagctgtggtactttccgtagctagtcacccagttccttcttccagttcttccagttcttcccatgccccaacttcctctgttccatctacttcgtctcatgtgagcccaactaccactcaacctcctcacacaaccagttctcacaccaaccacacatcaactaccttgaccacatcaggtaggaatgactcgaaccactccaaccataccatcccaccagttccaaccggtgccgctatgggagtctctagcaactatggtttgttggttgcagctggaattgccgccgctgctttgttataattataattctaggtagtaattggagatttatagggtaagaacatgtacttttattttactattgcaagctaacatttgccgcttttagtgccctgaaacattccattctctttcaagcgaagtgttgaacctttgaaaagtgttcgcaaactctttaccgtattatactctatgttctgtaaaataaagctatcgtagaatgtgttggatgtcattgcaggttttggatcgtgtggaataatcagagaagatgtagatgacagactagaaggttgatgatcagggaactctaaaaaagttcgattgttgttattgttgggagaagtcgtggacatggaaatgtgatcaatgtactcctcaaaaatcccagcactatatccatcgccttcaaatagttggggaataggagatttggcggttagagctgggcacacgcggaacttcggggtgtaacaaagattggtaagatccggaagaatatgagtcttttcaattggagaaggagtattcccagttgaacacaacgctgcattcagagacgcctcgttcagaacaagtttccatgaccctttgggctgttggcttcttcggaacaagtaatcagagaaggactttattctgttgacaataggatcatgatctgtaagagcacgtgatatagaagaccttatattttgaagattatccatgtctaataaggataagattctatctggtttctggacttcacggtgtaggtatggtttgacttgtcgggagtcttgagttggtgcttggtcctcctcaagaagcaaacgatcaagcatatccacttcatcaagaccatcaacgatcattaaactgagttcgtcgacatgttcatcccgatctacagtatcctcctcttcattctcgttttcgacctcgtcaagtcgctcgtcgataggttggatttgtacccgtttcagctcatttacgtcaaggtactgatctgttcgcaaagaagtaaagggctggtttaagattctacctgaaattagcctgttgttgtcgttgttgttccacactctatgatgaagctcaattttgagtcttcgaaatctatacttcaactcatgtaactgaaaactcataatatgtataagcaatcgtagccattcatcagaaggccaaaacgaaaacagaaccgcacgggcgactcctcgttgcaattgcagggacaaactatgacaacattatggctttgtgtttttcgctaaatgtcttttctcatcctcaactcattgaacccttcctctattaaggtcttcaattctttataagaaatgatgatacagttcttttcgtccttggacactagtaaaatcctctcttctattcctgcgtccaatttgttgagacatgttataacatgagcaaggtcgacaactggataacccctctcatccacttgatggtaaacatagtcaacaaaaagagtaagaggatagttagcacttgactctgaccagttagggtcaccttcatgctcaggcctaccgtgcaaaaaactaagcttggacatcaatcttaccaaacgggcgttttccaattcagtcgacaattgagattcaataaaatcattagaattttgtaggccatcaatgacatccaataatcttggggcaatgcgtgtttgaatttcctttaggttgaaatcggcggagatcagatacttcaaggtggctttgtaatcgtcggaaaatttaaggtgatcgataatctgatcctgtgtcttatcgtcaaacgaaactgatccatatatagatgtaatagaaagatcatacaacaatttggccagcaattctagatctttcttttgcagttgggcaatatcttctgtattttcatgttgtaaaatatcaacaatgccacatccggacagctttattctgttcttgttcgtcacgatgactttgcttagatcgatagatctaactgcaaggcctttgtcatgtacttcgttgagagcattgaccagctggattagataggaccacaagtgttgttcagttatcaactccggctgattttggaagtgtatttcaatcaaggttttggcattaccatagaaatcataagccaccaccagagaattccccccaaagacggttgtggtgaaggcctcatgtaccttaactatgtttgaattttcaatagaactccaagccttgatagtcttgaaagcttgcttatcggtaatgttaacattctcaatgcgtctcaaagcgtataatctggcatccttattggaagtcgccttgtacatatggctgacagctccatatcttgcagagttattatcaaagttattgttgagaggcaccagagaatgataaacaccaacaatatctggtatcgatggattgctgaaagtttgaaggcatgcttcattgcgcttctgtaaggattctctaaggttatcatctatgaagaacgaactcactgttctttcgttggggttcaaatggagattgaaatgaggtgggggaggaggagcatacaaattgtagttcagaggatactgagtagcctgagcataaaacatctcaggcacaacgttatgaggggctgttgttccgtgttgagggaattgggctgacagtggcaaccctggttgactattatctgatggaactgaaggagtaaacattgaatttggtggtgcaaaataatcattgctttcagcgcttacctgctgtggctttttgggtgtctgctggctcgttggcacaaatgttggaatttcgtctaacttgggtgacattgtagagaatttgttcgtcaaactggcaacagatccagatggagtgaacgaaggggcttcaaaactaaatttcttgcggattgagctgccctcttcggtcccagagcttaaaggagctgatgatttggtttctttcgtttctttattcttctcaatggaatcgtctgagggatgcttgaagtaacagcccttattctcaaatttgcaatacccgtgaatgaaaacgttcttgcagtcgatatccttcgcccaatcatggttttctaaaaattagttaacggcctctgagcgatgcagctaaaggatttgcttacctgtattggtactattactattagcagacatatttgccctattctgccaactgcttggtatggaaaggataaagtgtaccaccacgctcgaaatgggaggattacttccagcaattgcaagctggtgctgagttgactttcaattgacggttggcttgatgttgaatagggaaaaccaaggatgcagtataccatggcgatctcttggaatcgttgagagtaatatattccattgctttagttactggatccattttgagctgtgtttcgaaatctactgctctatgtttacgtaatcagggtatctttcattgaacctaattagggagagcttccagtacgcgtgtatcaatcatgatagccacaattctatatagactgtgaatagcgggcctcctgccggtagtgacttcactcaggatccagttactacccgcaaactcataccagcgaaaacattgaaatatggctcgggaccgactttatgttcggcctgctgtgacactcagaggtattttttgcgctaaccttatttcctattcctaaactattttcacctacttgtattatgactgtcattattttaactggtgcttctagaggactgggattggctattgctcacaaggttctcaaggacccggctactaaactggttgccgtagctcgttcaaaggataaactggactcattggtgaacgaatacagttcacgagatattcttccgattgctgcggatcttgctgaaccaaactctgctgatataattgtcaagaagacaattgaaacttacggaagcattgactgtttgatcctgaatgctggaaagttggacccagtggggccaattgccaaagcagatgtaccaggttataagaatctattcgatgtcaactttttctcaatagttgaccttgtatccaaatcggttgaatttttgaggaaaaccaaaggtaatgtcatattcgtttcttctggtgcctctgtcacatcatatgacggatgggcagcctatggagcttcaaaggctgcgctgaaccatttctctcaaagccttgattctgaggagtcagatatcagctcaatctccattgcacctggagtggtagatacccaaatgcaagaggacattagaaatgtgtttggtaagaacatgaagccggaggcatacaaacgattcacagatttggaggaggaaaacaaactgcatccaccggaagtgccagcagccgtgtatgccaaccttgctctcaaaggcattcctacggatctgagtgggaaatatctgagattcacagacccactattggaacagtaccaaacctagtttggccgatccatgattatgtaatgcatatagtttttgtcgatgctcacccgtttcgagtctgtctcgtatcgtcttacgtataagttcaagcatgtttaccagatctgttagaaactcctttgtgagggcaggacctattcgtctcggtcccgttgtttctaagagactgtacagccaagcgcagaatggtggcattaaccataagagaattctgatcggacttggtctattggctattggaaccaccctttacgggacaaccaaccctaccaagactcctattgcatttgtggaaccagccacggaaagagcgtttaaggacggagacgtctctgtgatttttgttctcggaggtccaggagctggaaaaggtacccaatgtgccaaactagtgagtaattacggatttgttcacctgtcagctggagacttgttacgtgcagaacagaagagggaggggtctaagtatggagagatgatttcccagtatatcagagatggactgatagtacctcaagaggtcaccattgcgctcttggagcaggccatgaaggaaaacttcgagaaagggaagacacggttcttgattgatggattccctcgtaagatggaccaggccaaaacttttgaggaaaaagtcgcaaagtccaaggtgacacttttctttgattgtcccgaatcagtgctccttgagagattacttaaaagaggacagacaagcggaagagaggatgataatgcggagagtatcaaaaaaagattcaaaacattcgtggaaacttcgatgcctgtggtggactatttcgggaagcaaggacgcgttttgaaggtatcttgtgaccaccctgtggatcaagtgtattcacaggttgtgtcggtgctaaaagagaaggggatctttgccgataacgagacggagaataaataaacattgtaataagatttagactgtgaatgttctatgtaatatttttcgagatactgtatctatctggtgtaccgtatcactctggacttgcaaactcattgattacttgtgcaatgggcaagaaggatagctctagaaagaagaagaaaaaggagccgcctgaagagctggatctttccgaggttgttccaacttttggttatgaggaatttcatgttgagcaagaggagaatccggtcgatcaagacgaacttgacgcaaatgttgactatctgattgccgaggcgacaatatctaagtctaacaagttcgggaatcttttagcatcattggccgtgcccaagtcaaagtcgaagcctaagaaacaccaaaatgtccagctgaaactgaacccatcaaacatccaggaaatcctcaatgacatagactcaataatttttgacgatgataacgataataatagaccatataaagctctgaaaaaggagggcttcaaggttgaagacccgttgtttgacaagaagaaactaaatagaaaaaaccgtcgattctgcagtatcttagaatccgatttcaatgttatagtcaaatctgaaaaagaacttcaacagaaaataaaagagtttgacctcaagaattatgaaccaaaaccggttccaaaagaaactgtcacaacatcggttgccctacagacgaacaaccttttgtataataaagtcatctacaagacagaccctgagcaacacattagctactttgatcttacaaaaatgagattaaatcatgaacatataaaagaggttgtccaaagctctaccaatttgaacaagtctattgttgaatggctacttatcaaccagtccgctttagctaaagatgaggactacagaatagttcagactatcctggacttctctatgagaaagctagaaaaccatcatgctgagccctccgaagagtacttgcagataagccaagatatgaacctaacatggccaatgtcgaactgtctatcaatgattctaatttggggtattcacgagtttctctccaaaaagtgcaaatatatttcacccattctcattgataagatcaagaacaaatcgaaaaaaacggtaatcatgaaagcatttggtggtggtttacacctatgggacctaaatactcggaaacaacaagtgtcaccggacgcttggaatatccttgaaaagtatcgaagaaactacaaatttgaagatcaaactttcattatcatactcaggttacttagtttccctaacttgaaagcttgaaaataaatataaaaagcaatgcattttactctatagtttagccttgattgttgacttacgttgttgtggttctaactgtgcatgggcaggtaaggcctgcaaaccttcttgcaatacggtagctaccaactgaccactttcagagtagatctccccagtaaccagtgcgcggtcatcttgacacactttgctcctgatactgaatgacagccactcatctatgttaaatttatcatagaaatggatcgtatggtctaaagatactgagaatgatgaagtaaacatctcctgcatatttagtctcatgttggagctaagaaagaaatagtccgagatgtaagcaatggccacgtcattgaaccttggtgatttaaaatgagacttgcttttcacccaatatctcagaaccctgtcacttacaaatttatcaaactcttctggggcaacctgtgataaatcaaacatgtccattggcaaccgccacttgcaaggctccgcatcataactgtccaacagttgctggggatttttggccagcttttgtaattgcacattgtctttggaatttttcgcccattccatgaatacctcagtttgctcatgacagtcttcaggtgacggaatatccttaccaactataggagcccgcctgtaatgagaaagttttggcgaatcactggccccagaagagccttctagtctctctgatcgaaaagaaattgatcctagaaaaatcaactgattgttctgtttggctttcacttgacgggagcagaaattcttcccgtctctcagagtttcgacatgatactcaatacgactctttgtatttgcagcaactaaaaagttgcaatgcatgcttataggtctgaacttttcatccacatttaacagtgcagcatacagtgattgggcaactagagttcccccgaatataccacggccaccgaaaggaactcttaacgtcgagacattactgtagacgttctcagataccttctccagctcaagatattgttccaagttcgccagcgtagataagggcattggctttggcattggcttttgcattgagtttaatcgaacttgtctgaatcgcttccaaacgtgtttgaacatcctggaaatagccgactatttatcgaatcttgcctaaccctgatttcggcttcatgtgaaaagagcccaatgtctagagaaacgagcgaagcattacataagcatcctcgtttttcctctctctctccccccaggtagagataatcagtcgcatcgccagcacaccttaatcttcctcctggcacaacaggtcagctactaattatggaagccgtgaatttacaaattgaatggattagacaggtgcctccagttactgtggctcttgtagcatccatgtcaatgacctattttttgcaacgcatagatgtattatcctcaaatatgttcgtgtttgaaagacatcgtgtgtttaatgagatggcctattctcgtttgatactaagtttcttcttcagcgcccattcgtttgttggattcttttggacattgtacacattatttcagaattcacaggcactcgagctgacctatgaaaactcaatcgattacctctactcattggtgataatagcaggtttgatcgtggcatgggcctcatacttggggggtccgttcatgctgggatgggttctagctgacgtcttgagaaccatatggtgcaaacagaatcccaacgaaagaatgtctattttggggctagtttccttcaaggcaggatactttccatttgtaatacttgccatttcatggctagaaggaagttcaagaaatcttctattaatgctaattagccaaactgtcagtcaggcttatatttttggacaccatatgatgcccgaactacacgggatcgatctgtttctgcctatatggaaattccagtgtttcagacgtcagagacaaccaccaattcatcagcatcaagactaaagtgggctcattcatattggctcaaaaccaaatgtttgaacttccgtgaaatcctccaacttcagtcctctaaacacatcctcttcatttacaaactggtcatcgtcgacaatttttttcaatgtcaatagatcgactcgtttcttctcgtgatccacgtcaatatatcccacaccaaacatctgccttgagtggacttcgaagaagtttctcagtactgggtcttccatcagtgcatcattgtgggtagtacgtgctttggcatacaaatgcttattctctttgaatgaagaacacacatgaggatttctatccagtatcggaattgatctgccctgtctatcaattctaaagtggttcaaggcatctttcaagctctggtcattttgtaccttgggcagcggatagctattcaagcgcagcttcctttcttcaatgtctaatagtttctgtctatagtgaggattctcaatagatctcatcaagagatgattgtaattagtcatattactgaccattcctctaactttggacgtcaatggtttaatgtgattgtactttgaaagatcgttataccagctctgttttcccatcttggtgactttatttgagctcttcgtcctttgcgtaatcttactgggtggtagatctttccgttcttgcgcttcaataccttcctgtgcccgctttttgcccttcaaagcggctgtcctctccttacttttgttctttagcctcgtgatcatattctagtacaagctatatctatatatacttctccaaatcttggcctctatctccaataatacttttcactgcagtgatgatatcgctatgtaaattttttgatgccgcgattattccctgcgagttgagctcccgaccgttgccaaaatccaactggttaccataaatatcagacacaatgcctccgctttccttgatcagaatgttgccagcagcatgatcccatattttctctcggtaattcacatcttttggcaacctcaaatatatttcagcatctcctctcgacagagcacagtacttggcttgagaatccaagttggcggacttggacttgatctggagcttttcttttattaatccttgcaacccatgacttgaatgacccttctcaacaccttcacagactctgcaggtatcaaaagaaagagaattgttcattgtgattctttttgatgattccagaggcaagatctcttcaaacaagttctgatagtatgatcctacgccttcagctgcggtgaaaagtcctccttttcccttgctcttattttgtaggtcaaacggtagatttggacacccaattacaccaacttttacaaccccatccacgattaatgccagacaaacggcaaattggtcgcctctcaggaagcccttagtaccatcaatgggatccaaggcccaaattcttccttgacggccaccttcagagctgccgccgtcgatagcatcgcaaacttcgtctaccgagttcaacagagataacgacccattgttggctttgtcctgctcttgaacccacttgatctcttccaacaccttttcagccagctttgggtctttcttcaacatcgcagagtcttcttctccaacaacctcatcattggggaaggctttcttgatgctgttgatgatgatagactgagcagcaaagtcccccacagtgactggagaatcgtccgatttcgaaattccgccaactgtgcgagctgcaatctcatcacttatcctcttagtcaatagagatgcccttttgacagccaattgggctagcttaacttccctgctgaacatattttttctcctgaacgcagtgcttttttttcttgcaggtggacaactcgtacttgagagggggtgatgcagaaaggtacggaatattgcatcccagcaccattcttgtcattctcactctcaacattcgtaattacctgaaaggaaattactttcacagtgatcgactccttttctctcccttccctcttctcttgtcaagctattcataaagtctctcatttcataccaatctcttccaatgataagtttcaaaagatcttctaaagacaagcattctaagggtcccaagatcaccaaggctgaaccaatacaagtcgatacctcccactccgaggttctcgatacgcccaaaaaagtcatcaaatctctgtatgactacaaggcccagggccctggtgagctcactttcaagaaaggagacttttttcacgtcataggtagtgaagatgaccccgaatggctagaggcttacaacccagtgacaaaagcccatggcatggtcccagtgccatactttgagacattcttcagaactggccatgcggacttgcagccccaagatcaggccgctacaaatcccaatcgccagtctttgtcaattctgcatgccaaagtgttatatgatttccgtaaagaacgagatgacgaactagatatcgacgcaggcgactatattattgtatgtgctcattatgattacgaatggtttattgcaaagtacatcaataaactgggcgggcccggcttggttcctgcgtcttatgttcaattgatcgatatgaaaacgggtcaaccgatcctaagggatatgaagtcgattgtagaccaagagaaattacccactattgaagaatggaaaaataacaatgctagatatagggaaagctccaaaatcatttcctccgagtacaaccaagagggtgttcatcaaaatcagcaaggaaatcatggagatgagtatccaccgaagctctccaggacaggcactgatctcagttctcaacattggttggcgcctacagatccgtatgttgtttctgttaatgtggagtcattttacatgacaaatgacaaattttggtttctggtcaaggcgactctatcgaatggaatggtaagactgttgtgtcggttttacgaagatttttttaatttccagcaaaacttgttaacgagattcccccgagaagctggtaaacaagagggtcatcaaagaatatttccttacatcccaggcccattgtcctatgtcaacgaaaatatcactgccaagcgtagagcagacttagatgactattttcaacatttgttcaggttaccggattatataacgcgttctgcactagtttccgctctctttgaaatacggtctggggacaaggaattcaaatcttctgatgacctgactctaccaaatccacgagtctcggtgctccaatacaataatcaatcatccagtcagcaacagaggcgcagctctcaataccaacaggatagactctctcaatatgaaaaacacagacaatcagactctatcaatcatttggttaaacgcatgagtagcttaaacacagagaccaaaagttcttcctcaagctcttctggtctcatcacaagcaaactaaagctgaagttctactttaaggatgacatttttgtgcttatagtgcccacaaccgtgggaatcgctgacttaaaacggctcgtggcctcaaggctggaccactcagcttctgctttacacctatatccaaaatatggagccaacattgatgaaaatgaatatagcgaacatgatgagattcaatctgatgataccttgtggggcagtaaatgttttgtcgacaagggaaaagttcttgtgattgcaacgtgaaatttagtttaccttccaataacttccaaacatagaatagtgcacttcaattttttcgtacccaaatctgacatcagcttcgacgattcacaggtaaatactatatagcacagcatcttaccctcgaaatcacccaaacatcgtgaatccaaattccatgtagctctctctgccttacattcttcctcccatcctaatgccacataaaagaacgccctctagcagtctgctgtatgcaagaattccagggatctcttttgaaaactctccggtgtttgattttttgtctccttttggacccgctcctaatcaatgggtagcacgatacatcatcatcatctttgcaattctcatcagattggcagttgggctgggctcctattccggcttcaacacccctccaatgtatggggattttgaagctcagaggcattggatggaaattactcagcatttatccatagaaaaatggtacttctacgacttgcaatattgggggcttgactatcctcccttgacagcctttcattcatacttctttggcaaattaggcagcttcatcaatccagcatggtttgctttagacgtctccagagggtttgaatcagtggatctaaaatcgtacatgagggcgaccgcaattctcagtgagctgttatgttttattccagctgtcatttggtattgtcgttggatgggacttaactacttcaatcaaaacgccattgagcaaactataatagcgtctgctattcttttcaatccatctttaattatcatagatcatggccacttccagtacaactcagttatgctaggttttgctttattatccatattaaatctgttgtacgataattttgcattagcggctatttttttcgttctttcaataagctttaagcaaatggctctctattatagccccatcatgtttttttacatgctgagtgtgagttgttggcctttgaaaaacttcaacttgttgagattggctactatcagtattgcagtactcttgacttttgcaactctattactgccttttgtattagtagatgggatgtcacaaattggccaaatattattcagagttttcccgttttcaagaggcttgtttgaggataaggtggccaacttttggtgtacaacgaatatactggtaaagtacaaacagttattcactgacaaaacccttactaggatatcgctagtagcaactttgattgcaattagtccgtcttgcttcatcatttttactcacccaaagaaggttttactaccgtgggcttttgctgcttgctcttgggcgttctatcttttctctttccaagtccacgagaaatcagttttagttccattgatgcctaccactctattactggtagaaaaagacttggacatcatctcaatggtctgctggatttctaatattgccttcttcagcatgtggcctctattaaaaagagacgggctggctttggaatattttgtcttgggaatattgagtaattggctgattggaaacctcaattggattagtaaatggcttgtccccagtttcctgattccagggcctactctctccaaaaaagttcctaaaagagatactaaaacagttgttcatactcactggttttgggggtcagtaacattcgtttcatacctcggagctacagttatccagttcgtagattggctgtaccttccacctgccaagtatccagatttgtgggttattttgaacactacattgtcgtttgcttgtttcgggttgttttggctatggattaactacaatctgtacattttgcgtgattttaagcttaaagatgcttagcgtctccgtttttttactaatattttggcaatttaacaccctctttgagttttctatcgactgtgaatagaccccattcagtttcccatttattttccccgttttcatatatctttttccaaggttcatcgaaggcttcaaaccagtaccaagggatcttgagatgccgtgccaacgcactaaagcctttaaggtacaaatcatagtttttcttttttgctattgcatcaatgaaactccccccttgatagggccaacctgtttccccaataacaattttttccatgcaagattttgtagaacagatattgtacaaagtgctatttacccaacctggagctatttttgcggtagttccattgaaaaaagggtgtaaatttactccgagaatgtctaattggtcagcccagtcctctttcacacatgagtaatgttcattggttcccactggtaggtcataccatcccaattgttgaacgattctcttaacttgcttaatatattgaaacagtgcatcagtagacaactcgtgcctccataggacttcattgccaacaaagatagtatcaatctgatcccttctgactttaagcaggatcttttggaggtctgatatctgattttcatttgattgtctatcactatttaaccaaacgccaatcgataccgtcatgttgaggcccatatcctgaattacatccaaaacataagcagcctgttgacattgtaagccatacagttttagtctcgaagtcaccattgatagaacacccaaatctaaaacaacctggtcataatttacaccacacattggttgtaaggatcctcttggtgcgtaattgactccataaattgatttctgcagccttttgtctgacattaagcttttcaattctgtattattatggaattttttgtttagacctgcatacgaattctgagtttcatcctgggtaaagttatttgcaggtggaatctggatcattatttttggagaaactgagaaagaagtattggttgtagataagttataatgcgaaatcaactgatcaataagtttctgcctctccgttggtgataccctgttcatatagttgaagatagtcgtggttgttccgccgattagttccgtcactaatggcaccaatattgctagagaagcgattaacgaaccaagtaagacgaggatacatcctacgtaaaacgggctcttccagcttccatgctctctgtatttgccagccttttcagagtagatgctactgggtgcaaaagaggccgtttcatttccgacctcatttgagtattcttttgtctcagttttttgatacgcggagtgaacagaagagccaaacatgacatcagaagtcgaagtgtccagtagtttaagaccaacggtttcctttgagctatcagtaggttggtcaaactttgctggtatgtctttgttcgtgttgccagtttcagctataggggatgtcataaaattttttgaaggtccaactcctacttcaggaacccgactgtttgggtggttgagaaaagctagcgtttcataatccatattagctgagttcacattgttgtttgattcggctttggcactagcagcctttatatccaggcttttagctttatttgaatttgccaaagagcttacaggtcctgtaaccggttctgaacttccatcttcaaaagaggaaacagttagaggctggactactgatgaattcagttttactttcggatatttccacttgaattcgttatcgaatactactgtctctgttttcagattatcttcgtgttcagatctcttctctcttgcttcacttttagatcgggtgatgggaattgacaacctggattctgtgttagacctccattttccgattgggagtgattttgatcttagtattggccaacttttgactgagtcattggtctgtgggtagttaaggtgctcctcgagcttgatttcgtggttgatgtatttagatggctcttcctcgtcatccagctgtatgggcgagctttcattgggactactactatcttcaaaacgtgttttcttctcaacacgttggccattgctttttgtcggactatggggagacataattgagtgtgaatggttggtcaaggttcagttcactgggctaatgtacaaagtggaaccgtgcggctgtaataaaattatttatttataatattagttggatggttatatacattcagatatcaggtgtattgtaaaggtttggagagatgtgattttcacggggcaaaccaatctacgtttgtggtccttgtaattcggaacggttacggtgttgagagagtcaaatgcaaaacaaattcttataaataaatgacaatttatataaaagaccaatgaccaagagtacagtacaatcccaagctaaaaagaatttgtggtttctgctggttcattgaattgtatgatcagatcaacgtctgaccagaaatattatttctctcccagctacaatttcggttatactttgcgatgatatcttaatattgttcaagtgacttacgaaagcttattccaagtcaaatccagattgtttaacctaagtaggactcatcctagacaatagaactttgatcagtttcactttcttaaattacttagctaagactttttaaaaaacgtgagtaatcctcctggtggccaagttggctaaggcgcgagactgtaaatgttctctttcagggaaatcttgagatcgggtgttcgaatcacccccaggagattcttttttactatggggactcaatttaatatatatctggtaatgttataaaaattatctagggtttaatatgcttcggctaaactataatttataactatccaatattctatcttcaatagagtctgtggaactcttgaactgggcaacttgcagactttcaccctctgctgcaaaaacctttgccatatctggttggcctggcattcccatttgtgctggcatctgttgctggataacttgcaccgcattggagctgctcagaatcaatgaaaaaacagactgcaaacctaataatgtgacaaagtaccatgacaaggaggagacccatctcacgtccaaatcaggagtgtcaattccttgttgcaacatggatttgaaacggagagtgagagggaagggtagtcgcattatgatgaatccagcaaagaaatagttaatccaccacataatcacagtctggggaataaaattggctgcatttgatttcagcatgttgaacatggcgtctgaagcattcgggtcagacaatggattaggcatctgatccttgttttgtttcactgcatttttcaggtactttccagaagtaagggcttcatataaataggcctgtctattgagaaactccttttttgagaccagcacatgtgaattgcccctgaagagacgggccttttgtaactgttgttgttctctaacatctctccacttggacaccttcgggagtggttgaagtaagttggtaacataacttctcagaatcccaaccaatatcatcactgccgaaatgggtagtagaacccacactttcaagcttgggtccagcacaagatctggggacattctgttgagttaagcgttgccaggaagagtgtgtggaaggaaggaagggtagagagttacatcgtattaagtggaaattcgagactacaattgaatggatgatagctcctcttgggtatacttcatacagagagtcaatgaaaatcactgggctacattaaaagtaggagaataaagctcattctgttattcgatcaccgtctatagaatagtccctcaggaatcactattggtgctaatctattgcaccgaaagaggtctgcttcagctttcacccaaagtccgaattttgacgtactgttcgttctatgagtatattcctccctccattcccactggaatatcacgagatccataaacccccttccaactgacaggttcaacccaagtcgcaggctgcggtatttgcaaaagctcataaactcgttgagcaaacacttgagcatccgaaatattgtctccctcatatacataaatagatagcaccacgatcttgattggctcctgttgaaggttggctgaagagctgacagcgggaagtgttactgtatgaggaaactctgtttcaagtaatttcaacaggtttacacaactgggagttggtttcatctccagtcccaattcaggattcttcaatgaattgacaagaatttcgataatgggagatagttctttaggatctttcagttttgttgtctgttcctccactgttagacgagacaggttcgcagccagatcattgctgtacagctcatacaaactcccatcagattgctccttaaaagcagaatcttttgattgaagaaccaacactttggagaaccctgaggtattgatgaagggcacaatgacctgctgatagaattgagttgtgtaacctggcaaaactggagatctctgctgtaaaatcgccaattttagatccttattatgatatacttctaagcttgtagaaaagtcttgaatagaggtgtcaggattcccctccacgtaatcgacgggcgaaacaaatggatgtaccaatgaatcatctaaccacgccactgacttcaagtttaagttatgaatcagcagatctgcggtgaattgtggcacgttaccaatagacacaatgggaagcaccaatgtggagcctttgaaactgttaaggacttcaatcgggttagttctactatgaaaggccattatgttgatagatggagtaggcgatactttggggagatggccccataaatctgggggagtctgattcgagcctcacctaatgttcatcgcctagcagcttcgcccccaaacacccaaacgcccccctaaaccgtccctcgaactcacctcatctgtcatgctgctgatagtttagataatcttaaaaaaaatcatcaggaggtgaaaaattaaaaaaaaaaaaaaaaacgtacatcaacctcctgacgttttccgtaggatcaacccaatgagtgacgttaacgaagctacaagtttggagcgcctaagagacgtgctcatcaacaacacaggagacataaaactggctcacaggtttcgggcactcttcttcctgaaatccatcggcgcagagtacaacgagaagccagaagatgccaacaaagccattaagtatattggcgagtgttttgccgactcttcagagcttttgaaacacgaggtggcatatgtgctgggacaaacaaagaacatgaccagtgctcccatcttgagagatgtactggaaagcaaggaacagcaggttatggtacgtcatgaagctgcagaagcattaggagctttgggagataaggactctctcgatttactggttaaatactacgaggaccctgcagaagtggaagagattcgccagacttgcgagttggccattgagaggatcaaatgggagaactcttcgaaggccaaagaagagaaactggagacttctctatacgagtccattgatccagctccacctttggctatcgacggatccaatacaaagatctccaagcttcaaaaaattttgaatgaccagaataccccattgtttgaaagatatagagccatgtttagactgagagatattggtactgacgaggcagctttggctttggctacgggattcagcgacccatccgctttattcaaacatgaaattgcatacgtatttgggcagctgagtaaccctgttactgtcccatctttggtacaggttctgaaggacacctctcaagcggccatggtgcgtcacgaggcggctgaggctctcggatctattgctaccgacgaagtcttgcctattttgcagggtttcctcaaggatgaagatgaggttgttagagatagtgctgtggtcgctttggatatgtatgagtatgagaattccaatgaggttgaatacgctgctgtttaatgtactaaagcatgaggagtgtatttttaatatctgtgtagtttctgattatgtgaaattcttctaattgttcgttctaaacttgtaagcacacttcggacatgtgtaaaagacagtagcaccttcatcagcagaccttaattgcagggtatggtattgcatctcttcattgccacattgaggacacttttctttgattgtggccccatcttcgagttcatcagattttagggaggtcttaactaacgaagctttggcacgtagagtagagggaaaagcatcaggggaacttttagtgaccacactgagattcttgaaccttttggtatcataggaccgttcacaaacgttacaatctatgcttttttggcccgctacagagtccaagaggtttccgcactcaacgcagaagatcatagaccctacgactgacatgttggaggtttgtggtaataaacaggaaagtaagttcttcacaggttaatcaatctacaaaaaaatattttactttcgaggccattttacatggaaggtttccaacttttctcccacccagcacagagatcaacatcttcgcgcgttctaagttttatccattgccttcaaatctttcttcactcctacaaagaaattccatcacaatgcaggccccaccacaaatgatggagatgccagatctctctaatgccataatggcccaagatgagatgggaagacctcttatcatagttaaagatcaaggccggaagcaaaaggctagcggtgttgaggccataaagtcacatattctgtccgcaaggtcagtggcgtcaatcctgaaaacgtccttaggtcctcgtggtttagataagattcttgtctcacctgatggagaaatcaatattacaaatgatggtgccaccattctttctcagatggagttttccgatgagattgccaaattattagtggaattgtccaaatctcaagatgacgaaattggcgatgggaccaccggtgtggttgttttggccggtgctatgttggatcaggctctagaacttatagagaagggtattcaccccattaagattggtgatggactacacgaggcttgcaaagtcgctgttgccaacttggacaaaattgccgaccaggttacagtctacgatggagatcaggtcgatcgcaatgcccaaccagaatcagaacttttcaaagctgccaagacatctctgggttcaaaaatcgtctctaaattccaagataagttcgccaaaatggctgttgaatgtgttctagcagtagctgatttgtcgcgtcgtgatgttgattttgaactcatcaagattgaaggaaatgttggaggatctttagacgagtctcgtttaattcgtggtgttctggttgacaaagaactcagtcacccacaaatgcctaagactattgaagacgctcgtatcgctattttaacgtgtccatttgaaccacccaaacctaagactaaacacaagcttaacatcggtaccgttgaagaatttgaggctttacaaaaatatgaacaggatgcatttgctgaaatgattggccacgttcagcgtgcgggtgcgaacctcgttgtatgtcaatggggattcgacgacgaggctaaccatctgctgttgcagaatcacttgcctgctatacgttgggttggaggtccggaattagaagccattgctattgctactcgtggaaagattgtgcctcgctttgaagatctatccgctgacaagttgggtcatgctggaatagtccgagaattggaaatgggtactacgcgggaacgaatgctggttgtagaggaatgtgctaatacccgtgccgttacagcacttcttcggggatcatctaaaatgattgttgatgagtctaccagagcattgcacgactcgttgtgcgttgtaagaaacttagtgcgagacaacagagttgtttacggtggaggtgctgcagagctttcttgctctcttgcagtttctgctgctgcagacagtcagaagggaattgatcaatatgcattccgtgcttttgctgatgccttggactgtattccaatggcccttgccgagaattctggtcttgaccctattacaacagtctcaactctgaaagctcgtcagtctactgaagccaattctaacttgggagttgactgtttgggttctaatcaaaatgatatgaaagaactctttgtgattgatcctctaattggaaagaagcagcaacttctcctagccacccagttgacgcggatgattctgaagatcaacaatgtgatcatctccggaaaggatgaatactagacagttttcaagataataaatgatataccaatattgtagctattttaataactagaacctgaccatttactttctttactgataaaggaccccttccaagcctcctagaatctcctccttcaaggtcgaattagccccttcgcgaaaacggctctttcggccatgtacaaccgcacacttcagtgttggtctttcgtattccatctccaattccttcaatacaatcaagaaatatgtccagcataaacacgccggccattgtgatggacaatggtactggtcttaccaaactgggatttgcaggtaacgatctaccttcgtgggtttttcccactgcaattgcaactcgtgctgagaattccaactcaaaatacaacaagtcaacctcctcaagaggtggccaaacctccggtggaaatctttctataaagcgtgggatggaagatcttgatttctacataggtgaagaggctttggaggctgcaaaaggtccatcttattcccttaattacccaattagacatggacaggtagaaaactgggaccacatggaaagattttgggagaactccatcttcaagtacctcaagtgtgaaccagaggatcattatttcttactgactgagcctcctttgaatcctcctgaaaacagagaaaataccgccgaaattatgttcgaatcgtttaattgtgctgggttgtacatcgcagttcaggcagtgctcgcactggcagcttcttggacgtcatcgaaggtccaagatcgttctttaactggtactgtgattgactcgggagatggtgttactcacgtaatacctgtggctgaagggtatgttattggttctgccatcaagaatattcccctggctggtagagacattaccatttttatccaaacattattacgtgaccgtggtgaaccagacacatccttgcgtaccgcggagcaaatcaagcagcagttctgttacacatcctctgacattgtgaaggaattcaaccgatttgactctaaccctgaaaagtttgctcagtacatggttgagaccgtcaataaatcacgtactttaaccgtcgatgtcggatacgaaaggtttttggcccctgagatctttttcaaccctgaaattgcaagttccgatttcctgactcctctccccacaatagttgatcaggttattcaagcttcgcccatagatgtgcgtaagaacttatacaagaacattgttttgagtggtggttctacgatgtttaaagactttgggagacgtctgcaaagggatcttaagcaaatagtcaatgaacgtgtggcctccagtgaacgtacaagtggtgcaaagtccagtggtgttgaagtacaagttataagccacaagcgtcagaaaaatgctgtctggtttggaggttctctgctagctcagacaagtgaatttaagagttactgccatacaaagcaagattatgatgagtatggtcccaacattgtgaggaacttctctttattcagtgttccttgaaggaagttttttacaaggaaaatgtcttttttttcttatatagccattttagtattgaatccactttacatattaactctttggccttagaaaacaacctgggagacgctgtttgccgtttttattacttgacttctcctggtcgtaaggttgtcaccaactggaagtagtgtaccaaacacaggaatgatctctatctatctcgccggcctctctctatcaacagttcctccataaagcgtcctctgctgtatccctatgacacaagcagagttgtacacattggaccaagtatttaatggtcttcgatcccgcaatcctcagcggcgattgctctctgcgaggaatctgaaggaacaccttctttccgtttctcgagagtttactcctagtgagcaggttaagaggtataactcagacgtctacaagcgtatcagtgatctgatagaaagcaagaataactgggaaaaattaggaggcgttgaagctatcaatgcattacttgatctcaatgctgatggcaatgacgatttggtggcttcttctaattctaacacagaagaccgaaaaattaagaggacggttctgaaaacgtatttggacaaattgattccatcctctgatttagaagtgatgtatagtgctaccaggacgttggggaaacttgctatcccaggcagtgcattggctggaccactggtagaattttacatgccacgggctattgaatggctcaaccctgataacaaacaagaatatagacacgcagcagtgttgatcatcacttctttatcttataacttgtccacctcaatctataattacgttcacaagattttggagaacatatggatcgcattaagagattccaagctgataataagagaagatgctgccatcgcaatgagatactgtctctcgattgtatacgaaagggatagtcaaatggctcaattttggtttagtgctctttacactgaagccagtcaatgttttaaggcaacgccaactagtagcaccaccattagtagcacggctgttgaagttatccatggttcattgctttgctatcgggaattggttatcaaaggtactagtctgctgtcagacaaaattgatgaactatatgataacctaaacaaacttaaagaccacaagaatgtaattataagaagagagttctccagtataattccaaaacttgcgcattttaatcgtgcaaattttgtggagaaacatcttcacagagtgttactgtactacttcactcagctcaaaataccacgagacagagatttcatttttgtagcaatcggtgacattgcaaccgaagtcaaaaaccgtattgttgactatctggagggtatattgactaatattgacgaagctttggctgtaagatctgtcaaagcgagacgtgaaattgaaccagcttgtttctattgcttggaaaaacttgccttggctttaggctcctgcatgacaaagtatatcaataattatcacactctgaatcgcattttcaaatgctctatcaacgacaacatgattcaaactttacaagtcctgatagaaaaactgccagcactagagcctgctataaacgagcgcttgattaagatagtgacgctttgtttgagcggttatgaatataagcatcctggatctcagggctataaaagacaaatgaatacgtctttagcgcaagaatatagacaacagatgttacaacgagatggtggcactttaatttatgagaaagcatatactggatactctactgaaagcggctatgaacagaatcttcgagaccttgacgaggatccagatgtaacagttatcatacaagcattgaaagtgctcagctgctttcactttgccgactataatctcacagattttacccgcttttcagtcatgacttatgtcgatcatgacaatattgaagtgagaaaaagagccgccctaacgacatgtgctttgttcatgaaggattctatttgctatcaaactagtgaaagttctttgaaggctgtcaatgaggttttggggaaactactagtcatttgcattacggatcctgttgcggaaataaggctggaagttctaaaggtactcggagaaaactttgaccctcaactttcccaggctgataacgcaaaactattgtttgtggcaacaaacgatggcaacttcgagatcaggaaggcagcaattaaaataataggtcggttatctgctataaatcctgcttacattgttccgtcattaagaaaacttttgatgcaactgttgacaactttagagtatgacgggagttccaaaagaagggaggaaacggctgctattttgtctacactgatttctcactccaaggacgtgactaagccatacgtgaagcaaattttagatgtgttgatcccaaaggcgaaagaccaatcatcaggcgcatcaataaatgcgattcaagctattggtgagttggctgtagtgtctggagaagacatgaagccttttatccacgaaatgatgccgatattcttggatacatttcaggatcagagtgctggttacaagagagataccgcacttcgtgcccttggtcagttggctagttcttcgggttatgtaattgatccactattagattaccctcagctactcggaatgttggtgagcattttaaaatcagaaagctcacagatggtacgaagagaaacagttaggcttctaggagttctaggagcactggacccatacaagcacagggaagttgattggaagattaagagttcattgcctatggagcaaatcacagaacaaaatgctccgccaatagacgtctcgctgctaatgcaaggcatgtccccttctaatgaggagttctaccctactgttgtaataactactttgatgaagatattaaaagatagttctctagtcaatcatcacacggcagtggctcaagcggtgatctacatctaccaaacgttgaatacgaaatgtattccttttctaaaccatgtcattccaggctttattcacgtaatgatgaattatccagatgtaagactagaattttacttcaatcaacttgggaagcttatcaacattgtcaagcaacatgtcagaccgtatctgaaggacatttttgttttaattaaaaagtattttgctactccaaatttgacagtgaccatattagggttaatccaaattatctcttctgctatggacggagagttcaaactatatttaacggagattcttcctttgatgctggaagttttggaaacggatacttcgcctgagagagaagcttctctagctgtgttgaacactttcgtggttcttggatccaatatagatctatacgtacatcttgtcattccacagatcgtttcattgtttgacttctctccttatagactgcgaaaagcttccatcgagactattggaaagctagcaagtactgttcatctcaatgatttatcttcaagaattatccatcctctgttaagagcattagaaacaaattcaagcgatgaactaaaaaagacaattatgaatacgatttccattatgctacttcaaatgagagaaaactttttagtattcattccattgattaataagatcttagttcaacataaatggaagttccctgtttatgagcaattaatggaaaaactcttgaatggccaaaaactaccccagaacttgataataggacctgagcatgaatctcttagaactgaagcaatggaaatcgaaccttcctccaacaagctgacattaaatcaacaagctttgcgacaatcttgggatgcaagtcaatgtaggactaaagtggattgggttgagtggattatgcgtctaagtttggagcttttgagagagtcaccatctcacgcacttcgggcttgttcaaccctggctagtgattatactccactcgctaaagatctcttcaatgtcagttttgccagttgttggaacgagttgtcacctcaaaacaaaaatgacttgattcaggcttttggaattgctctatctgcggtgcagaatcctcctgagattcatcagcagctactgaacgtagtcgaattcatggaacgtgatgataagcctttaccaatcagggtcccaactcttgggcaatatgccaagagatgtcatgcttacgcaaaagctttgcattacaaagagttggagtttattcaagaaccctccacccctactattgaatctttgatcagtataaacaaccagttacaacagtctgatgctgctatcggtattctgaagcaagcacaacagcaccatgatttacaattgaaagaaacatggtatgaaaagcttcaaagatgggacgatgcattaaacgcttataatgaaagagaaaaggaagatcccgactctatggacataacaatgggtaaaatgagatctttacatgctttgggtgaatgggagcagttgtctgagctagcgcaggacaaatggctaaattcatctactgaaatccgaagagctattgcaccgctagccgcagcagcttcttggggtcttggtcaatgggaccgaatggacacgtatattggtatcatgaagcatgagtctccagataaagcattcttcaatgcagttttatgtcttcatcgaaacaactttgagggcgcttcaacccaaatactaagagccagagacttgttgataactgaaatgacagctctggtaagtgaatcttacaatagagcttatagtgtcgttgttcgtgttcaaatgttggctgaactggaagaaattattaggtacaagtgttatccacaaggttcagaaaagagggctatgatgaggcagacttggaccaaacgattacttggatgtcaaaggaatgttgatatatggcagcgaatgcttaaagttcgtgcattggttgtaaagcccaaacaagacatggaaatgtggatcaaatttgcaaacttgtgccgaaagagtggaaggctgggtttagcagaaaaatcattaaattctttgttagatgaaggagactctgataacccaaggccatctcgtgcccctccacaagtagtctatgcccagttgaagtatatgtgggcttcaggtcaacagagagctgcactgagtcatttgatagacttcacgtctaaactctcaagagacctgggtttgaacgagaatgaagcaattactcaacctttgccgacagaagttcctggtgctgcaaaacatgttgaagaatacaccaagcttttagcaagatgctacttgaagcaaggtgaatggaaggttacactcaatcctaattggagaaacgaggaggcaactggaagtattcttggatcgtaccttttggcgactcactttgatagtaattggtacaaggcgtggcataattgggctttggccaactttcaagttatctccgctcatcagtccactcatgatggtatagctgatgtatctagtagtgctagatcaagtcatacaccggatgaagttaagccagatatgctacagcattatgttattcctgcaatcaagggattcttccattctatctctctatctgaactaaatccgctacaagacactttacgtcttttgacgctgtggtttagctttggaggtattactgaagctgctcacgctatgctggaaggattctcaatggttaaaattgacacttggcttcaggttattcctcagctgatatctcgtatccatcagcccaatgaagttatgagccgatctttactgaacttactgactgatctcggaaaggcacaccctcaggctttggtataccccttggcagttgctgtaaagtctaacagtgagttgaggaaacaggctgcattaaccattattgaaaagatgcgtattcacagtccaacgttggttgagcaatctgaattggtcagtgaagagttgatcagagttgcagtgctatggtatgaactttggtacgaaggtcttgaggatgcttcaagattattctttggagaacataatactgagaagatgtttttagtattggaaccgttgcacaaattgctagacaagggtcctgagacattgcgtgagatttcgttccaaaatgcttttggccgtgaattgaacgatgcattcaactgggtgctcaattaccgaaatacgaaagatattgccaacttgaatcaagcttgggatatctactacaatgttttccgccgtatcaacagacaacttcctcaattgaagactttagaacttcaatacgtgtcgccaaaattacttgctgcgcatgacttagagctagcggtaccaggtacttactcagctggccaacctatcatctgtattcaaagctttgattctacatttagcgtgattaactcaaaacaaagaccaagaaaaatgaacattagaggaagtgatggtaagggataccagtatgtgctaaagggccatgaagacataaggcaagacagtttagttatgcagctgtttggattggtaaatacattattagtcaatgacgctgaatgtttcaagaggcatttagacattcaacaatacccagcaattccattgtcaccaagttcagggctcttaggatgggtacccaattccgatactttccatgtgctaatccgtgattaccgtgaaccaagaaagatcttactgaatattgaacatcgtatcatgttacaaatggccccagattacgagaaccttaccttgcttcaaaaggtagaagtatttacttatgcattagacaacaccaggggtcaggacttatacaaagttctttggctgaaaagtcgttcgtcagaggcatggttggacagaaggaccacttataccagatctttggccgtaatgtctatggttggttatatactcggtttgggtgacaggcatccaagcaatttgatgatggaccgtatcactggtaaggtgatccatatcgattttggagattgttttgaagctgcaattttgagagagaaattccctgagaaggtgcctttcaggttgacaagaatgattagttatgctatggaagtaagtggtatcgaaggaagtttccgcatcacttgtgaaaacgtcatgagggtattgcgtgaaaacaaagagtcgttaatggccatcttggaggcatttgcatatgatccgttgatcaactggggatttgatttcccgatagacgaactagccgaatctagtggactcaaattgaacgccatatcgccatctgagcttctagccagaggagaagtgtcagaaaaagaagcttcagaaatcgagtctgaatacaaccagcagatgagaaacgctagagctgcatttgtcctgaagagaatcaccgacaaactaacaggaaatgatttcaagagagcccatgaattagatgttaccaaccaggttgataagctgatccaacaggcaacatctgtggaaaatctatgccaacattatatcggttggtgttctttctggtaaagagaatgctagtccttattgttctttttcgagtcggtcaggttgatgctatgaccttcccacttagttaataatgaatcatcgacgagattaacattgccgtcaaagtatttggaatccaatacttttgatatttgtaattctgcccttgctttatccagtagttcagtgttgctcttggaatataaagttcctataatctggccaattctagtaccaatcgaagcacctatggggtaaccttcatcaaaggcatcttgcaatccatgattttcagctgcccctatcccgtctaagtatcccgccttggcatgtttccttcttaacgcactggtattcacatgttctttcacgggagtctctagaccataattatcttccgttgtggcctcatgcaattcctcatctccccatatgtcatcgtcgtcatcgttgatgccctcccgctggagtttctctcgcttagggtcttcttccgcggttgtcatcttctgaagcagtcaagacttgaggaagaaagaagacaatgaaaataggtggggaacgaggcggaagcttttctggaacgtacctctgcttcaactcacgcactgttcctgtgggcggttatctcgtttcttctttctcgtaatcaggaatgaaattcaaattaaattgtattgcacactaccttaaaggtgccaaacacagaaaacaaagtgacaacctcaaattcagtacaagccataaagtatctcccgaggtttattttcctcagattaaaggacgaattggtgcaggtagccaatcataatgaatagcgtcatcactcaagttgaagagaacaggtctgatagccatctgtccagtgaagcacagcagtttgacgatgactataacactgagatccggctcaacatacgcggaactagcgcaaccattaccagagatgaactgatggcactaccagaaagcattctactgtgtttgtttcccaacggagtgtttgtagatatcgaaggaaatgtcatcacaaaccttacagaggaggatgttgtgtacgtaaatttctcaccagagtgcttcaactatatagtggatactttcaacgaagcagcagcctccgatatcaatagagtccacgacgaaaggctagtgatcgaagatggtgccgacctgttgcagagcaagccttcagttatcgttcttcgtgaggatctcgactactattgtatcccgcccgtccaaggaatgagcaaagaacagatgattcaagtcaaaatagaagttggacattcactagtcaatgaggcacacatatttaagggtcttggccatcaacagaataagactttgggtcctgctgagcagcaccttgcggatatgctgtgctcatcgggattcgttgctgacggttgctggggccaccggtctttagaacctgataagacagttgtgttctccctagcattggtgcgattgaagccagacagccctgaagatactaccaacaccaagaaatctaaattcaacacattgcaataccgtaactcccgaaaaaaggccaaagaaaacactacagccacaaaacttctgctattttggaggaagccagctcgtaaatgttggtgggccagtgaaatgatcaaaaccgatctctcaagacttaatttgaaagacagcaatggaaatcccatttcaacggtggaaattaaagttcacattagaagagtttggactttggagttgtcagtgattggagtgcaataataggtttggggacacttttattttattttcattatagatggttattagtacacatgatacagtgcctataaatgcggattgattgtactagtggccggcccttgggttttactagagaaaggtgaagaatgggtcttgggcagtctagtaaccctggcaatacatttaatatacaaaattcaagaaaatgcaaaaatagaattgatgagtgctaatatttaaaactgtgttgagttattcttaagcaggagcagataaccaagccaagctttcgacatcaaaactgtctcgtacttcgactctgaaaggttcattcttgtcggcatctgattgtcctaaatgatcgattgacccatatgattttagacttaattcgatgatactgtccattgattcctgtggttccctttggtctataggtagttcatctctgtagaagtaataatgttgagtaaacatgatcaagttgcagatcaaaacttcgattgctatcaccaacttgggagtattagtgactataatatcaaaacttttggagcttatagcatctgaagttagttggatcaaagacagagatgctccaatagagtcaaagaaaatcacttgaataggccagcctttagtggattttcttttataaatgtacaatatttgggggatgttcttcccgatgctcattccgattttcattattcccaacgagttcaagaggtccagccactggcataaaccactgtgtagttctatcgaaagaaccattatgcaaacatagaccaaacagccaaggaaaaacagttttgcaggtgttgataacttttgatttctatttttacggtagccccagcaatatgcctgggagagtaccaatgtgttgataataagcccatgtaaagcgtatattaaatcattcgtgtttaccaatggtagagattcgaaatcgctggatggtggttttgtatatctcttggaaaattgacttctgatcgtgtcattgtagagaaatgatgcgtagtatatgacataaacaacgtagccgacaaagttaaaataaataaagtcaattgaaagaccagtgacacttttagtagctatgttaaccagtaagggtggccaaaaccctaagctccaggtgacaacataggcccacccacttattgtggatattaagtttaacattaatacccttttttcaccactctgaatccgacctcctctaatctaccactgaagagaagcagtgtattgttcgtctacgtaaatttgaatgtgtaaatggcaaacatggcttcggggatgatttggcatatatattattgtagcatcgtctgtggctctatgagttgtgtggcggatgatgaaaagtttcgtgctgatcccacaatgcggcatttaccaaatggggaaagaccagatttcttcgctgcgccagctagggacagcataatgttccaagaagaagcgattacaggtggattacaaagcgttcgtctgcagttgatgttctacgtgatgggtatgagttgtagtgctacgctccatgaatacttctaatttgtcgttgacaatccatgaataatttaagtttgcttcccaagagtctattgcgaagggtgagccgaatctcttggcgtatgcacccgactcgtcggcttttgtgcgttccttgcaaagctcggtagcaatccgttggtgggagaaatttgtctcacgaatttcagttgggagtagctgttcctggtagcaagttcgaggggatctgtgctcataaaacgtgctcacgccaaaaatattcttacaaaatcttcgcggggtgtttgtcttacataatcgattggatattttcttcaaatttttttttcttactgaagtcccctatagagatgcttgaagatttagttgaaaatccttctaaggtattcagtaatgtcgaggtcaaagacatacttaaacaggccaagcaactgatagatcccatttccaagcaaaattctgttttggatgaggtttacattgatggccttgcctcttctcaagtttgggctcagatcaagcttgtcattgatggggttacagaagatgttttgttcaacaaaattccggaattgaagaagaccggtcaagcgaatgaggaagttgatgggtccttggaagaagagggcagtagtaatgctgaagaagagaacgaagaatctgaaagtgatattgttgaagatgaaattgaagatgaagacgaaggcgaagatgaggaagagggatctaacgaaaacgaggctctagatgtattgaacgaagagctgaatgaagtcgaagaagaaaaaccggaagatgatgttgaagaaccaaagacagctcctagagaaagtaacgaatcgtcagacgatgagagtgagtttatcgatacccacaccgaagagtttgcacaggcggaggatgaattaaacgatgaattttttgatctggaacagtttcaacaacaagttatcgctatggagaaacccaacgatgacgatgacgacgaagaaattgattattttggagagtctgacaatgctgcggaagaatctgataacgaagaagtaatgtactacaaccaattttttgatcctaaaggattcaaaccaaagactgaaaagaaaaagaaaaaggttaccttcgatttgcaggaagaagaaaatttaaacgaagaggaccatatggacaagctagttgcatctacgatggaggatctttttgatgaccatctatcggaagatgaagagatctcagaaacaggtgagaagaatctgtccacttttgaaaaacagcaaagagaaatacagaaacaaatagccgaattggaacaagagcaaatcgcccaaaagaaatggaccttgaccggtgaagcttcagtcaaaacgagagaagccgatgcattgttggaagaagacttagattttgaaagaacttccaaaccagtcccagttattacgcaagatgttaccgaatccattgaagatctcatcaggaaaagaatttccaactatcagttcgatgaactacaaaaaagattacctactaatattgccaagttcaagagttctcaaaaagttgaagttagtgaacagaaatctatcaagtctcttgccgagttgtacgaggaagattatgtcaagcccgattcaactgcaaacaaagaacttgagaaggcacatgatgagatatcacagctatatgagacactcagccatagattagactccctctgctctgcccactttattcctaagcctgcgaagagatcgttggaggtcaaggttcaaactgacaccatcacgatggaggatgctcaaccattgacattggctggagaatccacgtttgctcctcaagaagtttacaaacctcaggctaagaagcaaagaaagtccaagaatagagaatccatggaagactaagcatactcccccaactcacataaatctttttcacttaactgtatactaaagtttaaatacgacataatttcctggggaaattttttcggtcacgtgtaatgatatcaactcgtctgctgggtgccctatctttcaagatcagaaagtgttcccttcatacatcagcatcatgaacagaaacttggctttcctccgtccatcacctcgttttttcagctccgccctgaggactcaatcgaacaagctgccgtttgttcccttggtggcagagaatggattcgtggacgctattggaaacactcctctgatcaagcttaataaattgtctgaccagttggagcgtaacatatatgcgaaggcagagtggatgaatccaggtggttcagttaaggatagagcagctctttacataattcaagacgcggaagccaagggtcagattcaagctggaggtacagtagttgagggtactgctggtaacacggggattggattggcccatgtctgtagatcaagaggatacaaatgtgtcatatacatgcccaacacccaagcagcttcaaagatagatctgctcaagcttcttggagctgaagtttatccagtcccagttaagccatttgacgacccaatgaactataaccaccaggccaagagacatgcagagtctttggataatgctgtatggaccaaccaatttgacaatactgctaacaggaatgctcatatccaatcgactggtcccgaaatctgggcacaacttgatggaaaggttgatggtttcacttgctcaactggtaccggaggcactctcgctggagtaacccgatacctcaaggaaatctctaacggcaaagttaagtccgtgcttgcagacccaccaggatcggtattgtactcctatatcaagactaacggaaaagaactggatagatccggaagttctttcaccgagggaattggtcagggaagagtcacagacaacttgaagcctgacctagaaattatcgacgatgctatcagaattcctgatgaagaatccattgttatgctgtacagactgttggacgaagagggtatctatataggtggtactggtgccttgaacgtcgtagccgccgcagaagtagctaaaactttgcccaagggctcaaatgtggtcactatccttgctgactctgcacacaaatattcggacagaattttcagcaaaaaatggttgcagcaaaaaaatttgtacgatgttcttccagcaaacttgcaaaaatatgctatcttagattaagaataataaacaatcaggtaatggtctgaatataaggactattcaaagaatgtatctctcgacataatatctgccagctggtctctcgtaaaaagtaatcgggtacatttcgtttgatgcgcatgggataatcctttatctggacaacatctccatcctcagagcttatggaagcttccagtatgactccaccatgatgatcattagtttccaatggtgactcgaccgaagtggagatgttatctggctcctcctgttcttccacaaggagcatctcacttctaaaactttgaggtttgaaagaacttctcctcgagctcgttgagcccatgcctatggaggttcgatccgttgtggcaagtgaaactctagaaacgactgagctagtggtagattcaagactctccgatctatccctagaccatctttctctttcacctttgaaaactctgttgagatctctattttgactttccacaaatgtttcttcccaggtataaagctcgtacaagagccttaagtttggttggatgataacattgagtcttctgactctaacgtaaaggtatgctctaggaagactgacgtttaatcttttcataacttcagcaatacacagggatgcagacctggacacacctacttgacagtgaactaatactttctcgttttgttcgtaggcggcttgaataaaatcaagagcatcatttatcgtctcggtcaaagtcccaactccatcatctttgatatcaaatgccagcatttgctttatcatggagggaatcccgtcgggtgtttgtgcaccatgagacaaagacaatatcgaacagcctgagtgcgtttttcgttgtgtatacggcatatacgtcatccattcagcccattctccaactcctactattctcgttatgcctagttcattcagtagtggtaggtcgttagcatgattaagagatcctaagtataagtggggcaaaattcttgagggtaacgaacctttcaaattaaagcaaacatttttggtaatcaagttgtcattcagtttgagactacttgacttcaaaaatatacttgctaacgaggaaacagtgaccattgtctttgaaattgaatcaatcggtatacccttgggagagaagtgcgttaacagtggttccactttcttcaaaaatatgtagtcagactcaaaaaggaagcatggtctgaaatattctttgtgaagatttataattgtttggtcaacagaaaccatatccaaataagtgagtaaacttacgactaacaaagagctttcagtatatccgtcagaacaaaataacaaggctggagctccagtgagctgtgttttcagataaatatatttgcacaaattaaccacagccacaagttcctgttcggagcaatcacctatgcttacagagcctgaattgggaaagtcaataactatatcctccccttcactctcgtcaagtccatcgaacaaaatctctaattgctctagagttggaaatttgttcccatctttacaatgtatgaatacgcgccaattagctcttgggaatggtatcaaatgaaattcgtcatcaacagataaaatttcattggaggtcagggagacaatggtattcctttcatcaaagtattttggatgtggctggaataattgtccgtgctttagatgctcctgttcgtaattaaaatcttgatcttgcgccttcagcgtttgcaaactatgaaaatcagtaagattaccgagccataggccattctttatctctgttgctgcagacatcttggacaactcaagggattctttatacaaataatcggcatcccagttattgaagttcagaatatcaaacgaggacagtaagtggcctggagttcgaaatgaatcagaactttcaacaggaactaatgccatcaacttttgttggtcgagttcattgatatctagccttggtaagatatacgaacgatatctgcaatcttgtaggtcttgtaaggttgatttcttgtacatctgagccaagcgtattaagcgagcaagagactcgcaggaacaattctcagaatttggctgtaaatggtcatcgttgagacaataacaaaatatgtcagagatatggcttatttttgaacattgaatccctacattccgcaaactaattgtattcactggatccagttccaaaaataaaggaagtacttttaacttgtagcaatcatcgataatgagagataaaaaagaggaatccatctttactttggagaggaatccttttaggaaaatctttagttccagtttagaggacccttcccatgcggtaagtatttctcgtggttccagggaattcaataacatgccagaatttgcaataatgtcaccagcacatggagcagatctacaaaaaatgtaatctcgtatatctctggggacttcaaaatttgggatcaatgacctcatatgcattgcggcacgaataaactcgatttgagcacgattattacgatgaataccgtgcaaccaagggaacattttgtccgccggtggcagtttcttggtggtaaaaaaagtcatcaataggtagtattgatccaaagtgatatacttgatatcgaagttatccatcgattggttatccttgaaaatggagaggtatggattgtccccctgcagagaagcttctatcagataattcttgtctacaaactgaggattgatgtctttgacgtccttagaagatccaagtagtgtgttggataacctgctcctaagtttttctctatctgctcctgaaagattggtgctattagcccgttttccgccagacctatgctcagaaagctttgtctgtgatagggatgttgttgctttacttttggacggcggtgacctgttcaaatgtttgggggtaatatcttccatcaatgcaagctctcgactgctgcccgtgcctgcagaagacactggaaaaaatgattcagggcccataaacctttccttagacaactgagatgagtccgactgcttgcgggaagctttggatggtttttcgggcatactgaacgttaccttcattgatcaccgttacaagccacagtgtaaatcggtaaacaagtattcgcactaatgccgttttggaggttgatcgatcgataattcaggcagaagttaaaaaatcaacaatgattatggctattgtgaaaatggcttatcaagagttgctaaactatggaactaatagattccaagggttgtacgctgtatggcaacacaggagaggggtagaaccgaagctgataagattatatcttatcaatgttagttgcagggaaccaaggggagcatcatcacacgccaaattcgcgaaaaaagcgcggggttggatagctgttttacatctcacatagtgggaaatctagatcttcgtctgaagatgaattattttggattatctaatattttggcatactggaatctatttcatttgaccagcaattcaatcctcctattatgtctttcgaaggtatcccaagagtcctgaaaaattccactgctgattgagagtcattgccatatcggcatataaagaagttaggggtcccgcgttggaattgtgacagatctttcagttctttcttcatcagttggtctatgggaatattaatcgaattgggcaaggaacagatctggaattgctcctttggtctcacatctatcagtgagtggtctgttgacactagctcatcgtatttagtcaccgagattctatcattttctggatccattaccctgtaatggatggtaccgcagaacgcctggtagtcgatttcaccggattcaatggcttttcgtgttattgttccattgcatatcgcacacttctcactgcgtcctctcatcttgaatgttcgaagactttgttttgggtaactagaatagatcgtcaagaatggtgaaaagttttccattgtataatacccggtgataagcttgatagcttcgtaggccatcatgattccaaccatacctattgctggcccaataactcccccatctttacaagaagtgactgagtttggtggtggaggattaggatagaaacacctatagcaaggcccctggttttgaaaattcaaaatgctcaattgtccctctgttttcagtcctgatccagacacaattgtcagtccacacagaacggctccgtcattgatcaagtagcgcgtctggggggtatcagtgcaatctaggacgtattcataccctgacattacctcgaatacattatcattgtccaatcggattgggaaagtttcaatttcggtattaggattcaaattctctaaataaaccctagcgctttcacatttgagcatgcccacacgattggttgtgtgcaatacctgacgatgcagattggacttatccacgtaatcattgtcgactattcctatcttccctactccggctgcacataagtacaacaaagctgggcaacctagtccacctgctcctatcaccaatactttgctatttttcaaatttacctgtccttgaaccccttgaaattctggtactattagttgtctcccgtatctgctgtactcgtctagagataaggggtatccgttcgaaggctccatttcgatggcctcggcctttttatcagccagtttattcctgagagatctattttcctccttgactctttcaagttctctagtgagctcctccactgacatttccgagtttagaataaacttcagagaccccaaaatcaggagatgatacatagagcgaatttttcagtttgagtacttatctacttacgtaagaaatgtagggcaagagagcgtaaagcagacacagttacatcgctttcagtgtcaccagattgcttgaacgtgcctaggataaactctcacatatgaacagggagcatgtaagcctaaacaaccttttgcttaacaaaaaatcctttcaagtagctcagttgccaaacacctgtggcaacgaggacggccacctggaataaagtccacttaactgctcttgaattggtagattccgattgatctctgaaaatcatttctctttctctgaataaatcttgttcgaccctgatgtgttgcaatttcttactcagttcattgattctggcagtcaactcattaaactcggaggatttcttggaatcaacataggatttagcatctccaatagccaagtcaaagaagactctgtgtctggctctcttggaccagtctgtgtgtcttggagtcagacaaaatctgtgttcaccggtatcaagcgaggtaaacgttaattggccaataggttcattcttttggttgacgaccttgtgattgttgtgaaataactcttccactgtaagttcgactttcaagttgttcactttttcatactctcttgtgttcaagttgagctcatacacctcgtattttccaacggcaatggtgtccttgggcaactcttcgtagaaacactttgtttcgtccgtatcaacgtagaaatgaaaggcgttggcgattcccaccaataggaacaacaaagtcaacaacttagacatcttgtgtggaagttgaggtaagaagggaagacgattttttgtttgacacgcgtccaccatatgatccgcgatggaaaaagagaatgttgcttatgtaaccaaacattaaatgctattattatgacaaacgatctatacatgaacaacctaatagtgatttaatctccacatacgtacttttcctgccgtgttaccgacacacagagtctcaccacgagggctgaatttcaccgtggtaacggttcccaatggagtggttctggtgggccagtttcggaatactgtacaagagggcaggtggacaagtcttaatccatcagacacagcgttagaagttacgcacaacacttggccatcaggagtgaaatctaaggctgtgatggcagttaccaaattctccacagttccaattggctttgggcgagtcgtagagttggtcaatttgcgtctgtcgtaaatgtttacaataccaacattgttaccaactgccaaccacctatcacaggcttttatttgcgtaataccggttcctgaatcgtcggaccatttattcaagaactttccggtatcgacgttccattcccagacttcacctgcggaattgactgctattagtatattatcgtcactctgtttcatgaagtcaatatccaccacttcatcttcaattttgaatcctctcaaccataacccgttcgtggtagagagaacgttcacccaacctgagttaccagccagtccaatgtatcttccatcacatgatagcttaaaatgcccaaacgacttttgagtcttttcgttcccgtacaatttgtttattttttcaacccgttcgttctggagattccatttgtacatgtaaggcctacttccaccagcaaacaacttgtcatcctgaaattcaaggctgagaattgaagactgtttcaaatggatagaagtgatgaaattattaaccttaccgtccaactggaatattctgatggttctatccattccaccagtggctagaagagggtgggttgggtggaatgcaatagtttttatggaagaatgagctactcgttgcgcattggcatctctcaatctatcaatatcgatgttagttggaggtaatagttttgtagttttactagccacctggtattgttttgaaagaatgtcaagtagcatattactcttgaccaattcattttcctcctggcttgcggttccatcactatcttcagaatcactttcatctgcccaatcaggtcttgggtggatcttttcaaattgcgatttaagtctgaaaatgtaagactttccggataaaacagattcattttcacgttttctcagtttctcgagtttatcatctttcacaacggatattctcagattttgatcgtcactatcttcccatgcatcgctttcttcttcggaataatcagtattgtcctcacttccagattctccgtggtagtccactccaacatctcctttggattcgtcaacaaagaataactgatcgtcttgtaatttttcaaaatcatcatcttcactaacatcatcaccttcaggctcattaccagagtctgcttcagtctcatctcttccaaagaaatccacatctctcagccctttttcaaatccttcaagatcaccaaatacaagacgttccaattccaactcctcctcatccttggggggtatttccatagcttgttcgtctacgatcatattgtattgtgttcttggggaggaaataaaaaaaaaattatactcgaatgaaatatcgaagggtcgaatcgggcaatcctaacagccccaggcccgtcatcgagtgaagagctcaaagggtgtgcactccccgatatttcaagtgggatcagtatcaaatccagaaaacctggcatactaacctaaacagagtcccttcaatcatggcgtaagtaccttcctgcttcctgcactgttttgaccaatactaaccgtcaagacaacccgacaaatattataacaaatacacctaccagatgtctccggcaatgttgagagctagaagaccatacttctggaagaatatgggagcttttggtattctgggaggtatatctctaagtgtgtacctttacacatacaactttttgatgcaagatgattttgagaatattcctattcctccaattaaagacgaagatttggctgccctgagaagagagtacgaggaaaagaagcaactcagcaagtaggattattcctgtaaggttacctgaaaatgcagttgatacttgtatatatattatgtctgagaatacgattttgtgatgtgattgctcagggtgcaacgatgtgtaaaaaagattatcgtgaaatcttgggttacgtgtatccgcttcctctgtacgagttctttgtaacagtttctccaaaaaaactggtagtagagtctgacctggattgcgaattcgaatcatatggattggattcgtttaggttgatactgctctcttgctcagagaaattcctgtgagtatataaataggggttctcgtaagacatgtatcgactgttcttggttccaattggtttgggaacctctagttcactagtagtcaatagagaattaacttcgtaggcatcctcgtcgtagtagttatcatcatcgtcaatgtcaggaagttttggtaagaagttttgattctcgttctctagtttgatcatgtttagctcggtgggcaatcttttgcttacaaagtcatgaatcactctgttggcttctaaagaacaatactgttttaaaccatccttgtaacctcttcctgaccagtataccctaagagggatgtaagaaagaagtgctgttactagcatgatcataaaaaatacccacaaaatgaatgaaaatgtcatgaaacccaatgtcacagctgcgtatcggttttcttctgcaaccttcgaaattaccttcgtaattgtggaaaagtctccagtctccaatttcaggaacttgaataatgtgattccatttattacctgtctcggagaatcagcaatcaaaagcgtcaaacaatctctgatggaaaagaaggtgaagaatgtaagtcttttcacaaagccaccagcaccaattttgtcgtacacacaaaaatagctgtaatgcctgatggagtacgtatttcttagtatgttgttcatatatgtttcgcatatccgttgagatcggtggaagaaggcccatatccattttgcaatgagaattgcaagacttgcgaatatgcagccaacaaagatccaccgacagatctctttagagataaatggctcaatattcatggcccagcggtttaaattaatcagcctataagcagtgactatatcagacaccaaaaatgctatcgataatatgataaagagccacatcatcaggtacgccaggagtgtggagatcttgaagttgacaaatagctgcgactctatgatatcgaaagtcgtgttatcaagcttcactgcccatgattttcttttctctttgttgtccgacgtataagacatcttgctcagaaagaactactgtctctgaggggcagaagaagggttaaagaatcaacctgttggtttcaggtccccaaggtatcttgaaacgcgcatacgcgaagtccaaaaatagagcagggtctggagttaatttcctttcggtttttgtcagagcactcacctacagctgtaaggtaatgcaaggttgagtgatggaccttggatattcatcagacagcgactttgaaacgaaccaaaaagaggagtcatatgagacagaagattgggttgaggtgaaactgcccatccccggtgaatcgagtgtcctcaggaaaaaaagagcccttgaaaatcttgacgttggtgtcgtcaacgacactattggagagaaaaaggagggagttcacaaagacctaaacgatatagcggagtcagagaccacttcaatttcaaacacacagtccaatgatgatagcaatactcgaatctttgatggagacgcgtattataatgaaaataaactgatgaaagatgagttggcctctaaaatagattccccttcgttcagtaaatcccgctccaatcagttatccaacttgatgaactacaccgagaaaaacaaagagaaattggaagagcgtttcattaatgatagaatgaagaagaagaaaaaacaatctgagtatggcttctgaaagagttattctatcaaacttgtcaatggtatcttaaattcctttaggtcagctttggtttcaaccagggccaattttccttctttgatggtaatgacaacgtattcggagtcattcttttggagtttaacgatatagtcaccaagtttaactacctttaatccgagtattctctgaacaatatcttggtattctttcaattctcgttcggatatttctttgatagaaaggtaggaaacttgaaattcagatactttggattccagctgctggtttttctcaaagagttgatcaaataactctttcgatactgaagtagtcaaagtgtttgctgtttctgctgaggcttttgtagcctcttcagttgctactaatttttgaatctgctcatttctagacttgagctcatcttctaactctgagagtttgatagacaattcctgtttctctttactcaattgtacgatttgctcattcttatcaggtaagactgtgctttcctcttttattttctgccttttggactctctagattctgtgagtgagctaatgtgcgcaacttgaatttcgaactcttgacatagactattcagtttgtctagtagaatcttatccgtactatcaggcttttctatgttctcgtttccgttcatttttttcctgtagaaatctctctctagtgaaatattatccatctgatctttcataaaaagaagatgtttatctttcaagcctacttgtatcgacaagcgtgaaatgtccagctctttgtcggaaacgtcgagtttcaaagactgcaactgtttttgaagctttgctagctgatcaactgtttccaattgagcaggatgaacacgataaagatcctctctaagcacattcagggcaagttctttagacttgttcaaatcttcaagcaaacttatctttttcaaaagtttctgggttgatacaacttcgtctgaatcgaagttctgaaattttgactgatattgtgccaattttttagccaattctgaattatccttcaacagtttgtcataattgtgagccttaaactctaactgtttgttggactctttaaggtacagcaaaagctcgtgatccagtttgcttgatttggataaattcagtaaatgctcattctcttgctcaagcttagtgaccttttgaattaactggctcaattcgttttcatatagtttcgattctttattttctgggtttgcaacagaaggtgtctgattttcctttaacctttcattttcttctctagcctgtgacaattcacgtttcgactcatccaattgagtttctaacaatttaagcccatttgttttcacatttacagtattcttcaaactgttcagttctctgatcaaggctatgttctgttcctctagttcgtccaatttgctctcatattcgtctttggcatccagtaattgctgctctgcaagctttttatcatttttagacaataggcttttgttttccttcttcagttggtctatttgctccacaagtttgaggttcctttggtaaagaaaatccttatcacctttcaaatcctgaatatccctgttttgcaaatcaagcttgctgagcagattggagtactctatctgatggttggctttgcttaattcaagctgattcctaagctcttgtatttcaaaagacatgccattggggttaggtatttgatgtttacttggtgtggcatgaattggcgcgggtcaaaatagcatagagatgcccgtctcctgggctgtgacctcattctcacgagacaaatacagtatttaaacaagtaaattggcgctccacctcaattgcaaagaccaataccgttacctggtaaccgccgtcgacattggactaaaaggccgtaagatcagcttagtattcagctggcatgcccctccaatgtctgagcccactaaatctcgccctccctcactgccccccgaggataacttctcgatttaatctatcttccttccttctcctctaaccccatatacacgatgtccacaatgtaagaagacgcacacatcccagatcttagtcattccactaacaatcccttttagaccaaggaacttcaaacttttggaagaattagagaaaggtgagaaaggtttagggtcagagtcttgctcctacgggctccaagacctggatgatctgaccatgacgtattggaacggaaccgtattaggcccaccaaactcggtgcactcaaatagaatctactttttaacgattgagtgcaatgagagttacccagaaaaccccccaatcgtcaaatttcaaagtaagattaacctaccatgcgtcgaccaaacaacaggattagtagaccccaagaaattcaagaccttgggcgaatggaaaagaagttacagcatagaaatcgttctattggaactgagaaaggaaatggcattacctggtaataagaagcttgcacaaccaaaagagggaagtacctatttttgatactcattaattatattttacagttatcggtctattttgttactctactttatttctccttccttactgttccgttcctcatattcttgaaaccttatcattaaatctctttctgcctcaaaaaatctgtccatgaggctactattgtcgtacttgttcgttagggagtccgtaacttcaatgactgtgtattctcttgggattagtttctttccagttaaattcagtcctccattctctggtattatgttcctcttggcttcttggtttcccctccggcatttggcaaacaccctcttgaagggcacacatattatctcgtcagcagagaaggtacattggttctggatgatggagtacagctcacagtttgaaggcaaaaatttcatcatgtactgtggaaattgcatcttgacttcatctctcgtatatacagggactggtggtgccatcttggtctacaaagggggaaacgacagagagggtggggatgtggatcttacacttacataggtgcgaaataatgtacagtgagataggtatatgctgatgtaatcatgaagttgtgatatcaatactgaatccacttggcccagtctctatccaatatttcacttagctcttccagtgtcacatttaagtagtaaaatttgacagatcgggaacttatgttgttgttaaacataaaactttgagacttgttggtatttctggaagacacgttgatgtctaaaagtagatacttggtaatcagggtctcccaacatttttccatcagaaacttttcatagacgttgaaactggctaccactccggttgaagattgaaagttagacatctggcttatcctttcttgttgaaattttttaaccaactttgaatattcttcgtacaccagattgaaattaacattctcaagacattggtctttgaccactctacttgcagaaatgagaagctgaatctccagttcagacagacctttaagtattatatcctctaaacacatcggccgaagtaaggacgttatgttgtaggcagaatctagatctcctggaagtggggacaactctgataattgagatacaataggcacacagtgaagtttgaattgtactatgtctcttgttgtgtaataaatctcaaccagtttttgccttaaaggcgaagacgttgtgagaagctcttgaattcgactgttgtacgcctcaaagtaggatttcgtagcggcatcaggttgtccttccttgggcacacttgccagcagatttactagacaaattgaagtaaactcctccaggcttgtagctttgttgaactggaggattctctgcgaaaaccgacttttcacacgcttctccaaaagctctctagtgttcagcctgttggttattccaataactgacatgggacttgaaccattttgagtaatatctagaagattgtataagaaagactgtctctggtttacaaagacttcaaatgtctccaaaataacgattatgggaatgttgttcccttttatctcatcttcgctgttctgctgtaatctcttactatctaaaattcttagaatactttccagcgtatgagttatgttcttcttttcaacagttacgaatttgtccttcgatacaattctgtccaatatggtatcgtacccagctaactgcgacagtttgatatccaactgatgagcaaactctctcactgcttttttatcatcagtctgaaaaataccgttcaacttaattgtgataaaacctttgggatgttctttttccagttgagctaaaacttgattgactaaacttgtctttcctgtgtttctgggacccatcaatagaagagacctactttgaaggtcattcaagcaatgcttgcatagagagtacacttgacgataatgatcatccaagccgtataaaagctgggaattccttctcagttttgagagaacttgagttttcagtagctttatggtagttgtaggaactggttcctccggattaaacgccgttagctggctaattctaggagaatcattctccttctttttctcgttggcaccattcgtgacaattgtcactccagatttgttgccgacaactttagctttctctttgaacacatcgctgatacgatcatctcccattctatccaccctcaaactgttgaattctccagcaaaatccttggtgagctgcgagttgtcagtcaatgctggagttgttgacaccttatcgttattccttgaagggctattatctttttcatattcaagcacatcgacgaggttagtcttcatatgggtttaccaacagagtatgccacgagagacagattaagtactgatcgcggcgcgatcagatggctgaaattttgatgtcaaagatctcagtgaaagaactagaaggcaacgccttaaggttatttatagcttaatagcggatcaaccttttcccaatatcgccgaactctaaaccaaagcttgctctttcctctttcaccctagtcccaaccctccactcttggacaccgcttacgtacaacgcgtatagttgtcgcgcgaatataaatctaaggaaggctacataaattggcaagtgacagtaggatcaagctaatattgctttctaacctcaccaatccccagtgaatttaaacatgactccaccccaagttctccaactgctgaaaagtgccaaatatattcatctaggaacatctgcggatgacattccccatgtttcgctgatgaactacacttatgtctcaccagaagaggttttgaaagaggggtttccactctcggacgcatcccattctgtaatcattctcaccacagacaaggacactgtcaagtacaacaatatgcgagccaaccctagcgtgtccattctggttcacgactgggtgactaagtcaaacagtcttgaagcaggggcaaatcacttgctctcgttcttgaagaatctcaaccagaacgaactagtttctacaagtgccactttagccggaaaagcacatatacttagtgacgaaaagcaaatcgagtactacaagaaaaaacatttagaaaacaatccagagggaaaagtatttattgatggagataatgtggctattgtgctggtccaggtccttagctccaaggttgcagatactgagaataatgtttccgaatacaacagttgagtttacgtagagcgctgtgtaatatcaattagtttattttttattaatgaaatgattgaaatgattctaaccttcagatccgaagtcatttgtgaattcctcaaaccgtgctaagtcttgtttattcactgtaggacggttgttcttaacagccttaatgaagtctttcatggttagctcaggctcctgcaattgctctgtctctaaatccatccagctcatttcaacggccccttcgtctcctggtgaacatggagtgtattttccatcttcagtcggtttgaaatgtgtagcactttgaatttttctaatcggttgcattaatgcatctctaacgacaacagcgacgtcgtgaccggaatatccgtcggttatggacgctaacgttctatagtcctcattgtctaattcgcaggcagtgttgccaatgttcaacttgaacatttccactctagcctcaggttcgggtaacgcaatgtaaattctcttttcaaaacgtcttcttatggcagcatctaattgccatggaatatttgttgctccaagtactagtaccccatcagagtcgttgccaacaccattcatttgaaccagtaactctgtcttgatccttctggaagcatcactctcattttcccctctcggaccacacagagcatccacttcatctatgaaaataatggaaggtttgttttctcgtgccatgttgaacaactgttttactaatctttcactctctcccatccacttggatactagatccgaagatgacacagaaaagaatgtagagttagcttccgtcgcaactgctttagccaaataagatttacctgtaccaggaggtccgtacaacaatattccactggtcggtttcctcttccctgtaaataaatgaggaaatttgacaggtagtataaccgcttcctttaaagcatctttggcagcttctaaaccagcaatatccgaccacttgacatcaggtttctcactcaaaatggagctggacaaagcacccctcaacttcttgttatcgtcgtcatcgccatcaggtccacctccagccttcttagccttgacggatccattagtagctgagttttcaccagattgggttgtctgttcctgtttatccaaatgctctttcagttcttctgctcttgacaagtactctgtgaatttgtttctaatcagttgctttgattttggattcttctcatatttgatagccaacatgagatagtccaagccgttgtagtacagtttgtatgcctcatcatattttgttgcagtgtcagcttcaatggccttttgtaccaaatctatacctttgtttaaaaaatctgacatctatcgcaggtaaatgggaatgtgcctggtaagggttgcctacacgcttgtcgaatggatatcttttggattacatgagatcgccatgagatcgcgggtgttcgttagtgaaatggattcaaattgagctgcgatagctactatctaagctctcttcagagaaggctccttcagtttaaagttacgggttgaaaatgtacttagattatttagccctttaaggaacattgacgacatcccaatcagtaggatcgtgcgcgttgggatggtctaattgaccaatttcctggtcatttagttcgaaaccaaaaacatcaatgttctcagggagtctccctatagtttgggtcttggggataggaatatgtcctttttgaatcgaccatcttagtagtacttgagctggagtaactcctttgttctttgcaattgacttcacaacctgttcgttgaaacgacctccacgagccaatggtgagtaagcctcagtcagaatctcattcttatggcagaaatcgactagacgttccctcatacaccaaggtgatagttcaacttgatttacaactggtttgtatttcaacccatcccacgaaaataactcttttatatgagcttctccccaggaggacacccctaattgcttcacaattccctgatcaacagcttcttgcatcgcctggtaggtctctttacgtaccttaggtcccccattaggtgaatgcatcaacagcaagtcaatatactccaatcccggcacctggtcgatggctctctggatagacctctttgcattttcgtacccaaactgggaatcccaaagcttggtggtgtaaaaaacgtcagatcgtttgttattttctggatcctcatccaaccaccgttcaattccttccccgacttctttttcattgcgataaagataagcggtgtcgattaggcgaaatccagccttaagtgcatgatagacaacattggcagcttgagatctgcccaattcccaggttccaaacccaatgtgagggattttgtttccgttattcaattgaagataccttgacatgttttacctgcttttccagtttactagaattgagagtcgactatttcggtgtagcctgtcatttataaagtgctcatttgattttgaaatattcgctagcaatctaatcgtaatcttcagtcctatacaattgaaatatcctaaacaatctgagttcttttcctacaactgccaatcatctttatcggatacacttataaatggatcttcaatgctattaatcttgagatcactgcacagacagcatttcccgcttagaagcttgtcgatctcctctctcaattcagccctgctctctctctttgagctcatccgtttctcaatactactaatctgactcttcaatttgtagtcgttgctctccaatatagaagctaccagacaatcctggtggaacgagtgaccgcaagggaagatcatgaatttcctggtaatcagtatgcggttgcacaccgaacaagactctttaggctctataatctggaaactgtcattcttaaactccgccaactctttcttgatggtttcggaaatatcagctgattcgtccatttcttgagataatagcttcatctctttggaatagtcctccaacgattgcacaatctccttcttgaaattgtcaattacaacgaaatcgggaaataatggtaaaagatctttaatcgtcaacatatcacacttgcctaacaagaagctcaacgtctttttgatcttctctcctatctcgtccgtatcgtaggtgatcaagtctgtctggaactttctattactaataatgttgaatatcatcttgcgactaatttggagccatagtttcttccttagcttatcatcaatatcctgtttctcagctatctgagtagatttccatagtaagtcattgtctaaagccagttggattgcattttgatattgatccaacatagaatacaactggaccatgctctcaatgcgtttaaacctgttgcatagtcttagtatcaaatctgcgtcgaagtaaatggagatcttgccatctggatgcacgttatcctcgagatatttcaaagataatgtttcgtcagaatttggataagaaataatcattgtgaggaatgtgttatgaaccacattatcagggcttcctgtgaaccgaataaaatagctcaagaacctgattgcttgattatttgatatatcaattctcttcgagactgatctgttgtatgtcaataaggaaggaattagcttgtgaatgtccaagttttcaatcattttcatccacgtgttaatagtctcatttggttcgttcaaaagcaggacagtggcatatttgtatacaataactggatcattttggatagcaattatcttaatggcatccttccatttcgaaaggcccacatagtaacccaatacgaaatcataatctttgatcaaattggcaaaatacaagagatcctcgttcaagttgtgaggtatcaatagctggtaaacagtttccttatccaatgaatctttgaacttgttgacaaaagactgaaacttggtgtgaatgttcttcgattcttcctcggataaagatttatctgaaagcatctgaataagcaactttatgcatgaacaacttaatatgactttttgcatttgaaacttctttgtcggaaatgactccaatttggtagttaagtatagtagtaaactgtcgtactccttgagttccaggagttgtaaggtgatggtctcaaaattataggaagtcatggctaaaattttagcaccttctgagtatttcttcagctccaagtggttttttcctttctctataagaatcaagtctctgttcaacttatcgttggagaccatatctagtgcttcatcgaactttttttgagcaagtagaatcctccaaatatccttcgcctcgttgttaatgatgatttcataaatggagtcttcattgaactgccaataactggaagagtagctatcagttgataatcttaccgcctcgggagcggattgtctcgcactaatagttgaattcaaactattgatcagtataatatcgttgtgcttagtcatgactagaacgtgatacttggtcaaagaaaacgatttgatgtcggatgcttttacatttgacggtaatgaaacttttacgttttccaattggaatcccagatctgtcaagatcgcatatgttttatcatcggtatataccttcctgatggaaagctcttcaaatccaatattttttttgaacacgctgacaaaattggacgaattgtgatgaattttttctaacttatctttgtaggttgatatccctgtctttgtaaatatgatgatatccaaatctacggcgttctttaacgtccagaacacatcaacgatggacttgtcgtgatgcacatttttgaaatacctttctattttattggaattcaggttgatgcaggtctcatagacattttgttcatcaaagacaagaaacggccctgtcgtcgaatggcctaccagttcatcactaaacttaatgccaataagatctaaattcttgagctttttcaatgagattgcacttttggatttcctgttcacataaaagtagtccagactcttggttttgacaattagatggcagcccttatagtcactaaacgagccgacaacttgggtacctgcacttatcggtaattgtatagttgagacgttttcgggcctactcaagtcaattgtgtaaatggtaccattctccaaaaccagatcaagaatgttactgttgacttgaaggtcaactgtttttcccttgatgtggaattctagttgaacttcttctattgataggtccatgtaggttggtgctgtgtgtcttctggaaagattgatgttggctggtcgcgcagatgctgaaaagagagggcacactatcaagctagccgtggatgattaattttaatggaaggaaggggggataagctttgctcagctcttctttacgtggtcaacaagattatgagactcaattgagactcaattgcgaggtgcggaagatgtggacagagtttcagctcgaatacctatacaacaatctcactctaacaacaacaaacttagatttaatgtcagacgcacagatatctccgggccaatccacagattatctagtaccctgccgaatccagttttgtttccgtgctgtctccaataggtctgttttattgatggaaactacgtctatcttcacgtgattcaagatagatgtacctgattacatcagctagtcccccgggttttcaatgtttcagatcaaggctgattgatgaagaaacatgagaggtcaccacacttagattggctttacattacaaatattcgtgtaggttttacctcgtctcgttgccattgttagtgggatcttcatagtctttgttctagctgatggttgaaattgtgcgattggtattcgtcattttttaatgcagcacctatcgtctggcagtgcccgaaattgtcacataaatagcattcaacaccttttacaaatgcttgaattgccaagcagaaaggcaggttgtcaatgaattgtcaaggtctcatagacttgctgcaatttctcaagtcgatggtaagacgtccaattcgtcattctcagacactgttatggataatcaaatttatctagaaacatttattgttggacaactcttttgtagcactatcctcttggccatcgcattctggttcagatgatcgactacagcatttgcccatctaactgaaatagcctacaataaccggaaactttcatgtcaaagatcactgaaaacggattacaaatgacatacactcttacaataatatcttgtcatcttcaatgggcaatcacagttcttcattaacaatgtcgagtaagatgccacagtaattaacacggccagcctacggtacaattctccaattggcctccctcgtgctctctcaaagccttgaaaaatcagcaaagtgtaaccagtccaaatcaggacctctcaatcctgtttcaacaaacaagtttcacatttgaaagacttttcattcccttcttctgatcccttgaacgcaagactggtttcatagaccgacagttgacctttatcttcacgtgacctgaggtattttcaggtggctcaaataaaaagaaaccagttcccactgagtaatcttcgtcaaagacatggttgaacgtagtgttgatagtgatcttgaacagtttgagatagaaaatgaggaagattttgataaattgattcagaagccccaggatacgagcatcgtctccaagatcaccaattctgattttttcggcaataatctgggattactgctaatagtcataagcaaagttttcaattcagtcatgatagtgtgctgtaaactgctagagatggatccaacagtagaccgtccaattcatgctcttgaaatcttatccgtccgaatgtttttgacttatatatgctgttacgcctatatgcaccatttcaagacgccggactatccttttggccccaaggaatggcgactttacggggtaatgcgaggggtatttgggttttctggagtgtttggaatgtatttttctttacaatacctcacggttcccgatgctgtggtcattacatttttgattccctcagttgttggaatccttgcccgtatattcttgcacgaacgattcaccaagattgaagcatggggagccttggtctccttccttggagtattactaattgcaagacctccatttctgtttggagaacgatcgtctgatgaatctgatcataacgtcgaaactagtgatccagcaaagagaatactagcggttgctgcctccttgatgggggttgttggtgcatcaagtgttacaattgttataaaacatatcggtaagaacgttcatccgttaattttagtctcctatttttccctaattacatttatcatttctacagtgtccatcattttcacccctggtttagggtttcacgttccacagacattacatcaatggtttcttttcatactcattggtatttctggattcttcatgcaattccttctgactgagggtattcaaagagaaaggaaagccagtcgttcagcattaatgttctacacagagatcgtctttgctatctgttgggattaccttatatggaaacatgcgcccaacactttaagctggatcggtatctcgattattgttacatctgctttgacggtggtgctggtcaaggataaaggttccgaggtccctgtagtacaggaagaaccaatatttttagacgacatagacatacgtaactgattagatatgaacattattagattattattacttagtcactccattcttcttctggggcaacgtatggaggaggcttgaagaattcttggtcttggagtacgaactcacggaacttttctttatcatcacagtactcgtacaaatactctaattccaggtcatgtagttgccttcccagcatcacgagcgagtgcaatggctcaccgctgtcataagaggccaattctttcaacgtaccggccttgaatttctgggttggagctcccaatctggaaactgccacacaaggagtattctcagtgtatgcctgttctttcttggtttcctcaacttctattaactgttgtgcagcagttgcaatgttcatgtatcttggtggttcatagatcagttttcccttcatcatgttctcaaatgactgttcttttactttgatatccaaaaggatcagagtgtgtagacccaactttctgtttcccataatcttttcataaaatgagtctggtttccatgaatcagtgaagaagaccatagagatagtttgtccgaactggtatagttgcaaaccacaggcacctacagcattcataactgatgcattgtggatggcctcaaccttgatgcccaactccctagctctgatcaccagatcagtgtgtgtcgtggcaccaaacggatccccgaccaccagaaatgcaatgtcatctttgtcagctccctccaatatgtcgtcagatccagtttccactagttccctgtcagccaagatgacatccttaccgtagaactttgacaaactgtcttggtcagctgccatcaatatggaagtgtaagcttccaaatagactcttttgcatttcttgaccgtctgtagacctcttacggtgatatccgtctcatatgacaatccaaggccgattaaatacagcattttccctcggatatttcagagctgttaggagaactaaaagttttttttttgtaatgctcgaatttgcgtctaatcggctatccgatatcctcaaattaattgattaaaaagctggtggcttcactcttatccccccccctacaaactactccactaaaattctttcaaacaatgcctcgagtttacaaaaggccccgaagacggattgcttcgacgatactgaaatatttgactatttttgccacaatagcatctctatcagtgttctttatcggtgttccaagtaagatatttgcttcagaaaagcttgatcatctatttattttcaaaaccaaagatgtctccgttgcaggcattgatttgggatctggaaccgtcaacctcaccgtttcaggaacagtggtgaagaattacacttatagcaacccattcttggtaaaaacgtctcatttggttaaggaggtgaatgttcaaacatctgagatagaactgtttggagacgttgaaaggtctgttaccaagctaggaaaagcccaagtccagccctttgaactgaatgtcgaatacggcaaggaacaagatattcaatggatagtgaccgtgaagcccaaagtcaggaaaatgatatcaatcatagagaagttagttgatgatcccgatgcttcattgaggttacgaggagacacgttggtaaaacttagtctttttaatggttaccttccgttattcaggttcaaaatttatttggacgagactatctccattgattgacgatttactacatctactcccattaattattgaatgaactcttccctgttctctgttttttagttactctttaatattttttaaaactaatttgctcagtgtcattgatgtctcattttctgtttgacatatgctatcgatttattagtcactcgagtatccttcttatgctgctcgtagtggtgtctgagataggctagaaacttgttagaacttcttgaaccctgcatctgatctccgactttgattggaatgatatgcctcgttccctcaacacatgatgggttaggacatatggccccattggcgattacggtttttgtctccgaggacccttgagatttcttcttcttgccccgtttggcttcagtgaaagcataattaggtataatgaacatgggatcaggcattacacttccatctgcatatatgccgtgatttttgcccaaatgatgaacgtagcttgaatctttcattccgaagaaaagtaagttctgctcttcaacatctgagcaatcgaaaacacagtaggggcacatcccttgagttccatttttgttgttcttgggtgtcctatagacccgaggagagtatgtggtcaaatatccctggttttgagttgcatagtgaaattttgattccttcttcaagtgatgcaatgagatattgttgggaatcctgaggctagcaagtgagcactcctcttctggggaggccagggagtgctggttggaaaccacactgtttgactcttcgaactcctgttgttctttcaaaaaatctagttgttgactgatctctgtgcagaattcactgctgttcagtaaaacaacgctagtatgcctcatattttctgctgtgaaactggacgagaaatcatcgatattgtttccagttggaccaatctcatccatattgactggtttcgtctcagagacatgctcattaactcccaccccgtcatcccctctattttttagaaggtatgtggagatgaaattttgaggcgggagggataacaataggtcttctctcaatggtggggtagtttcgaacggattgactaatcctggattggcttccttgaaactacttcggttgtccaattgaaaacatataatgtgactgcccgcttttggacttgtgtcgaagctttcattcgaatctgctctttgggcctgttggggatcctggctaattatacgttggtgtgtcgtcacctcactttcagtagaggagcccataaaaatattggtttcaaagtcaggttgaaagctagttgcaagacaattgtcatttaacggatcttgctctgtacctggcatatcaaagttgaactctttgttcgaactgtacacgttctgcatctctactatcagatcggacgtgttgttgcgaatgacaagattggggtccacgtttatagctaaactggcggacaatgaggaatcctccctaaatgaatacatgacttgagtatggtttggtgatagacattgtagatcaagattttgtactttatttacgatgattaaagattctggggttccaaattctattgtaagttctgtagacgtgcatattcgtgcatacatcgatgaacgttgcatgaaggctagttgacttgatgattcgtttggttttgaaactgaacctggcaagggccgacagttctcccattctataatgaagtagatgtatgagtgttaaaacatattgagaggaagaatcagaaaaaacaataccgtaaaaataagagtgacacccaagtatagccaaacggtatgcctcgacaatcaagaatcactgacaaccataccgcatagaatggtcacaaggcaaagaaaccactagctcctctaggctttctactaccagaactcagctcgactacaatttgaggatactgaaaatggaaatttctaaataaaattatctgttggctccgttgttaccataagtgctcaattagctcttggactactataaaacttctatttgtcaatataaaaagctaactaacctggaggaagctgggaagcatctacaacatcacttacgtccttgactgtctcagattcggcagcctctagtggtgtccttggaacagccatcataccagttctagcaatctcgaggattccaaaaggttgaatcaattgaacaaaactggtaactctagatggtttagcactaagctcaacgatacagttacgatcactgatatcaacaatacgtcctccaaattgctgggccaacttggtaatgctgtccagatgttggtacttctgtctgagtctctcagaaggtagcaagttggttgggtgaaatttagactcagaagcagccaagtcgggagcagattcttcaagaccgttatgatgggctataagctgttggaagtattctggtcccagaagggaaactctggccaacaaaagctccctcttgatgatctctgcattggtgtaatccagaactgcgtacacaggaactaagtcctcaatttgtcttctagcctgctcaataacagcgtcttgtccattcaaaactattgtcattctggataaatccttgacgtcggtgttgcaaacaaccagagagtcaatgttgaatccacgagcagcaagagttccagaaaccaaggacaagacaccaggttcattttgaaccaagcagttaagaacgtgctcggtggaaggatctttggatggctctggtgtctcgtagataatactggacaccgcggcgttggctgaccaagtgggggtctccaacgtgggcaaagggggccttttcttgtttctatgcaaagttttgtaagcaagggcactagtagagcttgaagagtaccttgataggaccctaaacggcatcaaggccttaggcatcattaatcttccagcggacattaatggggggagtggaaataaaaatatttgaaggcccgcgagtcgaatttttttttatatgcttgactcattcgctaattggatgagtggaaactcatccaaggaaggaggggtgggatacaatcaactggtttatacaataaataggtgtttaattacttatctaaactaaaacttggcttcaaactcactagtcaatctcttagcaacagctttgataaactcctcagtgttcacataagaagatctgtcagtctcacctcttgcaagagcgagatctttggtcatgattccatccaatttaactgtgttgatagtggcattttccagaagttgaccaaactcaacaacaggaagagtgttgtccagtagtcctctttgaattaaacctctagtccaagcgaagatagaggcaatagagttggtggaggtctccttaccttgctggtgttgtctgtaatgtctagtgacggttccatgagcagcttcactctcaaaagcagttccatctggggtcgtcaaaacagaggtcatcaaacctaaagatccgaaaccttgggcaacaatgtcggattgcacgtcaccatcgtagttcttcatagcaatgatatagcctccctttgatttcaacatctgagcaaccatatcgtcaatgagacggtgctcataccaaataccggccttctcaaaagattctttgaattgtgtttcgtacgtttcgtcaaagatgtctttgaatctaccatcatatttcttcaggatggtattcttggtggtcgagaacaggttcactttcttttctagagcaagtttgaaggaggaaagagcaaagtctcggatagaatcatccaagttgtacatagtcagagcgacaccggcagatgggtagtcgaaaacctttgtctcgacagggtcagatccgtcctttggagtgaaaaccaacttcaactcaccagcttttggaatcagcaaatcggtggctctatattggtcaccgtaagcatgtcttccaatgataattggcttctcccactgaggaataattcttgggatgttgtcaatgacaattggctctctgaaaacggttccgcccaatatgtttctgattgtaccgttgggagacagccacattttcttcaaaccaaactcctcaactctggcttcatctggggtaatggtggcacacttgacaccgacaccatacttcttgatggcctcagcagcatctatagtgacttggtcgtcggtttgatctctatactcgattcccaagtcgtagtactttaggtcgatatccaaaaatggaagaatcaactcatctttgatgagtttccagatgattctcgtcatttcatcaccatccatctccactaatggagtcttcactgaaatttttgcatgagccatcttacaatatgatatacctaaaaaaaagaagaacaagtgaaaaaccgtaaccttccccatggggaaacctccactatttatatacatgtcccccggagcgagaaaaactggaggattatcttggatctcgcttccgacaatttttcggagttgaaattcctagatttagcgtagagggacggtggctcgggaattttctcacctgtcaaaaaggttttgcaccaattaattggcacattcaattgggtcagaaaaaaagttgcccaatcaagcttataccctgtaaaaattccgacaaagtccgcccatcgagtgccgttttctgatttgattcttagcggctgcttgtttgaggaggaatatttggatctgggatctggcggagtgcgaatgattctccgagcatggcaccgaaaatcttcaattcgaggtaggaacacaagcgctacccaaccccacctactaaccggcggcagtttgtaggactcgatgttaatagcacgtgatttggatcttcactaaatgaatgtttggtgggggtagaggagaaactaaatgaagggctaatgatttcagatatgccctcgcactagtaccagaagatcataaatccagagctggctaacccttttataatacgcaaagttaaggctaatagtagaacgaagccaactaagtcctcttagtttttgagaatcctccttttgctcgtaatagactgttttggcacagtagcttgccaaaatcaaaaacgttctctgtagtcccaagggattctgcaatgcttcatccaaaaacctagttaaatcgttggttttcaagatcagcagtacaattcttggaatatggctaagaagacccattaagtcatacaccagtccttcgctcaataatgcttggtgcatcctatcgatttcagagtcttccctttgcgtgtggacttttcctgatagcgcatgatctatatctcttccggtgatggcagctgcaaataaaggaaattgtttgtccgtaattccagcaacgcgtttggcataaactttcatctttgtggtatcattgtccagcattgcgagccagaaatgagcgtaatccctcttcatttgtagtggaatatctctgtacagtccgtgatcatagagaacaatttcaaagttgtgaccgttctttttgtgatccaaaggtctgatcgcaaggttacctccgtgaggatcacagtgcaatgaaacgtctggtgtaaaaatcatattgttgaaagtatgagagagacaactagacacctcactccgactgatgttgtgagagtctataaacttcaagtcatctaaacgccctccaggaacgtactctagtatcaaaactcttttgtgagcttcaatgacttttggaatcctgagcgcagtttgcttttgaaacttcttgaaatattcagctgtcttgatagcattttttgcctcattctggaaatctaactcgacataaatggaactttgcagctcatcactcaaccatgtcaacgaataatcaggaaaaacctttgccatgagatcaaaaacagtctttgtcaataggatgtctaatggaacaaactcctgtaaggaagggtgttgaaattttatggccactttttcttcggaatttcttagagtaccaatgtgcacttgtgccaaagatgctactcctataggctcttcatctatagagctgaacacttcatcaaatttctcacctgtatctttttcaaacattgccttaatatcggtcaaggaagactttggacattcatcttgtagtggaatcatcgtctcagtccattcctttggtagtaagtatgtcatagcactaacatgctgacctagtttgatataaattcccccgttggtccttaatgcatctaaagtgaccaaagctgcccttttgtgggtctcatccaactccttgtaatattcttccttggaatcaaagttctttgtcagcacagtggagtagtacttgaaacatttcatggtagcaagagttactacacctaccctttctccagttaacaccaagtgattgacaccgttcctgaatgaatcatttgcaaaatatagtcctcctgtgacaccaaccactacaaatcccactttgtggcctctaaatgagcgggattttgcctttggctgacttgagagtcttctaacccaagaaatgccattttttttcaagttttggctgatagtacgattaaacatgaaaaatccctgagaaaaatacgtctcttgcatcgaataaatagtaaccccagatatctcgaatgctttggggagatcaaccgttgaattcttcggagtaagggggaattggttttgcatcctgaaaggaaccgaaccggttacgtttagcagactagcatcactgatactctcaatatgaatcagattgaaagtcatctacatccgattgtgaaaagtctatcggtttaggaatcgtgtcgatataatgcaggagaaaaccttctacggcagttgatcgcctagaaacgcctaattaactccacaatcccttgatttttaccatctctatatgatgtgctcatcatctacgctggtatatacaagaatgtcattatcattaattttacgtcttctgaaaggtaacaatggaagattaatatgggtagttccaaataggggcagcaggctgttgtgattgctcctgaggcggttgctcgggtgtatttcccgttcgcatccttacaacgttcactccaagttgggagctttgctgctgcctctgttgcaactgctgctgctcatgttgctcttgagatctgggcgttaatgatctcggttggagctgttcattttgatgaccgtcctgcagttcttcctgtccggtgaaattctgcgtgaacggacgagtcagctgttcattctcgctcattctatttggcgatccaggaaaaatgggagaagaacgttgtacggagtcattaggtaaattagatgacgagccaagcatctgggaaactggagcaatcggctgttgctgctgcgtcttctgatgttgatgatgttgctgctgctgttgctgatgtggctgatgttgttgatgttgttgtggttgctgatgttgctgttgctgttgctgttgctgttgttgacgttgatgttgttgttgatgttgctgttgctgttcctgctgggctgggaatctatcacgagaaaacgatgagatatctgcataagtgaaatcaatttcattactgttttgaaataatgaattctccgccataggaaagcttgtactgaccggagtcaaatcatcaactgcatcatcaaagtcattcaagtccataaagaaattgtcattaagaaactcgatattcttttgaatattctcgctattttccatgctgaaaagtggaaagctttccataatctgtttagcttgagacgattgaggaccctctgtttctatactttgtctatagcccttgttattagattggtgactgaaactgccatttacacttgcaggttggctggaaggctgggacaccaatgtagggacaaactgtgtatcaatatttctgaacacgggacattgcacaggttcagcaacgttattggaactattgctattactgcctttcagcctcttgaacagattggttgccgaaggcgattgacttgagttcttgcggtcatgaatggattttctttcaatacctgaattcaaattgtcaaagttgatactaaacagtctgttggagttcaccaagacattatagaagaatctgatcagtttctttaatctccaggcgtaatagtagttcttggtgagttgatccaacttttccagaaagttcttcaagtattggaatagtctcatcaaaaggtcatccctagcaatcccattgtgattcagaagttggatagtaggttctgaatcctgttgcaatctcagaattatcgaaatcaaaaactgattcgatcggtggttgagaatcatcagaaatgggtataacatcaactctccgccatgattagggaaatacttcgcagagttatcaaaaaagtctccaaataacttgtaatcctcaattgcaagcaatagagtatcttcgaaatagcggttgaagtaaccttgatacgttgctattttttcttcaggacagctttgtagttccttttcgtagttaatgaacattatatagttgatcacaaataggaggattttagcagtcaagaaaagcctgaacttgaatattctaaccacaatgtcaagcttggaagagtttgaagagtcttcgtagaataccaagaacggctctgttttcatgtcccacggagtaggtatgcctgtatatctttcatctctcttaacaatgtcattcagtttgcctagaactagatcgacattctccttagaaggaactttgctatggttgatcagcagatccataccctgaaagatggtataattaacctcatattccagcttgtagttggagacaacttttagttctctttccagaagcgctgggtctgagaatgcttcagacaacaattcagattcaacttcgccaggaagtttgcaatcccatgatttattttgagtgcccatgacaggatccatatccaggttgatggccaacatttttgagtagtctccaagactgatattagtcaccacattcaaactaatcagagtgaaccaaagcttcctccataaatgccttttacggaataggtttatgtttgcttgtgagtcattggaacaagtcgattggaaatttctgtagaataatgggtctctgttgattccaattgtgttggctaaagtgactagggaacttaggaaattaatgctgttgaggtttaacgattcgctagtgatatccccagtggcatcgcttgcactggatgtattgtatgaatcgtccaaatcaaatccgtcttccggagaaaaaatattgtaacacttcaaaaagattccaacttgtagaatcacaattgatggcttcccaaacatcttagtgttggtgaaaatttccttgatgaggtcaactagaaccatggggactagattctccggttttgacatgatcttctcctcattagtaagaggtctatcgtactttcgggctaaattaataggcaatgataaccaacttaagcgtatcaataatatcaaaagacagacagtcatgaagtcctcattgtagttgcttcccagtgaactgagtctgattttatttgtagaaccatctttaggaccaataatgctagccacttttttgcggaatgaaacctcgtcaatgcagggaaattgaaggtaaaggaggtcaaaaaatcgatccacaagtagccaacatacttttctaggaggtatgtttttctctataatgttgatcgcctgcttggtattcgagtaatttagatgcttgacagatgtaatggtgaaggtctttagtttttttcttgctagatttgggcttcttgctgttcatatcacatccaagaacagggcacccagtatttccgccattccatttgtcgtcatcttgagatgtatctaactgcattggggtaagagttagaggcgattgatacacacttggggaaggcgtattagaaggactaatcttgctttcatcgctgctagattttttcatctgcacggatcctgggttatggttcattgctgtgtttgtcgaatccaacattggagagttataggccgacgcaaccagtgctctttttgccaagttagtgtcattcaacttggacaatttctctctaaagagagatcttgcatctccaatcatcaaggggcatactctgggttcgttcttgtcttcctctgaagacaagttggggaaaacggactcagaagttggaattacaggacattttccggtattaccactcaagaggttcacctccttcatattaacaacgtctttctccatgttacccgagacagggcattgtcccatctctccggtgacggggcacatggaagttggagcagcacccgatgaggaatcgttggatgagggagttgtggtttgacttatcgtcctatctgatgatagaacttcctttttaatttcagtttccttgaagtctgattggttcgattgatccatgtgctcaaagggacgtttagaggagttggaaaggccagaggtaaagtccacggcaagggtattgggttcctgaaaattagatccggatgataaggaatttttgagtggagtagacaaggatcccaaagatgccagtgacgcatcggccactgtatggttattgtaatagtactcataatgtcgtctcaagttgaaaatcttctgccacaaatcgttcagataggcatcagtcttggtaatgaagagccaggagaatatgttgattttgtagatcaaggggaacatgaacttttgttcgtgtctggtcgtgtataagatatccgagtttgctattagattcaccacttccctgtcatcggggagggatccatcagcatttcgatgtatctgggccccagtgtcgcctttttccatcagcagcttctccagatcctggactctttgacgaagttgtcggacctcctcgtctttttggattgagtcactttggttatgatctaaggtattactgggagtattgacaataatggacgcagggacgggttgagcactcgtcaactgctccggattgccacccattgaaagaagctcactgtttaccagtggtttggcccacgagggctctagataatagcataaatgaggaacaccatttttcttacagttagtgcaaatcggttttttcttatcacacttcacttttcgacgacgacaaatcgtacatgatactggaactctgtttctctttcgctttagtttgatccgctcggagggacaaaggttctcgtcttgtgaacccatgaagtattgatgtttttgctacggaaggtgtccaatagtctagattttagagataattttttttatcttttccatcagtgaatgtagtgcactgctccaaggggactgactttccaacaagaatgaggcggccaggttttttcagggatagttattaggtttgccgagacttaccgaataagaaaagtgagaaaaaaaggtaaaaaagaaacgaatcctgcaagcagttccggcgctccacccaaaaaggttattttgcgtgaattttctctgcgatccactattatgtaagatgtgaacccctaaattatcatatatgcaactccttggagacttcctggagtagaagatctatcaactcttcaaagctctttttcttaacgtcccgtattgtggagcgcatcctctcaaaacagactttgaagtcctgcgcagtccataagttgcggccatggaacgcagacagtgcgttccaatctaccatttctgctgaggtgtagcctaactccttgatcctgcttagtaaccagatgcggtccgcagcatcaatggttagggctctctccgtagcatctctttttagtagcttgttccatttgtaacggcactggatacgtgatctagtaccgtttattcgttcactgactaccgtccaattaataacattattcgaagactcatcgttcaagagttcatgcaccacctgacgcaacttttcttcttcttcttctgaccatttattaaccattctccgattgccacacttgatatagtttctccatcgatcacgacaatcttcaggcatacgacccatcttcataccgatcagcttccactgcccctcctgttccgtggccagtcttgctaactcttcttcttcctctggtgtccacttgcctcgagtttggaaaatatgataggtccttctcacatgcttatataatgaagagcgggaccgatgctccagtacacgatgcaaagaatcccagaaatcatcctttttacggtcattcgaccatattctatgacaaatgtcatctctcgtcatgttatggatcttacaatactccataataaatgcatctatagcctcgcattcttctttaccgaacagcttcccgtaagttttacctccagatatccagtttgaagcttttgcagcggcagcagcaaccagctcggcagcttcatcgtggcctccgttgggcttgagatccgcctcacccgcgttgtgacccaagtgattgccctgctgtctatcggaatcctttttattattatcatcgccaacgtctccaacggcggcggccattatctgtgcagcagcttgtgaggcctgagctgccaattgctgctggcttatctcaatgtcgtgatggcgtaaataatcctggtccagttgtgcgagggtcctagcatccatcaacacattctgtacgtactggtcgtgatcagttgctgcctcagaatccagctgagcaagttccgggtcaattttttggttggtgtggtggcttttattgccgttgctatctgtgtttgagtttctaagacggtgtccgttatcgtcttcagttcctgataaatgagaatttccgttaccattgtggatggaggacgtcttcttcttcttgttttgaggctggaaattgaagtcctcatccagaaagccggtccattgctgcaactcagtaatattagacatatcctcggtaaaatggcgtttctttgaatccaaattgcctccgacaaagcgcatgacggcagcttctactgcctcactagccagatcttgggtgaacttcttttctgtctcatctgtgtcttttgttttgttgcccaattgaagcagcgcctgagcgccacccagctcttgggtggcttgcggaggaacagcatctgctgggataagtttggagtcattttgttctatcgtcggactcgtttcattgtgctcactgagctgttgtgggggattatcttgagacatgctgtgatatatatatcaatggttaccctaattgacagggtaatgtttgttctccctcaaaaagaaaaagttaaggattgttgagtacacgacagttgctagtggggaaccgttactggaaggggcaggtcctggaatgttgcaaggagggaagatactctccaggttgacgaggagtgtcgttcagagaaacggaaatccaagggaaattagctgatcaagctggttggttttataattagtgtccactgaatcaagaaagtgggcaaaaggcaatcatatgctaacttgaacgttattcttcaactaatcactcctagcaaatcctgcctctgatttacaaacatttaatacacagttatattatttttcctgctacagattctacctagaacttggagaacttcttgttaccaccgacagcaggagtaaccttcagaacgttgaatctaacagtcttggagagaggtctgcactgaccaacagtgaccaagtcaccttcgttgacacggaaagctggggaaacatgagcagcaacgttcttgtgacgcttctcgtatctgttgtattttggaacgtagtgcaagtagtctcttctgatgatgatggttctgtgcatcttggtagaaataacagttccggtcagaatcttaccacggatggaaacggtaccagtgaatggacacttcttgtcaatgtaagaaccctcgatggcggactttggggtcttgaatcccagtccgacgtccttgtgccatctcttagtacgcttgttggccttggcctttgggttggtgaagatgtgaggttgcttggatgggttagtatcaccttgttcatttgtgcgtttacttcttcttaagtttggacaaacttaccttctggaaagccttctcagactgaacaatcaattcggtagccatcttgtgattatgttctagttgtgatgtgaataaaattattcaaggtgaaggatagcgagggttgggaaagtcgtgtattgttgccgaaaaaaaaaagttggaaaaatagtcacattttttggtgggaattatacgagcgaaaagccttttggtcacgagacagaaggttagccctcagtacgatcatgtgatgaatatacttccatcagacatttgagacgtgtccgtccacaatacggttggaaataccagctctgactcgtaatacagtcttaatatacctgcctattggtacttatcacttatgtactttttaatgatttgatggagcattaaccttggaaatctgtaactttttaccagcccattgtgtcaagctactcaataacttgttggcatcgtggagttcttgcatttcagagcatccccctcgggagattccattcactagcaaattagggacagtggatctacctgtgatctcgccaatgtactgttgcaattcaggtccatgtgtgtgaagatctagctccacgatggtgggagcaggtgtaatctcataattgttttgtaacatggccttgagcttcttggagaatggacatcctctcttactaaatataaccattggtgacatggaaataatctctgcaaactccttggcagggtcaaacggctcagtttctttggttaaaccatcactcttggcaacttgttttgggttactactggattcttcagcatctttgactttgctctcatcaatttcacccttctcgttaacaactctgtcattctggttaaccatgtggtctatatcgctcttgtctgccggtaccttaggtgtaatgggcgggatcttctctggtgtttcaacctgtatttttaccttgccagatgtagtctggtctacgatctgaacgttactaacatcggagtgagaaatggtaatcagcaaaaatatcgtcagtaccagtgctgctaagcctaatattctagttctcttgtccagtttagccatttgtggtgtaacttgctagtgtgtaaatgacttccgtttgatgtacatgggtaggagagcgcgttttgcgaagtagcatgcttcataattatgtcagcaggtatttttagataaataaggttctattataatattctacaaaaagcgtgtcagatggtatgagtttactggatgaaagcattgaaagtgctgggtaagatccttatttaatattttaattcttttttgtctgtctagctaggggtagtcaatgatctctaggaagttgagccaagtaatcgtagtttagactattttcgagtatgataatcccacatcaatatattaattacactttatccgactcatctggacccttaaacttaactagaacccctcatattttaatcacaacattgagcagcaaatttgcaccggattacattcctagtcactgctttgtgaataccgtccccatcttacactcctctctgctggccaaggcttcttactatataagctccacctaaaatagaatacacccgaacaccgctgtttcccctggatattacataaacatcgtttttgtttagatgatagtcgatctagcatctgaatgagacacaatggactataggtatgaactagacatatcttggttaaaacagtcatctcccgagcaggcaaaacacaatgactatataagcgacacaccccctgctttgccagagaaaccaccccgtcattttctggaagcgatcagaaaagaatcaatatctaatgacctcctactccatgatttggagtctgcaagttacaagaacccattgaaaggaccaagggttttgcctcaagaatcttatcatattccaacccaacctctgaaggttcctagtcaaaagaagcttcctaacccattgtcgatctctccaaatgcaatgaaccccatacaacaacctctccagtcccttaactccccacagcacctctattctcctcccaaactgccaactttacctcaattaccattgaagatgcttaaaagtgactctcctcctcacgtttctgatatgtatactaagccattaccaaagaccccaatggagagggacccctccagtgtaagggtccttccaccagagccactttcttctgagagacgcaaaagcttgtctcccctgagagtcgaaacatctgattcatttggggtgtttgggagaaaatcctcgccattaaagtccacgcctacggaaagcccttcaaaaaggagttggccctcaccaactaaaatataccaaaaattaactccagagagatctttcaggaacagagatagttattcatccgatgaagatgaaagtataccgaatgatcagtttaccttttctgatgatatcgagatatatcctgaagagacgaacctggatgataccttggatgagataacttaccttcttgaagagaacaggcttaatcccagccaaaccttgcctgagctaccattcacacccaatagccttctcccttctgattttgatgctttagaatactcaaatttattgagcagtatatgggattggtgtatacggctttttgaaaagaacttaagaaaactgccaaactataatgatctcttgaaatgtttataccttttgttaaactattggtttcctacgctttcacattattacttggaagaacaggctggcttgatactacaagaactgattcaacaaggcgcaatatctctctcagaggataaccttcaaatagtacccaattatgatgcttacgtcaacggagtaatgctaggattagtttgctgttatggtcagcactatgataacggagactattctcaatgctaccgaccgtcttgtgcatatggtaaaaatacattcaatattcagctttccaaaccaccattagataaggttgattcttcgttaccggttcaagaaagaataatacagtacacaagtggaagttgggatgatttctggggagtttcacttgaacaagtgaaagggttgcctcctaaaacttacgaattacaggcaactatttttgagttgatcctttctgaattgagaacagccagaaatgcgaaagtattgacagatgtttattcctccaagttcttgaaagaacacccttccattattaaaaagggtgaaaggatctatgaagggctatttcagccattgcaagtatggaatgatgtacatcggcagtatttggttgattcattgcttgaaactatcaagtcacagggaaaattcatctccaaattcgcctcgatatatatacaatgggcaaccagagctgaagcagtgtcgattgcttatgtgtcaaagtcgtttctttctctcaagattcttgaagctgaaaagaaacgcccaggatccaagctcataaagtggtttgaggatatatctcgcagtgtccaaagctctcttattgacgattactccatgataatacgagcacccatctttcgtcccattaagttacaaccaactatcgaaagaatattgaaattgacaaatgataatgacccagagaaggctgagttggccaaggccttgaatatgagccgcactttaatgaaaaatgttgaaaatgcagtcaacgttttagattcacagcatagtataggcattttgaaaagggaattggacagtaaacacagtatcgattatttaaatcttgaccgaaaagggcgatatgttgccgaaagtggagatgttaaacgcaagagtatcattgacaaatcaagttatcatttaattcttttagacaactacctactaattacagagagaattcacgatgatcctgtaaaaaagttcaaaattgtcgaatctccaattcccgtcgagtacttgcttttcagggctaaggataaagagaccagctccaattcagggcaaccaaatgctgcattggatgaagctgatcagttttcgtttaaaatcaagcaactaggttctgatacgtctcacactttttatacacagacccgagaggatagaaacaaatggctgttttcgattagtacggtgaagcaacgtctttcagaaaaagtcaaaaggtatgagccgttttcattgagtgttgtctccgatcgagagtttacatactctcaaagtgacactgttaacaaaatcaatcctcttcctaaagatggcgcattagatgttgcaattagatctgttgaggatttcgacgatacctctactaagatccaaagcaacgtattatcggcttgtagttttaggtacaacaaccaggattatgttttcttgggtctgtcacttgccggttacgtaagtttgaaaggccagccaaactctgcaaagcgattgttagaactttcaaacatcaagcagtgtgcagtactggaagaatatgacttactgattgtcctttcagataaaaagttgctgtactttaacttaactgatgtcatgaaagtttattttggaacttcccattctgtggagggagatagattttcaagacaaagtgtttcattttttgctgttgcaagaaattatgaaaacaccacgatgatcttttttatgaaaccaaaggcaagagtttcgaattttaagattctagttccaataagagatagcgtttcaaaaaaatttgacttcttccttgagcataagaagttttgcgtcgattgcgatacttacaagatgaccctattcaaaaactcatttgtcgtacacacttccaaaggatttgaattgatgtcattgtctgtgctaaagcctcatccgatccctgctcttcactattcggatctttttgtcgacggccacacatctggtaactacagcagcgttaaaaaaagattgaattccaacaatctgaaaccagtggggattttccgactttatagtagtggaaagtttctgttggtgtactcacaatttgctgtatttgtgaaccgagaatctgaaatcgttggtgaatgcattgaatttcaattcaagtgtaagagcgccgctcttgatcatgactacctaattgtaactaacgaccaagttattgaagtctggatgattgggaacgatgatgcgaaaattgttcaattttttacaggagagaatgttgtattacttgatgatacacctggcgaagctttggtttcgatgacccacccaaaacaccccgagcggcaactggtactgagtttttgtttgaagaatcagttcaagagagttgttcaatactaatttgattcatgagattgttacagctaccaattttctgtcatttctagcaggttatggttgaatggctcgtagcatcttcgaaactcaggaaagctgatcatcttttgattacaaattgagcataccttaaatccttctcggaagtaggtcatagtacaagaataatgcataaaatgtccgcaattcaaaatgaaaactgactcaagttccaagatatcttcttgacaaacatagcaaatctccctgctctcaaaatacacatatttctcttttgattgtgtgaatagttgaaacttttgacgtgttactttgtgaaacagtttgctggctccctcaattttaatcatagttgccttaaatacatggttttgctctcctacagagctgatccatcttgcttcagtaagagtagagcttggtgaaatgtacaccgtcttcaaattaggatacgatccaattttaacaatcggaagatcttctccaaagagaatcaatttacgcaattgaaatgcgtccactgcaatcgactcgactgcggaatagcttagatccagtttcagcaagtttggaaaataccctgcaatcactttcaagtttgatgttttagataagtttatcatttccagtgacggtgcatgaattccgaagtcctccaaagatgatgaactcagatccaatcttttgatgttctccatttgtcctttcaagcttatcaagttgtgacatccttttaggctcaactgaaccaatgacttcgaagtgtactccacacatgctaaaggggtttcgttgatcgacaaagatttcaagacatgggaataaccattcaagttgaaatccatgtcttctgtgaatgtgactttcattcttgtgggagctgcatgactgatcatagattgaaaagttgaacaattgtccaagttaagttccttcaagactctcaaatcccctaccaagtcaaccaacggagttccctgaagactgagcttttctaattgaggagcaacgatgttgattgaagagacaggcacataattaagactcatacttttcagatgagtgaagttaccttttagtacgtcaacatgtcgaaacggcccttcatttggcaatctccttccatcaaccaagaaataggacataactaaattagtgcagccgtcagcgttgatgttctgaatccgagcctcagaaattaccaaacgccttagatctttactaccttctaagtcgacagcctggaggcaaggaaatgacccataaaacgtctcaagtccccgaattttgctcaaggttagagattcaagacaaggagcttgcatggagagacgctgatgcgaatttgcgtagagatcacaaacattcatactcggaaagataccgtgaacattatgcacgtttgagaaatggattattatgtttttcatcttaggagcaataagatcaaaagttttcgttgaacaatgggccagtttcagactctttaagttttcaaattttccctttattagctctatgtttccaaatgaaatgtccaaactttttaaattgggacagtctatctcaaaacttttcatatctgggaactgataaagcctcagcacagtcaaagacaagaactgcagatgatctgccgatacaggtttgaacaaacggccaggagtataggaatagtactccagaaaaggaatacaaattggtagatgctcttccagacattgtgtgaggagaatggatgaaacattggatccaatgtaaatgattttagtcctgtgttttataaagcttggaattgactcccttgaatcataaagaaagagaaagctttggtcgatatcagggaagcttttcacacttctcatagaaatcaatcttgaataagtggtatccgttaccatgtttagaaaggactcatttagttgggatttcgatagcaggaactggtatttcacatcgttagacgaactctctggcttcaaaggatggtgacgtaccctgccagttaaatccttcagttctttccctaaaggactaaagaacaagcaattctgcttgattttttgaggcaaagaaagcagaaacataagagactctattggggcgtcatgttcatagaatagcttgaggtgatatgaaatgactagaatcaatctttggtctacgctagtatcgaaatccattgtagtgagatatgacggaaaacgcaaatatcacaattgacctccaatcaaagcaagcaagattatccattaatatgtatatacaattaagtttcctaatttagttcggcagtgacatgtagtgttcttttggtcttaaactagttctgctaccctaaatggaattgtatggtacttttggtgttacataagcaccgtctagcatgtggtcgtgccccaaaaccaaatgttgctgagagaacgagcaggaatgaatgaaagcttgactagaaacaaagactcattgtctgttattatagtgcaatgaatcaaccaccaaatcagcctcaggacaatgactcccaagtttctagctcgggaatgcagggtggcaatagtatgaattactcttcgtccgctcccgtaaacggtgctggtcagggaccacaaccgcaacagaattctcaaggtcagaatggaaagaagccagtaggaatgcaacaagcccaaatccaattgctagctcgtcggtatcagctggagatgcaaaaggcacatcaactaggccctcaaacccctcaaggtgcggagcatcttcaaacagccactaagatcaagcatgttttgctcagttatcaacaacaacggcaaagacaacagggtcaagttcaaggacagggtctaagtcaaccacagggtcaaaatcaggcacaagggcgtgttcaacaacaaacgcaaggtctatcaccggacccaggatctcatcaaggatctccccagtttcaacaacctcatcaggtaatgatgggatcagctcagacagcaggaacctcaattgcaaacccccaggctcagtctaacatatcgtcacaagtttctcaaatggctgctgctaaagtgaattctgcgtcccctcctatccctcccaaaactgtaggaactcccacaggaactccagtcggaacgcaaccaagaggtcaagtgaccatccagcagtttcaacaagttaaatctattttagaggaatttgaaaagaagttacgtaccattgaggccgccaaaagagatcaaaatctccccgaggagacactgcaaaaactgttgagacaggaggcaatcctgaaacaaagatatgctcaaactaaagctactgcctaccagatgtcccaacatttgcaacgtcaacaacaggctttaagggctgcttctgccgaatctgcagaagtttatgtcaccggttctgcttcatcacccaatatgaatgtttacaatcaacagattcttacacagcaacctcagcagcaactacagcagcaacaactgcaccaacctcaaccgcagcaaccgcaaccggcaaggcaatcaccacatcttctaatacaccagcaacagcagcagcaacagcaacaacaacaacaacagcagcagcagcaacaacaccctgtgacacaccgcccttcaaatgtttctcaaacaatgccacaaccttctcagcccttgcaatcttctactccttcgtccgccgttgggagaaaccaatctccaggagccacgcctgtgacatcagttaatgccgctgctaagcctagtccaggcacatcctcaacgagcacccttattaaccagcatattttaaagccagctccacctcccacagagatcccagctaggttacaggttaaacctcctcagcctgccgctatgaagattcccaacagaccaacgcttcttggaggatcagctattagtcaaccttcactgacaactccagtgagtattaggccacctccattggaaatggagggcgaccatgttctccaaaaaagaaaactgaaggagctactaaggaatgttggtgctgacgaaggtgatggagaaactgtcattgatggagatgttgaagaattgctactagatctcgctgatgagtttgttaccagcgttacttcatttgcctgtagactggctaaacatcgcaaggtggataatattgacatgagagatgtacagttacatttagaacgaaactggaacattcgcgttcctggatatgcatcagatgagataagaagcgtcaggaagttccaaccaacagctggctacaatcaaaaggtccaaggtgttgctatttccaagagtgtaaataagaactgaagtgtacttatgtaatgatatcaagattgagttttcgcgtttacagataattccttagtaggcctggcctgcatagatcttttcacgtaggcccgaaaagcatattcgtcaatgctcggtgttccagaaccactggtgagttcaagtcggtccagtattgatcttgtcatatattggactcaattgacactgatacatcctgcgctgacctgggtgttctggctgcttggattaccagcatgtttctgtttgacagtagatataatatggctgattatatgggctagtggaagaaagaaggtcaagagggataagatcaaagtgctaataaccggtggctcgcaaggtttaggaatggaagtagtcaaaaaattagtcccagtatccgataaggtgtacatcttagacgtcgaaaagcccaagtttcaccatgaaaaattggaataccataaatgtaacatagcagatactcatgagttgagcataagttttgataagataatacgagacgcaggccagttggatatactgataaataatgctgcaataagaggttcaggtgcttttatgaattccagtcaagaacatttcctgcatggatttaatgtcaactttttgtcacatgttggattgatgagaaagatgatcaaaatgcacagcagtaactatatgaatccaaatataccacggaaaaaccttcatatcataactataagttctatactgggattggtgggtcctaggaatttatccatgtattctgccaccaagagtgcacttctagcctttattgaaagtttatcacatgaagttcgctcacaagacgtcagttttgcaacattcttacctggacaattagatacagccatgttttcggatgtttctgttacacataactttctggctccagtggtagaggctgaaaagcttgctactagaatagtagatgcctgtttatacactcgagaaggcacattcatgtggcctatgtatacatgggccattcccattctacgtatactgccttttactattgtcgaatgggcgagacagttcagtggcatggacaatcagataatacaataatttcatttctctttctcttgtaatagtctagtaaagatctcaaccaactgatcaatatgaataaacccatcctcgtcaaatatgcctgtgaacggaatatcctgcttcccaagtaatctattattttcaatcacagtgactttgtagattggcgtggtattattttcaacccgggcctcaattgaaatcttcttttggttattcttgttgattccaacgtatttaatgtctttctccctatattttccgtgtagccacaacaatccattcaaagcgaaatatcccacaaccagtgcaaccattgagtagtagtaggtcaagttggagaaatcgttgttatattttttctccaaataatagagtgatccagccaaaattgtggcaacgtaaccgatagccagtttcgtatcaatcagtgaaaaactctgttcgtatcccagtttggatagcgccaatggtagagcatcatcagtggcatttctgagttcggcaaccgagtacaggttgacaggtttagtaattcctgacatttttaaactctgtccgtgactgatgatgtgttgagaagaagcaggttagaggatcaagaagcgtgagttaggaaatcacatattcagatgatcacgtgacaaaaaatgacagtttcatcattcatccagtaagtgtgtatataacgttcagcgctggtgatgaagggttagaagacatgaggagaacgaggttcagtagaactaccatctagtgtagctctttttgctgcttttttagctcttctgtccattaactgtgtactgcgctgtaagcccgataatgctcaagtcttgggcaaatcgtatgtaatttacacctaaacgtctcaaacagctctagaagtcattttctggtcaagtaccacaaaaccaagagtcctcgtcttctcttgtttggactgcttactattcttaaccttctgaactttgaccatcctaatctgtacagttcccgataacaaagtgcaccaaccaatatggacgcatgtgtctcctttctccatctctactctgcgtactggataaatcaggggaccgtccaaaccatcaggatgtccaggaaaggtcggtcaaaacactctaaggtatcagctgatgatcttttattagatgatcatgttggaaagtttcccagcaacaggaagaacttggttaatataagccatttagtcgagtacacactacctaatgattattccagcaataacagaccacttaacaaacgactacctaggccaaggagaagatccgattcggttcatctaagcaatatggaatatatcaatgtgaatttcaaatttatagtgaattctacgggagatttcagagctcaagttttagatcctaatgttcctttgaagcaaagagatattttacgagtcatcatctccaaaaacgatgctcaatgtcctatttgcttgaatgaagaaccaattgctccgaggatgatcaaatgtggacatgttctttgtttttcatgtttgttgaggttcctagagctggactcgaccaagcagtgcccactatgtgcttcaattatcaaagaaaacgaagtcctacccgtgttgattagtcaggtagataacagatttgatgccccccgagctaatgaattcttatctcttcatttgatgcatcgtccaagtaatgacatcttggccttgccttatcagtttgaactgtctgaagaaggtggcgttaatgggcaccgaccggagaacttcccatggtatagcgaggctcatcagcaattctaccaatatgcaaggatattaaaggcggacccacttttttctatccaatgttatgagaaggaaattgagtttattcatactaactatgaggaggacaaattactttacaatgaaaatgacatttactgtcaaaaggccatagataaaatacggtctcttataaacgacgaaagaaaatctatggaatcaagccccgacgatatctccaattcttatgacagttctttctcaaagctgatcaacgatactgaaaatcttcaactgcaggatttgatggtgaaacaatatgaaaaacaggatcaaagtggatatttcttttaccaaacatcattcaactctaaaataaagttctttttgtcgcctttggacatttctgtgataaaagcaatatatggtgacaatttttctctttttccgttagtgttgagcctaaagttgcaggacattacctatgagacagttttgcccgactttctgaaaaagcacaagtacttatcccatcttcccataggttctgaaataggttttcttgatgttgagtggtttgaggaaaaggggaagacctttcgatctatattaccaacacaggtttttcaaagattcaagaaacagctactggaaagggcaaaacgtacatcccagagaaataaaagggaagagaagaacagagtgaaatttgagaaagaactagaacaaaaaactttagaattctatgcttcagagaataatagatcacttggggattatgggctcgcatccatcgcaaccagagagactcctacattagattcctcattgatcgaaaagagtgataccaatatagatcttgaaaacgctgttacaactgtctggggtacgaagattattcagcgaagtgacaacatagaagaacccgaagaagattggcatatggaacccttacttcaacaagccagagagaaagaattgcagaagcaccttaagaaaagaagcaaaaagaagaggaatcaataaagaaagcacaactcgtattaaaccattacataaaaaccagaccaaagcgtctactctattcaatacatatcaaagtgtctatttatctaaaaatgaatctagcttcttttgaagcaaatcaagcttttcgtccttagctaagtttgcttccactaatcttgagatttgggactccaaatcaacgactaaagaacccagtttctctacagtctctttcaaagtgagtgtctttttcggggatccttgagcttcagtcaatggctttactggctcctcttggggaaccttgtctggcttttcttgagttttaacctccttctttggttcctcttttggttcttccttgacctttggtatgtcctttggttcttgcttaacctttggttctttttttggttccacttttggttcctccacaacctttgactccttcttgacttcaggttctatcttaagttgttcactagcttccgctgaacgttttggagcctcatcccaatctccatcttcttcttgtttttcaggctcatcgtcactcaagttgttaaccttgtcaagcaacgtgttaacctctttcttagccaaaagttcatcaacacctttttcttgagtcttagaaaaagctggagctggagaagtctcttgtttgacgctaacagatttgctttcaactttggttggctttttcacctcctctgaagtttcttcttgatgctcaactctttccctcttgatatcctcaggagattgtgtagattcgtgataattgagctctgaaccttcatacacatctctgagggaaatcaaaatggggccctttgcttcctttccgctccaccattcgtctgccgaaagagcaggtttatcacccgggcagtcagagtaaatatcgtcttgaaaagtttcagatcttcttggaacaataaacgagattggttcaatatagttgtcgttaacactcttgaaggcacgaagaatttcattatcatgaatgctgcatgtcctctttggagcaacagcaaaaccacgctgaggttctaccgaatgaaattcagacaactggaatagttcatcatcgctaaattcatagtaacgaatatttccgtctcctttaccagcaagatacaaaatcttgttctcagcatcaaaaaagggcatcaagataccagcagataagtcaatggtataaaatcccccaattggaccggatgcaatatcttcagtgttccaaactccaatttgacggtctgaaagcttggaaaaccctgttgtggcaatcctgtcagagtttcccaaccaaacaacacgagacgctttggccccagtatgtcctggtccctcactaattattttagctgagcggatatcccaaacgcgaagcttcttatcacgggatgttgtagctaccagagtaccattccagttgacagcaaaagatgtaactaaatccttgtgctgtaaagtctgtaggttttcaccagttttcacattccatattttgacagaatagtctaatgaagaagacaaaagaatgtcttccgcaattgggtggaattggacgtgcccaactttcctggtgtgaccagataacttcttgataggagttatatctttaggatctccattctcatcaacgtagttgaaaaaagaatagtcttcaggaacttcccagacagaaatcttaccatcatccgacgaggacaccaattgtaaatcattaaaaggattccaatccgtgtctagaactgccgccgtatggccacgaaagagaggaacttgatcaggagcctttcccacctcgttcaatggaatgaccgcaaacgcacctcctccggaagcatcccaattaacagaaagatattttccgttggtcttgatcaggttggaatcccaagcgttcttggtgactttgatgttttcataacaaagctctttcttggcaggttgaccaaagacatgacgatatttagaagcacgaacgaaccttccactgaaatgaagttagtaaacaaataagtcggaaaatatcagctatacatacctcattttcttgtaattagtagatgatttggctgaatacgatggaagcgtgtaatttgaggctggagagatgagttatcgggtgtgacatttttcgcgcaaaaccagatcagccaagaaagatctcacataacgcaatggaaaatcacttagtagtttgaggaaagagatatattgagtgtgcaaactgaaatcgggttgtggaaatgtctggactggatgaagtctcgcatactgttttgtcctttgtatcctggcactatttttctagatatttcagagattcttgttcgttctcttcttttctagataactttgactgagactattagcttaaaagatggaagcagagataaatagacacttcttctcaattctagtagtgctgatgagaaaactactcttttccttattgctgacacggaagtcacttatctccagcatgtcaccaaactggaaacagattgccctgataagggtttcctgatatttacaagaaagaatttcatatttgggttatctgattgaatccaaggataaaggcagtgaattctttgtcaaagtgggtgtcgagcggtagcaactggcaccccgaagacgcattcaactcaaaccccactatcaaggtaaacactttcttggcactagtcagtctaacgaacacacatcaattgcattctttggtgataatcgcttactgaacttccctcaatcctctataccctaagaatctgaggtcaagcgcctacaaaatgctaaaccctaaaaattattcaagtgactaatacactaccaaaattattctcctatcgatcgcttcatcacctaaagaacgcgctctctctcagaccttctgtagatcgatatcctccagtgatttgactcgccgtaaataaagtagtcctatttgcatgcttaaactcgacaaataaatggatgaagacagctggagtgaactggtcaggtcgatagacttgtcacataaggaagtttctaacgatcaactccaagagaaggtcctagcctcaactttccagtatctgaccgctcaaagccctgagcggatcaagcatttattctgtgatgaaaaaaactatcctatagctatacattcactgatactgttttcatttgatacaactcctgttctagaatggtatactcctaaaattgactactgcctcaatacttgccagcgatgcatctccatgttccataagggacgcgcaaagttaagacaggatttcattgtcaccagaggtttagaccctcaaagtgtctctagatttatggacattatattaaactgggaattaaacagaatattaattaagttcaggaatgcaatcacttcaagcaatggaggaagagttcaggttactacagagctttctttatcagtagttgaatgcctgtacggttgtgcaatgttaaggttgagcccagaactgcgaacgctattttccaccatattttcagacctcgttgagacacaagaatctattgtaccttcaaactctccagcatttccaggtgtaatattctttctgtttgaaggcacggacttcgaaagaaactgggccttatctgtgttaaaatcattcgactccagaaagctttttattgaatgggatttactgcaactggaggaatatgaggttcatttttacagaattcaagacccaagtttctataatagcttaaattgtgcaaatttttggtgcaatatccttccattgatagaatacacaactgttgacaatttagaactcaaattgttacttcctgcatcttacaagcccatgttgaaagaagttcgttttcaaatcgtttcacttgataaagtcctcatcaaccacgtcatgtcgtatttagactatcctttaccatttgtgctcagagcgttgaatatttttcttcagaagttttctttcaaattttggagtgttgtagctcctcatacatttttcaacttcatggatgccattttggggagtcctcattttctaaaactcctgaaagaattggagaccaagaattgcttcttatccatcgataaattgtcaagcaaaacaccctctttcaatgatttaattgaatggattcctgcaatgtttaaatcccttcaaggcccttcgcaacagcaaatgattattaaagcttctgtttttatatggggacaaagagacatcaatatttcttacgttattgagctgacactccccctcgtattggattgtctgctgattcaaacacccatatatgactctacgttcaacattgatgttttaacacaatcagagactagagtatttctagataataatttccatgttgttctggactcaacaattgccaccgaatctcctaagcttatggacatgtgctgtgaattagtaagggagcttattttatttgactctaagcaatatgcgagcagcagttataacctgaaccttcgaaagcctgtgaaattggtgaattttttgccaaaattttggtcctacttatcaatcaagatacccccaagtaatttacagtttacatctacagttttggaatctctcaagtttatatgtggtgtttttgttgtaggcatagggaaacaaacacctccgcctccaggaaaacaggatgaaagagataacctcttgtccataatctccaagcataataagaacacagagttattttttacccaagcttctcaactgttgtcaacgcttgtaacttttgatccgtcggtgctgagaactgctttgaatggtaaacaagcatccattggttattggtcatgcatcctctcaagtaaccaagaactatatcagagtgcagcaaatgttctttatgaagcgttcgatgtggaaggtagacttgaaggtactagagccttgctggaattaaatcttcaaatttgtttgcagtcggtcgtcgagaaccttaatacactgttgcttttaaaagtatatgaactttgtccaagaacactccgagtgctcatggatttgcttcattcattatgcgatccagttactggagtttttattgaaaacaactcctatgattccaaaacaagggagagtattttaagcttttggaatgtttcttgggatttcctttgtttgatctacgatagaactacttactgggcctccatttactccgtttctgttcttatcgactttgccagagatacattggacacatcccatttgttacttgacgggtttaggagtttcatgaacgtagtttcagacaaacctgaaatcaagaactttttgttcgataagattatgttgactttccataaagttctcacatggttaagacttggtgacgaatcacttttgaccagctgtctgtctttggtgatgaaaacgttgaatttagctactgaacttgaattgccgtttgataacgatatcattgagcttcttgccaaatatggagcaagggctaaaaagttcaacaataaattgagtgaaacacagcaatttgaaattctagaaagagccagagacttcaacagtgaccttgtgaattccattgtggcagaggcagaggaatatagaaattccaaattcaacttaggttcggtagagtcaccaatttccattccagatgaaaagccagtcaagaagcttcaaagtgatctctccaaatatattaagtatgtaaaagagcaggatgttcccgctatcatgcctggatctagaattaaagagattgctagattgtctgctaaggaaaaggctgaaagagatatacgaatcaaaaggatgggtaaaccagaaaaagctcctgctgcacccagacctcctggttttaactcgtcaaaaaagaagagggccgaagattctagtgacgatgaagatgaagaggatcaaaatgacaacgcactggatactctttttcatccaaatgtcgaagaattgaagagcaagacagccagaaatttacgtgaaaaaggcaagatgaaagctcaattgctttccatggatagaccaaaggtgaatgcagctgaaatggaaaggaagaaggcagaatatagaatgagaatgcggttgaacgttgacatgaacccattgtatgctaaagttttgcaatggtctttcaaacgagactccagaactccggataatgccgatcttacaacgtacaaagcaatttctgactcatacgactcagttgaacagtatcagaacacatttgagcctttgcttttacttgaatgttggcagggtattcagcaagccaaggaaacgggacaggatcaaccatttaatctagtagtgggcagtaaaactactactggaaactttttcgacgtatatgcttcagttaagaagagcgttttgcaagacaggaagatcggtgataacgatttggttgtgcttgcttatgttcctgacgggttgaaaaatatgcagggacttgatgaatctgtacctcggactgttgtaaaaacttcagagcactcctgccttgggaaggtacgagaaatcaagtactctaattcagagttttgtgatgttacaatcagagtgcataataggaacaatattagtcctttcttaacttcgagatcagaattgactggcctcaaaattttgcaaatggtaacaattgaaagagaatactcctcgttgaaaggattgccattctacgatctctctgacaagattgttaaagccaaatctgctgagccatttaatattgatgacacaacgttgcaagaaacgatggttaagtttagggtcaataaatctcaagcccaagccattgctggtgcctcaacatcgtcaggcttctcgctcattcagggtcctccgggtacgggtaagactaagaccatccttgggatagtaggcaaagttttaaccactcgcaacaaccttcatagtaccccaatttcaattccaggagcggtgacttctggacctagaaagcctgaaaccggagtaaggaaggtcttggtatgtgccccttcgaatgccgcagttgatgaactggtcattagattgcgggagggtgttccgggaatttcaggacaaatgttcaaacctaaggtggttagattaggtaggtctgatgctataaactcggcggtcaaagatttaactctggaagagcttgtagacgctgagctcaatgaaacggctcgtgctccaaaggctgatcaatccattagagagaaacacaacaaagttctagcggagagaaattccattcgagaggctctaaaagaggtttctaatttgaaaccagaggaagtcaaagatttacaaaaaagatacagtgaaattaccaaagccaagaatgaactgggaaagaaactggatgagcaaagagaggaagtttctgtgtcttatagaaatcgggaaattcagagaagagcggttcaatttcgaattctatctcaggcacagattatttgttccactttatccgggtctgcgcacgattttctggcaacaatggacacttcttttgatactgtggtcattgatgaagcatgtcagtgtattgagctttcggctattattcctctgcgatacggctgtaaacgttgtattatggttggtgacccaaaccagttgcctcctactgtcttgtctcaggctgctgcggagtataagtacgagcaatcactttttgtcagaatgatgaatgttcatccaaaatcggtttatctgctaaatgtgcagtaccgtatgcatccccaaatttctgtttttccatcaaaagagttttacaatggaaaactcattgacggtgaaggtactgagacaaagaataccaggagctggcacaaaaaaatacctccctattgcttcattgatgtgacaggtaaggaaagtaccaatacgagcaataaatcgttattcaacagggctgaggcacaagctgtggtctctttgattgacgcgctattggggcttgatcgtgatttcaactttgcttcaaaaattggagttatatcaccctataaacaacaagttgtactcctcagagatatgatacttcggaaatttggcagaaatataggaatagatgtcaacactgttgatggattccaaggtcaagaaaaagacgttattttgttttcatgtgttcgtgccgatgagactaaaggagttgggttcttggcagatgtgagaagactaaacgtggcactaactcgtgccaagtctactcttttaattgtaggacatgcaagcaatttatccggccattcgttatggaggcatttagttcaagattccaaagaccgaaatgtgttttttactcaaagatccttgctagatggaggtaaaggtgatgttacagtcggggtattaccatctggaaagggaaagcgaaaaatagaaggtatcctacccccagagaaaagaaagaatactacagctaatcgtaacactgatttcaaaggtcaactcaacaatgaacaacgttcaaagttcaaaggtcaaaaaaatggtaaaaagtcatccaaagatttttccaatgtaacacccagtaacactggttacgttgctcctccaactaagggatccttatcgatggacagttctgctccccaagtcaaatcaggaacattacctagcaaaccgacgtcaagttctcaaagaggacagaaagtgacatctgattctagattgaatcgagtagattccaaagtgttaccaagtaatgattttgaaactcctggtttcattactggagtcttaccaagctccagaggtagttctagggataaaacgttgcctccaactgcaagtccgctaagcactccttctccaacttctttgataccaagacctggtgtgttacctccgaaaccaccgatatcgaaactgccttcaaatccacagacttctgcaacatcactgggaccttcaatgacctctttcagtcgtccttcgatgattcagtccccagttgtatacaatcatcctaccatgagtcagccaaatctggcctacaattcccatgtgccagtcaactccggggtttacccaggttcgtccagtgtaaatcttccaatcatgaacccaacattgccagcagctctacctctgcaatctgtatcccctgtttcagaaagctcaaatgatccacactcggtatcttcaaaaagtaatcaaggataccttcctccgcaaagtcagccatccgccttacaaaatcgaaaatctgatcgccagccttcatcttacggattaaacagtaatattgatcctcgttcagggccaaagttggctgaaccaacagatcatttcgtacatgctggagagaaggaaaagaagaagaagaagaagaagaagaaggacaagagtagcgataaagaaaaatcaaagaaaaagcataaacctccaatgaaaagtatgtattaattaaattgaagatgatgaagtcatcgtatgtacatttataaatagaaccgcataatgacatttatcacatgatgagtgtaacccgatgaagaggtaggactagttgtcccagatggcttcccagtgcaacgtttcccctggtttgaaaggggctacttgaagatccttttcgccaatcaattcgggaataaacaaatctttcttggccaaggaaacggtatcttttgagactaattcgtcatcagtaattccgtagaaagaaagaccaaaggtgccaacaaaatctttcagtttatccaaagcattacgttgctcaaagacttctgcaacatacgacagaacgtatggttgagtgaaaaccccagcacacacaccaatatgctttgacttatcgtgaattgggtgaggagcagagtctgacccaaagaaaaaatatggctttcctgaagttgccgcatctatcagagctttcttatctcttgggagtttggctactggtttacagaaattgataggatttccagcccaactatcaattgtcaaagataaatggtgagcggtgatagtggcagcaacggtgggagttcccgtggtattctcatttatcttttgaactgcctcaatcgcatccttagttgtgcaatgttccaacacaattttcaggtttgggaagtccttgtgaagcttgaaaagcgcagggataaacttcgattcggcgttcaagacgtggatatcatcttcttcattttgttcactttgaaccgaaggcttctctccatgaaggttgagtatcaaattgtgtttctccataaccgtgaaaatggggtagaacttggagaaatcgttgggatcaaccccgagtttactattggtagtgacccccgctgggtagcacttgatacctcttatgagtttctcttgagcagcttgttcaacaagctgaggggttaaatcctggttcaaatagaaactcatcaaaaaagttgtctttggtgaaagtttttgcaactgagctttgtactccacaacttgggcaatggaggtgattggaggagtcaagttgggcattacgtaaacaacgctcacacctccttgtctgacggttggagttatcagctccatcattttgttttgtctaaggtggacatgtaagtctgcagttatacccagggaaagtttcattgtagtttgttagagttaagcggtgaatgaaagaaaaaaaaggaaacagccctgtcgataaactagtcctcgaaagatggagtgaaattttcctggaccgatgagctgtagagcagcatgtatttcactctaggtttattggattctaccgggtatagttgttatacataggcacaatatcaattatgtttatcggttttcagacaataaatatcggtataaactcaggctgcgctctcagctgccctctagctactgtctcctccagtatctccctttaatcaaatctaatcagtttgttcgagaaagaaaaaaaaaatactgcttaatcataccatatactccccttatgtctcaggccccagctttgtcgacacatcaagaagctgaccagtttcagtattcccaaatagaggagaaacgaatagaaagatactatcttggggagtatagtgacttgaagcaaaggattattcaattctatgatctagatgaactgaagaccaagctgcaagagaaagataatgacggacgtctgaaatacaaaaatatcaccctacaatttcctgactctttgatagctgatagcagtattgtactcagctaccttcaagagtctcttgtcacaaacgaggactgttctaccaaatcttaccccgatgtagaagaaatcggttgcaagggttgcgttgattgtgacaaaagagacaaaaatagtaagagtcaagattcggataagcaggcaatatggattttggcagatactgcctattcttcctgttgcatcgatgaagttgctagtgggcatgtcaatggggacgtggtggttcattttggtgacgcatgcttgaatccaatagacaagctcaatgccctgtatgtgtttggaaagcctcatttgaatgccgaaaaaataatagaaagagttgaagaattgtgtttggaagatgataaagttgttctaatgagcgatacaccatattcctataatctctactcaatataccgagaacttaagcccaagtatccaaatttggcgtacgcagatgtcgactttgacttgcagcgagaaaatatggaggtgatcggaaaatggagccagccacaggatgaagattcgatagcgtttgctaatcgcagaatttttggtttggtggatgagattagtaactacaagttgttccacattaccttgccagctgatcccagattactcttcctgtccacgaatttctcctctgtggaaatatttgattgtaaggaaaattgtactgtcttgggcccattcccttctctgatgaaaaggtacaagcacatgcatgttggacgaactgccgggactattggcatcctaatcaacacactttccctggcaaatacaaaaattatgctaaatacagtcataaaagccataagagcagccggaaagaagcattacatttttgtggtgggaaagcctaatgttgccaaattggcgaattttgatcccattgacatttggtgtatactaggttgtggacaaagtggcatagtcattgataatgtgggagattattacaagcccatcataactccgtacgagctgcaactggcattgaaacctgaggtatcatggacaggccgttgggttactgatttcatggaagtaatcgaaaatggtgaatttgacctaggaaacgacgaggatactgagaatgacattgtagaaaggcataaagacgatgcacccgagttcgatgcagttaccggaaagttttcgacgttttcccgacccctgcggcaattaaagcacttggatgtggaagtaattgagaaccaagatgaaacagccttggtcaagaaattttcatccaacttggcaattcaaagcacagtatccacttcggctaaagctttgcaagaacgaagctggaccggtctgggatccgactttaaagatcttgaagaatacggggctgctttggaggaaggccggaatggaattgcaagagattacggactctaggaaactcagttagttgtacatagtataaattagtaggcagacatattgtcgtactaacattctcctcacacgacacgacacaatccttttcggacatcgcgaatatgtgatgctctgatttccgttccatttcttcctgtagcttcaaacatattgtcaaagaggaagaatggggctagcttcttccaagattatggactcccttgcggagggaaccaactgtaggttgctttgtgtgattttcttcctttttttgtttttgattactaactttacagttgatagggaagaagtcgacagacttagaaagagattcatgaaattggacactgatggttcgggtaccattgacaagaaagagttcctttcgattccaggtgtaaatacgaacccacttgcagaacgcttgctagatttgtttgacgaagatggcggtggagatattgattttcaagagtttatcattggtctttcgacgtttagtagccgaagtagcatcactgacaaattaagttttgctttcaagatctatgacatagacagagatggttttatttccaatggagaattatttattatattaaagactatggttggtgggaatctgaaggacgaagagctacaacaaatagtggaccggacattgatggaaaacgacctcgatggcgacggaaagttgagttttgatgaattcaagagtgcagtcgatcatacaagcattgtgaacaagttcacgctgaatttgggaatatgatcagtttgcgatacggtttgaaaacggaaataggaacaaaaggacaagttggaatgaacatagtgaacgaaatagaatatatcaaagaacaattgagacatttgagtagagtttatctcttgtataactggcagactgctagggtcgtgtagattaatgatttgtctgtttggcaactgcaactgccagacgggaatatttggtctctatgattatgtaagctttctttatcattctccctcatcttgtcgcgtgcgattagtactctcacttccagcttcccctaatcacatggaggaacaaagccccaaatttgagtcttccttcccacgcagaacgagtgaaggaccggtggatgatgttggaaagtctccgccagcatcattctacagagagcttttagcaaacaaagctcaacagccccagttgtcagaagacgaggaagaccataatccaaaagacttcctgtttaaggaagatagtgaagatgaactacttataccagactccgaaaatcataactccagttccacaagtccaagaaagttcaaggtcgagaatattcgttggggtagtgacaccttgaatggatcgattctaccgttgaattctcaagggagtaatcttcagagccttctctcaaatgttggagaattggagcatctactatccaaggatgttgctaagcattcaaaatacctaaaagagcaaagtagcaaagttgaaaaggcgcgggctaatattgtgacaaatttgaccagattgagcttggtgttatccagtatcttcaacacataccaggcgaaggcacaagacaaacaagcaatcttggacaagatcgaagaatgggaggatgagaagaaatccttgcttgatgacatgaaagaagttttgtctacggatgataatgcggatggtgagactcacaaattcttagagttggcaagcgaaagcataaatgttgaaaacgaaatagaagctctggagacaaggctgaagcaactgaagattaaacagagaactttaaaaaatgagtgtttccaatcccaaggaataattgaaagcaggctttcaaattttgtccaagccgttgaaaagatcgaaatgagagaaagaaagagtatagaacaagtggtccaacaattatcagagaaccaattaggttactggaatgataatttggcactagaggtaatgaatggcctgactatcaatccaggagacatcagtttagttgaagaatacgaaccagtggacatattgaaacaagtagaatcattagagaaacctacaattgctgcagattaccacctgcccaaaaacacgaacaagcaagcatctaggtttactaggcaactgttggaattcaactacaaatgccaacccaaactgaatgtatatcctgttgttggactaatcacaaaagaattgaaagaagactctgctaaggaacaggagtataaacacagatacgaccaagtcactcataccctatcggcactaaaggattcctttgctctgatttatcatactgaacaacaattgcaatcaataactcaatctactcaagatttaaaggatttccagagtttgatgaatcaaatggttgaatcactcttgaaaactcactctgaagcagaccagtacaatctctatttggctaaagatgtgttggcacaggaaatatccattattcaccaggctttaaataaattaaaccaatctacagaatattcatcggttgagtctgataatgtgaagaatcatgatggattattatttcagacattttccaaagctcaagaacgaaccaagctaccctctatcaaatcagcaacatccattcgttatgcgccatcactctataactcactttcgcctactagcaccagcaagactacagctaaaggggaagtaaattatgatgctggaatcaacaaatacaccaaagtcaaagaagttcttagatctggaaaaggtaataaggatgagtaattattaattagagtggatacgttttaatttcactcttcttcgtcgaacaacttggtaattttttcactaatttccttatctttggttgtcaactctgatgggtcatcctcgtttccattatcatcttgcatccagaacaaactctttgccccactactcaaaaatgtcaatttgaaaactctaccatctttacaacttttgacgtgtttccacgtcacatcgcccggaatgaccaagaatgtctctgactggttaccttcaccagctgtgttctcagtagggacccatttgaaatcataaaactcttcgccctcagccgacaattggacgattatttctcctcttgttgccaagggtgtacaaagcttggtttcctcgtcaatcttgactttgcctgcgttgaacttgataattgccattttgcctcccgttctggtatcgtcgtagagaatggagaagagtcgaacgagatgtggttgagatgttcaaagcgcgaatattttaattccacctcctgaagatggttgacccaactagagctttaaggactaccaagctcgcagaaacacaaccagattcgtaggaaattaatccagttagccaattaactaaccacgtctctatccttctgcgataaacttgccggaagaagaattttgaaaaccgaacctactgcggtactcgcatacgacttttgcatttaaatcgttgtaacgaatgcacttccctccagagtcggtgaaaccattagtcaaggaaatagcccagcatctgattgaaaacaatgagacggtagcagtgtcagaaggtgtttgtggaggtttactgtctgcttatttagtgtcaataccaggagcttcacaattctttcttggtggcacattagtctacagtctcaagtctcgattgaaactcagtggatgggatgaaaaggacatatcctcatacacaggtcccagtgaggaagtcgttttaagattggctagaaatctcaagatggaattgggagccacgtacgttttgtctgagactgggtttgccggaccatccggccagtacggaaaaggtagcgaccaagatgaggaggttgggacagtgtatctagggatctcaacacctcaaggagacttggcatgtgtgaagcgtacaggcataaaatcacgatctgataacatggccttatttgcagaggaaggtctgaagttcttgttggaacatttgaaatccacaaagtgaaatttttcacaagaagaatctcggctatcatctgtttttgaataacagatcacaggaccaacatgaccaggaaaaccgaattggttttggcaggatttgacaataagggccatttcgagtactaattacagatcgctaacaacaaattttggcattatcttcaagtttgaccttcaaaaagttttccaacctctcttgagtgactatcataaacgtcttttattttctcatcttaacgtaaatagcctaaacgacttttcactcgttcctttccgcctctatgcttccccagacaagttcctaacttttcgattcgttgcagtacccgcgaaaacattcttggtttccgatcctaatcaaattaaactttgctgaaaatctcagatccttatcgttttccattgatctcccaattcaatttcaaatgatgtcggagtggtcaccgttgccaaaaatgcttcatgggaggtttttgaaggcctttgtgccttttgaatcgcttcccaagggaaaggccaagcaattttcctcagaactacaagacatacatcctggagatgaatgttttatgtttgaaacgaatggggatgaatgggcaagaggttatgttatttcacaaccacttctgtctgagttttcagctgcagccattgatctgaacaagatccctgaaagaaaagttactttgggcgtatttcctaggtcctacgtctttacaattggagagatctctacagaagcctccccgaagcagacagatgattctctggaagatgttgactttcccaattcggtccccactctttatgacactgaactacaaatcaaaagctcttctaatccagatgaacttttggtgcctaaaagtactgctttaaccaagcctaacctgcccctaatacagttaaacgacgttgacctattggacgaaatcgttgctactttaatttctcttagttcccatatattcaccatgtactcgataaacgagttgtacttgtttcaaaggttacatgaaatttatttgcaattggatgatattcgaattgatttgcaaaataatcttttaaccaaagctgagaagacaatggcaaagaaaaacgcaacttacttaatggggactattgttaagcttttagccagccggggagacactaatgccggtgctaatccgaagtcaaagctaacaaggtctgacattagtggctatcaagcaattatgtcacgttctcatgttacaggtaacctattggattttcagaaagataagattaatcctgctgagttggtctccaatcaacttttatttgcattatctcccaactatcctgtctctaccaaaatcaatgctgacttaactccagaagaagatacttatttgaaggctgttccaacgtctcatattttggttgatgtaaagaatgtgagcggatcactatcattttttcccaaaggttacaatggaatgactgcgtatattttccttagaacctctaagactcgtttaacggaagcgttttcgattcatatacgtccaggagatgatctatccttggagaatctaagtgctgcccttttcaagaatatacctgcaaccgcaactgagagtgggaaaatctatcttgttgccattttaacggagggtatcgatgtggcaagtagatctgggaagcctgtttccttgaatcaaatcagaaaaggaattgctgctggagtcactgatgtatctagaatcttctcgagattgaaggggtccctagcagctggggaagcgcaccagtttattataaagctatttacctcgttcattaccgaatcagacaactccaattcgtggaatatcaataatggatggggtgagttaatagagagaatcattactggttcttcaagaggtgttgcagttaatcctcgtgctgaacgtctcatactatctattaaagagttcaaaaatgaaggaatttcggatcaaagcactctgaacaactccttagcgattgcgcctatccgtcccctattttatgatccgttgagtgccaatagagagagaatatatatccagttggtcaatgtgactaccaccttagacttgggaaaaacgccttttatcacaactcatctcaaagcatctaataagaattactcgtttcagaaatcatccaacgaagttccgaaagaccactgggaattcttgactgttgctcctggagaatacgtcaacgaaatcattttgctcaataatattccatccaaaccaagaagttctacctctgattacattattttcactatttttggtaatgaagagtatctcggggaagccaaacttttattttatgatggtaaatctgtttttgaagataagaaaggctgttcaattgatattatgtcaaatgatgaagttgttggaaaagtccaagttgaggtggattatcaaggtaaagtctacaacttggatcctaatttggagtcaattttgaactggaagtcaatctttgccaataatttcaaagcgaacgaagagagtatctgctctactttgacaaaatttgggcgaacaaacgtactaactgttgtcaaatactttgctgcattggtgatgagcgagtttgaaatttatgaagctgcacttgagaacgaacttcctactttatccaaagtggcatttgaatctattgtgcaccttctcgatgttgcaattgctcggcaaaaatcatatatatacctttttgatgactttaccagaaactatgctaagctcctacctaaggttgcccagccttttttgaatcagatcgtcagcatctttgagaacgctgaacaggagtggtcacatgtgtcccgttccttatgtcgtgcaattcgtctccttttgacgttgttccagaatatggctgatgtattaccaagaattcaattacacaacaatcttacaagattggtgaatgcaattgccaaattcttctcgtttaaaaaagataatttagtttctgatcaagttcttattctcagtcaagtgttgcacattagagagactttacttcttggattcacacctctcaatgtttgtaaagacatgattacctggttcgatataattggcactaggggattgggtacccttgaacaaggcgccaacgtgcaaaacaagccactctcaagagaacgtgagcttgttataaccaagctgatactattgaacaggatgttacacaaatcatataacgatgattcggatatttccaaccttttgagcaactatgcaatccatgtgtcattggaagtcttacttggacagtccgatgtctctgcatcaagattgtcttctacgatactgatttctgtattttctgctacttggcagaaaggtgatgatgcaacagagcaggaattactaactatagctcaactgttaccgttaatgagcaagatatttaacaaatactacaagtcgtataagagaaatgacttgcaagcgaagagagttttcactcaactttttcagacaagttatccattcacagaacatactgtggattcagttgtcaacaacgaatccttctcggagctcttgcttgagttttctactctcttgacatttatagttcaagcaggccaaaggttatcggatgagactggcattatgaaggtattggagatgtccagtaagctgcaagggaaagaacctgatattttgtcaagtgaagtcttactatccattttgaagacgcttaagtttatcgacgaaggtatgttttaccccaaagataagtggttatctgctagtgctctttttaccgttacttcctatggggcgtttgaattgatagcccacacaatgtgtacttactatattccctccgtggacaactcggagtcattcgatcgtctactatgggcaaactttcttagaactttgttaaagatctctacgagcatgcccgtcgccattgaacatctcactagcatccctgctatagggtgtttgaagattacaggagatcttagagttaagactgccaagttattggagaacatttgggataaactagcttgggaagccctacctgaagatgttcacagattccagttgaaaaggttcggcggataccaggtggaattcattaattacgacttttcctgctttaaagatttgatcttactgtctttgcaaaaacacgaatcttctagagaggtaggcgttaaaatgctcggttcaatcataattgccgaatggttaataagtgagaatctatttgacgttgaaagagaatgtattctaggctgctacgagatctacaacagtgaaggttaccgaccaagttcggaggaacagcaactttttatcaaaagattaaagcaaatcttgcatgttgatcccgaagatgtggcctacaagccggtaaagaaatttgtctccacccttgccgaatttttggaaatactaaatgatcttgagaatgttccattgggggatgagtttgatgatgagcgtaccttccataaacttaacatttcaggatacctaatggaagttaatagtcccgaagttcttcaatcattcatcaatggaatgtatgaggataataaactcaaggaaaactttgttcaagctgctctgagtttggagttattggcaaacacctatgattgggacattgatacagttttacctaggtgctatgagccagaattcccggcccaaactccatttgaaagaaaagaggctcttttcaagctcattgcagacaattttgctaagggaaatagattagagcaggccgtcgattgctacaaagaattgattgaagcatatgataaagtcagttttgatcttcgtggattggcatctgcgcatgctaagttggctaaagtttacaagggattggaagtcgttgatagagtaacaccatcatatttcaagatttcttttatcggtttgggatttccaacagccatccgaggaaggcaatttatatatgagggtctaccttttgaacatatcactagtattcatgatcgtttgtcaagactgcatcctggtgttcgtataattagtgaagaagaagaagctgaaaaattgattgaagaggtcccatttggaaggttcttacatgtgaagacagtcgagcctttcaaagatttggcctccaactttacccatgccacgatatccatgaagaggtatatggacaataaagatctgaaggttttcgtttcgacgagaagacttccaggagctacaggagttacagatttgtggaccgaagaaaccacatatgagacctatttgacattccctgtgctaatgaaccgtagtgaaatcaaatctgtgaagacggtcaaaatatcacccctggagaatgccattagattgttatctatcaagaatcaagatttggcaacgttagagttatttataagacatgcactgaaagcagatgaagatactttaggtttattcaatgatctatctcgtcaactggctggcactattgactcaccagtgaatggcggtgtaacccaatatcgggtatttttcacgtctgaggaggaagcggaagattctttcagtggagaggaagtgaaacttctcaagtcagaattcaacgatctagtgttattattaggtcgctgcttgattctccatgggaaactagtctccaaatctttaaagaaatcccatgattcattgattgatctgtttgaacagaattttactgatgaaattcaagagcttgaaattgatttggaaagtataagaaatgccaaaatgattgataccaaatactctgaccatcttcctaatttccgtccttcctccatacggactgagagcattcacagtgttggagataacagccgtattgaagtgtcatcgggatcacttttatccgaatcttctagtagactgactaatttaacagatggtactagccgaagcgcagctacaagaaagaggactgccttgaattggaggagaaatagatcttaatttgaattactgataagctagtagaatttaaaaggctgaatagttgtgtagttccattattaagaacagaaacagactgattaccaacttcatttttcacccaatcacataggggaccttaggtaacccttttcagagatagtactcttacgtaacgtcttctccactggaacctcaacttttcgcgcctcaactttctagaacagaaacggaaccaagtaaaaaaactgtcctacttttttcgcctttcttcatactttaatcatgctcagaaacgtttcaagacagttactacgttcatccaaggtgtacttgccacaagtagctgtggtgagaactcaaacacctgccttcgtctcgccatcaatcataagcaaacgtttcaacatcacacaatctgcttccacattgaccaaagaggatgtcctaaccagaagtgtctctgtgttgcggggatttgaggtcaagacaaaggatatcgatttacaaaccacttttgttcaagatcttggaatggactctttggatttgaacgatgctttagtcgctctggaagaggaattcgatgttgtgttcgatgacaaaaccgccaatgagatcaagactgtgggagaagttgttgattttgttctggctaactacttgcccactgagcaatccatcaaccataccatccgttaagttattttagaagtgttgtttatagccaaatagttttaccgaaggtgattggatgtaagtgcaagtcgtgtgcagtccaacttggattacatgctgtaggtaagaatgaagctggggtaaaatatagcaagtacgaaaaagaggacaattctgtctcgctgatggatgttgaagcaaccctgtttggttggcatagtctcctatagtaccagccaactagcgcaagcagtagccatctttctcttcgtcctttagacgacatcaacttcgtctctgattatgtaatctttggtatctaccccaaagatcgcgtaggaatattagctcaagctaggaacccacagaaatcatacgaaatgtcgaaagaagaagagaaggctgcattgaattctagtgataacaattccatctacgaaacagatcctgaagatgttcaggctccaggaaatccaataagtacattggacaccgcaacaggattcagccttattgatgataccaatccgcaggagattgctgccgatgaagacttggccgatgagttggcatctgacttggagtacttagacctggtccacttgaaagtgaaatccctagaaaatttgaacctagatagatttgcccaattgactgggatatgtctgcgtcagaacttggttgactctctggtcccactgaaggcaatttctaaaaaggatcaggtgaccgaactggatttctacgacaatagaatcaaccatatcagtaaacacgttaacgaatttgagaatctagaagtgttggatctgtcgttcaataagatcaagaatatcaagaatgtggatcggctatctaagttgaagaagctgtatctcgtccaaaacaaggtgcatgagataaagaatatatccaatctcaaatcgttggaaaccttggagctcggaggtaataaactcacagagattggggaagaacttttaaatctgtcttcaattacagacctatggttgggtaaaaattacattcagagattgcagaatctagatagtttgaaaaacttggaaattttatccatccaatcaaacaggctcacaaagatcgaagggctggaagagctggttaacctcagagagttgtatctggctgataacggtatctccaaaattgagaacctagacaagaatacgaagttggaagttttggatttgacttcaaataaaattgagcatctggagaacatgtcgcatttaaccagcttgacagatctatggttttcttacaataagatttcctcatttgccgaagtggagaaggagttatccaagctcccccagttggacactgtttattttgagcataatccaattcagaccgagaaccctacatcctacagacgaaaactaaagttgatattgggaagcagtttgcagaaaattgacgctacatatattagatcttgaataaattttacttggctgattcaagcctttacatgttcgcattttccccacttataagacccctttaggaatagatagattatgtgtaataaattacagcgatcgtagattactcaatttgatgctcgtctgtttttttgcccttaacttaggtggtcagcgataacaattcactccctcggcctcccctaaaacggagtcttagaccaaaaataatggcagaagacaggaaaaaacgtgtaggaaaagcctgtgactcttgtagaatcaaaaagaccaagtgcgatggaaagaatccatgttcccgttgtatcagtgacaacaaagtttgtatttttagtgaaaggaaaaggttcaaggacagaaactacccacctggatacgtacagctattagaaacgagactcaatctggtgttgaatggacttgaaaagattgtgaatcttgtaagaaaagatgttgacctgtcggagttgaagagcgacgagttcatgctgcagccagaggaggagaaagtgaatatcaatcgtgtgctatcctggatgataacccaacaggacttggtaactaactctccagtagaatgggattgtgaatcagatatagcagctaagttgacaggcgatgtctcagactttcaggcctcgattcacaaggttttagagcaaaagaagactcaaggaaggaaagagtctagtagtcccttagacaagccaagtacacacttatctacggtatacaatgtggacaattcctcagtctcatccaatgaggaaaccgctgatatcaacccccaggttgaggataatccattgcctatactagacaatgaagataacaatttgaatcccgatagcagcaacacattcgacttcaataatgtcaacttcgagctgaacctgggtggcttccaatctggagctgcgcttgccactgcagcaatggatgggggactttccatgatagattttgaaaactcacccagtatgggaggttattcgtcatctgatcagaaatcagacctcctagattttcatgatgaatcatatatcccaccaactacacttcaaaggaagaattataatagcaactcaccactcacgtcgccaccattgaaccctcagaacatgagacgatcctcctccttcaagactacgaggcggaattcgaactcccatttgggctacatatccaagccacaatcaaacagtcatattcacacaggactcaagaatagtccagtggctggtatctttcttagttctgaagcggatggttcatctggcaacagtgggacgttttcttccattcactcgcctgctggtgattcatttcctacctcgtcaccgaacaataaaacagacgaatactaataggaatcaagttgaattcattcaagaattgatttaactgtggtaggataataatttatttgtcgtctttgaacattattgatagtaatcctttgtttcttttgtatatattaggtaaatccctttttggtaataaattgtcacctctcactatacttcgcatttttccttacctactgattgttatttcttttttccaatcaaaccatcatcatgtatgaagaagaggtgtttgaccttccacaggacattttggacggtttggtcagcaatgttgtggaggccaatgaggagaccaagtctgagtcaccaaaggaacagcaggaggaatttgaactagagataacggacgatatcctgaaccgtttagtaaacgatactgtaggcttattggaacaacaagggcaaaaagctgagaacaaaccatctccggaagatgctcagggagaagaaacgatatcgaacgatcagagtgataaagaccaaacacagaaacaaacagaggaaactaatcacgccgataaggaaaaacctcagctaccttcagaagcagttactgaagatcggaataatgacagcagtgagtatggaaaacttttagaggatacagaagccattcttcaacaatatgaatcatccaagagtgggccgcaagcggacagtcgtgtgtctactcgtccagcccaagaaacatcagatattgcatcacaacagcaggattcaacagtcaagacaaacaattctcagcaaactgggcatgaaattgaaagtgaggttaatttcagagacatgttaagactggcggagcagcatgtacaaattgaccagctattgtccggcacgtcagaagaaatttcacacgagatattggaacaactagcttcagccactgctgaaagtattcaaaatcaacaaaaacagctggcaaaagagtttggtgttccaaaacagcaacaattacagagggagtttttgaatagacagaaacagcaacaaaagaaggtcgaaacttctcctgatgaaaatctccaggaagcattagccaatatggttcaatcagtggttaataatgttgtagaaaattctagaaacgaaaaagcagatgtttccaagtctgatctggatacggctacgagtagtagaacgaaggcatctgagtcccatgatctggatcaaacacaactaaatcaaattttagagaacgcagttgccatggctatatcgaatcctaataacttaccagataatgctccaactaaccaagaaactaagcagagtaaaatttccaatgaaactgctgcaatcacgtcacaagaggcattggatgctgctaaggccagattgtccaagcttccaatcaaacctatgaaacgagctgaggaaaagaataaatcatctgattcaagtacaaattcgggtgctggtgggtttaatcagtcacctttacagtccaccggtaattcttccctcctggaggcgatacgaaatgcatctcaaagtgccatgaaacaaattcaggaataccgaaagactgggtcgacagtaccaccgtctaaagaggttcagattggttctgcttcttccgatatgttgcccaatagtcaggcatctgttgtgaacgattcggttactaaaaaggctgcttctagtaaggcacaggatgcttcgaagaaaagaggtctctccatcgcacaaacattagccatcaccagagatcagatggttagaaaagcttcaacagaacctcagaatatctccaacctttactcttccttatctcgtaacagctcattatatttgcaaaggcaacaaatgctgaactcaatgaaaacaaaaccccatgagtcaaacaaaagtgagtccatggacagtttagcctttttacctgccacgataagtgaagaagtgtctagaatcaccggtttgtcatctgatgctatacgaaacattttcaataccgtaaacagtgccgttgatttgatagcgccttctctgaacagaaagtctcttgaaaaagcaaacatggatttaaaagagaagattcgtatggataatagggagaggaagaagaggtggcgagaattgaacgtggataaaaatagagataatgacttgagagctagagtgctaaaaagagctagtgttctgtttccttctgcagatgaggaagaaaaaaagaaaaaatgggttcaggaagagtttactaaaaggaaacaaaagagacttgaaagagaaagagagaataaaccagtatattcagcttttgaaaccaagaaggaagccaatagcaaagacaaccacaaggctagtagcgagttgactactaccactgacactgttttgaagcagttcagcgacttaggacttccagatgatccgaaatttgctaccgatttcaccgagttgtataaaacatttcagaattcgacgtcttctgtgtattcatcaaagaatagtctcatcaacactgcgactgctgctattgttgcgtacgcttctctcaatcaagagccagctctgaagcaagaaaaccttgatgttacatccaagttcggctcaatgatcaataatatagtatcagctttgttgaatagcactccccaagaagctgctgttaaagagattacaggattacctgcaggggccatgtcatcattcaagatcagaaaagattccccaaatcagaattcatcaacggcagacacgataaagcttccttcaaaggtccccgatgcagaattgacactcctaataaagaataaaaactcgagtgctacaaactctagcaatagtcaaatgatcggagctttgaggaacttgaatctcaacttcactacagagaaacgcaaaatggacgacgtacctattgcggtggacgattccacacccggaaaaaaactgaggaccgaagacaggaaaaatttttcggccccttggacttttaacacgttaaagctaccccagtacaagaaacctgaagttggtaaaccggtctacactccggcccctccacgtttggcacaaccgaatactataccagacagagaagcttctaaaccattatcgtttggtgggattaatttaagaaagcctggcgctttccgtaagcctaagaccaccactcaatgatcactcttcatatcgctaaacatatattcataatattacataaacgaccctttcaatatataggaaagacatcgcgattagttaaggatattatattttggtgaacttttcatcacacatggctaagaagaagtctaaaaaggctgaatccccacagccagaagctgctgcaactactagatctagagaatctagggaagaagcggagaaaaaaaggaaagccaaccggcttttggtcactaatagtagcacctggacggggaaactgcctgtgaatcttttgcatgagcatattcagaagagaaaatggaataagccggaatacgatatgaagagagtgaaagatggctttattgctgtagtcactttaagctgggagaatcctaaaacgagagagacattgagaatcaggtttgagcctattaaagaagtcgttgaacctcaggaaactcctctagaggcaagacattttgctgcaacctactgtcttcatagactcgcatttagtaaaaatatacatatggtgctacctaataaccataaggatttttggaaggaccttgaaagctatagaaaggacatggaaaagaataaaccttacaaatacaaatatgaatacacagaagaaccatttcaaatgctattggaaaaaaggaaagatgaagcagaagctcaaaaacaaaaagagaaagaagctaataatccgcagaaactaaagatagatagaagcaaaaagattcctgttaactactccacaagaaatgaggtaacgtttcccagaaaggtttgggaacagtcaccgttgctggatctcggctttgcttttagaaggaagatcgaaaaactgctgagcggaagctggcagaagctatttgaagataaaaaagcttcaaggcccgagtatgttgacagcttaacgttcttaggatttagaaacgcccatattgaggaatgtttactgtacacaaataacttcaataactcactagaatggcttttattcaatgttccggaggatgatttgcctcctttttttcaacgcgatgaaagagactctactgttgagattaagctgagcattgactccaaaaaggataatataatcaaaagactaaaagccggtggcttcgatgaggaacaagtgatggaatgctaccggtcagatgaagttgatgccgctattgctctaacatacgagttggtaaaatatgaaccaccaacaactgaagcatctgatgacctcaacatttgggaggaagaaattgaagcaatcaccagcattattgaagatcgaatcaaaaagactggcgataatattgtggaatttgaattggatttggagaattgttcccagtgttttatactacgagttttcaaatcacctggctacccttcaactctccccggtatccacattctgactccaaatgagaaagtagccaattatatcaaacaatcgatcattcaacaactggtagcatacttacaggagaactccataattggagaccaaatgttgtactccatgttttcatggttagaggagaatattagcaagatcatagagaatcctggtcctttgataaaggacgatattttcgttaccgatgcacaaatagcatccgtaactggcaagtctaagagcaaaaataaacagagaaagaagcatactgacgtaagcaggattaaagctgattacgaacaaagagttggtctcattgatcttgaatcaaggacaaagctgcctgcttggtcccacagaaatcgaatggtggaaattttagaggagaacgaaatcgtattggtaactggtgaaacgggttccggaaaatcaacacaaattgttcagttccttttggatcacatgaatgctcaaaatgacttttcatcgcagattatttgtacacagccacgaagaatttcagccattggactggctgagagagtttcagaggaaagatctgacaaatgtggcaaggaaaccggttacatcattcgtggggaaaacaacactggcaaactcactaggataacatttgtcaccactggtgttttattgagaatgatgcaaagcttgttaaaagacgatgattcctctttcgacctagatcaaatcagatatatattagttgatgaggttcatgaacgttcaattgacagtgattttttgctgatgattctgaaaaaggtcagaagaaagttcccaaatctaaagattattctcatgtctgccacaattgatatcagcatattttcaaaattcttcaaagttgatgtggcacatactcatattgaaggaagaacttaccctatcaaagacttttatcttgacgaggttatcaaccttatcgattacaaaattgagagaaacaacgagctggtaaccccaaatcctaactcagattttttcaagtatagacctttggaccttgatctaattgctaaactggtttttaagatcgattcccagctgaacagttctggatcaatcctggttttccttcctggtgctatggagattaatagttgtattcgaaaattgaaatcggctttcaatgaaggatctctttgggcccttcctctacattctgctctatcttccaaagatcaaaaaaaagtattccagaaacctccaaaaggtgctaggaaagttgtgctttctacaaatatagcagaaacttccatcaccattccggatgctgtggtagtcatcgattcaggaagagtcaaaacaaatgtttatgataccaaatttcattcgactaagcttattgaaacattgtgctccaaagcagaggcgacgcaacgaagaggtagggctggacgtgtgacaagcggactctgttataaactctattcgaaagaaaccgaactggaaaatatgcgtgaccatccagtaccagaaattatgcgaaccagacttgaatccatttatctgattgtgaagtctatgggtatatcagatgcaagggaatttttgaaaaccggtattgactctcctgatgacaacttactggataacgctaaacagttcttgcatgacatcggagctgtctccgaagataagctcactcacctgggtgagtatctttctatgttgcccgtagaccttcactctggtaagttaattattttcggtacattgttgggagccttggagacaagtttgacattagctgccatcgcaactaccggtaatccgttcattgagaataaggaaaatgtgagggcggtgaaacgatcatttgcaaacggtaaaggagatttgatggcaatagtggaagcttatgttcagtactccaacctgcatacatcgccttataagtggtgcgaacaaaactgtctgtctccaatggtattgaaagacatttcctctacaagagatcactatttatctattttggaagatattggattcattcccctgaactatacaagggatcatcaagtgctgaacagaaatgattctgatttcaaaatagtcagttctattataacggcctccttctacccaaatattgcaaaggtaaactaccctgagctaaagtacctaaagagttctgcgggtacgattgcacgtgaagcagatgctagagaaaccaagctcttcatgaaaaatcaaaactataccataggttcagaggctctaccttcaaatcgctgttttattcacccaggatcaagtctattcgcaacatccgatgcggtgtcatcagtagcagaacttcaactttttgacaagactgatattgattcatccaaaataggttcagctaagcttccttcacaattgcactcagacttcgctgtgtatcgttcttcccaggtctcggttcgggatcaaaacacgaagatttatttgagagatataaccccaacttcgagtttgtctgtcacattatttggtgggaagatcacttataacctgaataccattcttgcaggtcgaaagtcccctggtattgtaatagactcatggattccaatagtgacttggtccaagaatggagtcttacttcaccggctaagaatagctttggatgaagccatcaaggtcagattgtctaaagctgcttataatcatgtacaaaatggaggtgacaatgtcctcggattagttgaggaacttattaaaaactttagatattagcatcgttacttctttaatttatacttatcaccgttcacttctagtttctcctcttcgatgcaggaatgcagatatagctccagctgcttttccgtagcattgtaaggagtctcctggggaactaacattttcaggaaagaatgcatctggctgagagcagtaggtcccagattagtcaacattccgacgataaatggccaatacttttgcattgtttctgccaattcttcctgatcattatgatcatgcgcattcgtgtcctcagatacacccgattcctgctcttcgaaggatgtgacggatgaccagactgatccgctttgctgaagaatattcttttgacgccagaattgcaaattcttttgcaaaagagcaatatccatctgcaattcttctgataatttctctatctcccagcttattcggctagaatcatctgcggaaaacttcagaatcaccgcagctttgtcgggcgttaccgtaaagcttctggtctgatcattcacgtctatggataacgtgactctaccctgggagtgaattggctcgatagatctctcaggcttgaccgttgagaactccttcacataattttctatgctgttggatacctcaagtggcaaaaggaacctatccttttcaagctgtggccagaataaatgggatatgattgacgaatgaaggttttccggtattgtggcacaattcttatgtatttttctatcaatgattttactatcattcacatctttgatcatcacatttagtgaattaaactcgttctcgccaaaccttactttaagcaaatcaatcttatgagagatatcagcaaagtcgtaacttgtaagatctaaaagctgtgatgaaataattgatacgaattcatttacaaaaacatttttcgaatcaaagatggaaattaaggattcaatgatatcactaatcttgttcttcttgaaatctggaagtgcttcactagggtctggcacccaatgtaggtctctcaaatcatggataaagtgagtttcagctaatgggggtttggagagctctttggaaagctgaccgagctcatttgaattctcgtcaagtagtgctttcacgattctcttgactgtatcatcccggtctctcaaatagtgctttatgggcctgcagaccttgtctaaaagaacgcctctagggtcaagcttcaggaaggctttaatgaccaacaggtagaacgatattatagtgctagtgttgataccagcatgtagtagtctctcttggcacagttttgtgaagtaggaaactaagtgttcacgaacatgggtgtgaataagacaattcttcatctcttctaggcaaggttctgctatgtcaaaattttcaacaatatcaaacgactcatttattctgatggtgattagttcatcatatatgacttggatccaactgtcggccctgaagctgtttgggtcgataatccgataaattctgggcagaagccattcatatagccagcttctcaattcgggaagaacgtagtgatcccatttgcctccataagtaatattaatatagctggcaagtttagctcttatcaattggactgtaagttctccaagatagtcacccatgtgtatcagtttcatagccttgaacgctctttcttcttcgtaagagtcctgaccgtttaacacaattaagatcatagactcaagatctttctccaaagtaggacattcccggatagtcctttgtagtactgcgtttgtggctcgctcaacagcagatctgtcgttctcatcaagattcatgcaccttacaatttcaaccactttcctgttgacagccttgacagccctcaaacggttgtaaagagaaccatcaaccacaattggatatcttctaaacactctcaagaataattcccggagatggggcccacttgagtgttgattatttaagcttcgaagacttgtacgaatacgcaaaggtggatctttagtgctcccttgacactccaacgactgatttatccactcttttaccagctcccagtcttgctgaagatcgggcaaaacattttcggactgaaacacgctcaagaatgcgcttctatccaatggtcttagtgacattaccacaatctccccctccagataaagggaaaagaagggtaaacagcagattcgagaagatcagtagagggacagataagtcactaggtgggaaacgagagaaaaataaatccagataaagtatgtctgtggtgaatgtggcttaggaattcatacatttattcatttagtcttagaaagggtgaatggtctgcttgacagtcaataatactgtgacggcgcgtgcatgtaaatcaaaaaaacaaaataaaaaataatgaaggatgcgaggttcgaactcgcgcggacaaccgtccagcagatcttaagtctgccgccttagaccactcggccaaccctccaatggttgaaacatattgatattgcatctttttgtcaggttttggtaaattctttttcgcgagatttatcaattataagtcaccaaattgtccaaacaagttgacattggataaatagtaaaactagattctttgttggcgcatataagtttccttttctcaacgaaaataaacccatggcacccagatctgttcaaaagttagttgagtcattcaaagaagtgactgatcttagagattctgaggctacagcttggctcaccaagtataaatggaatcttgaagatgctgtagaagcttacttgactcagacctcgatgaactcccaaggccaaaacttcctcacacaggaacagaaaggaagtctgatcagcctattcaataaatataagcaagatggcgaggactacattggtattgacggtacgatccagtatatcgaagacctggagtttgaagttgaagatccagtggtgttagctctggcagagtttttagaatcgacacaaatgggagtttttgaaagagcaaagttcgtaaataactgggaaaaggcggggatatcttcgatacatgaaatgagacagaaagtattggaatttcaaaggtctttagagaatgatgaacagtttctgaagaaagtgtacgattttactttcaagtttctattggacaacaaccaaagaaccctactaaaagatactgctgtagaatattggaagctcttactatcccactattttggcgaggaaaagatgagtcaatggtgtcagtttatcaatgatgagtggcaatttgcaatcactaaagatcaatggcagatgctttttctgtttatgagtgaatggaatcagaaagataactttatcgaatcatatgatgaaaatgcagcctggccttcgatgatggacactttcgtcgaatatttacgagcaaaaacgagcagttaggatgaagagttttgcagctaatgaaagtatgattaaagcataaagagggtccgagtaattcatgtattgtaatccaatcccgtatatcattggaatctgtccttacataatctaaatttttcagtcatgtgactcgaaattttttcttctttaattttctactgctaatctacactctctaatatcaactaccatggtcaagtcatatcaaagatatgaactcggcaaatcatttggagtgatcagttcagatagcaatattgtgtatcttcctcaaaagaaatccacgggaaaagtcatcaccggtggattggaagacattttggtatgggacattaagactggtgagctctctcagaaactgcatgatggaataccaattggagcagctgatgcctctgtcagtggcgctcccagccaagttgttagactggagtaccaccataataacaatattgttgctgctggttatagtgatggaagtataaagatttgggatctcacatctggaactgtagtaatgagtctccaaggtcacaggtctgccgtgacgattctagtattcgatcgaagcggcacaagacttgtaagtggttccagagactctactatgattgtttgggatctggtgggagaaactggtcttttcaagttgaaaggccacaagaatgagatcactggtctccttctacttgatggaacagaagccaaagatgacgaagaaatggaagattggctcgttagtgtcagcaaggatggtttgataaaactttgggatttaaaagcacagcaatgtattgaaacacatgtggctcatagcggagaatgttggtctttgggtatcgatattgagcgcaggataatcattaccactggtacagagaacaaatgtaaagtctggactcttgatttggatgctcctaataaggttagtgaaaggggattatttgagaaaaagagcaagcaaagaggtctcacaacttcgttcaagaccattagaggaaacagctttttctttattcagaatgctgatagaaccgtggagattttccgattaagaagcgatgctgaaattcaaaaagctgtgactaagagaactaggacattgaaagaaaaaggtttggatgaggatgaagttgaagagaatttgaagtcgggtgacattaatagattgatacaaaattttgccacagttagaagtatggctaaaatacggaattgtacctggactgaaaaagctgatctcttgatctctttgaataataacagtgttgagtactatactgtttctctgcctgaaaatgttaagaagcaccaatccactgatatgatctacaaaaaggcccactccgtggaagcctttggccatcgtactgatattagatttatggatatcagcgatgatggcaaattattgactacggcatccaatggactgttaaaggtctggaatgtcaattctcttaactgcataagaacttttgaatgtggatacggacttgttgtgaaatttttacctggtggggcattattagtgctaggaactagagaaggtaacctggaattatatgatttggcaagttctactgttttggactctatccaggcacatgaaggtgcactgtatcaactcgatattactcccgatggtaaatcagtaatcactggaggtgctgataagcaagttaaaaagtgggatatcaaacttgaaatggttgaagttctgggatcgaaagagaaagtggcttctatgtccttggtcaattctagaaacatggaaatgaacgacgagatcttagctgtcaaggttagtcctgatcagcagcttttggctgtttctaccacagacaactgtgtcagggttttttatcttgatacgttaaaattcttcttgaacctttatggccacaaacttcctgttctctctatagacatttctcaggacaacaaaattatcattacttcttctgccgataagaacatcaagatttggggtttggactttggagactgtcacaaatccattttcgggcaccaagattctatcatgagtgtacggtttatcagcaatactcatcattttattactacttctaaggatggaatggttaagtactgggatggtgataagtttgagtgtattcaaaaacttgcagcacatcagtctgaagtatggtgcagcgcggtttctttggatggttccttttttgtcactgcttctcatgatcatagtataagaatttgggaggaaaccaacgatgaggtattcatacaggaggaaagagagaaggaaatggacgagcaatacgaagaaaccttattggcatctttggaagaagacgaggattccctggccaagagaaaagaggaaatcgatgaagttactggagtcaccaaacaaacaatggaatctctgaaggctggtgaaaaactcatggaagcattggacttgggaactaaagaactcgacgctcaagaagaatatgagcagactcttgctgctttccaactgaagaagactttgaaccaaccaataaagcctactcccaacactatcttggtcgtcaagaaaatgactcctgctgaatacgttttgagtattgtacttgccatcaaagcctcccaattagaagatgcgctactagtcttgcccttctcatacacaatcaagcttttcaggtttatccagatttggactgattcagaaaatggatcaaaaaatattgtcaacttatctaccatttcaagattggtcttcactctagttagaaacaactgtaaggagctgatttcccaaaaggaagataagataaatcaattgattatttctgttagggatcagttaaggaagcaattgtctctgagtgtcgacgacattggatacaatgtcgaaggacttaagttcttgaaagctcagtggaagttggctcattctacagagttcatcgacgaagaggaacaaaaacggtacgaggaaaagcatgtccaaaaaagagtgtaccagacggtagaataatagttcactttgcattttcaatatataccaactgattcacattatcaatcaagctcacttcttaatagtacatagagcctaccacagcacagatatcccaattgacaagtacctatgatatccgatactcgatcgcaagtggtacatgtagtacatagttcaaccgttcagctgaaaagacccttagtcatctctcgttcattccggtttcttgtgtgataatctgtgcatattgccgtactggccatagagggtgacaaatctccctctattctattacattaaacggtacagtctagttacttctatttatacatgatgcccatctccaacggtagccagaagcccttatcattagtcatttgcgtaatctgaagacacgataaaaaagtggtactattattcttactgtgtggtattaatttgcggtccttcgtttttgggagtagtagtagcaaggaccaccttcaccaattttcttgcttaacttcctccataatttctggaaaaatgaattaccctcataatcgtattcaaccatgtcttttcttctcggtttgatagaacaagttgatccttgcactgaagttgagctacagagcttattacctgatcttaaaacgtccgacttcaatattttttcgactttttcccgtaggatcatttccagttccatttctctttcgtattttaaaaagtcgtttgactctgggtcgtattcaatcccacagtctgtttggtctctactctgagttgcgtttccattcgaattgacggattgagatgtctcacagtccatcagtaactgtccacatgtctctggcaaagcaatgtatgctttaaaaaatttggtgaagaaaagcctatcgttgtagtttggtagctgatccattagccgttgtctttctaatacgttcacccctcttaatgtttgctctatgtcggcagtgtcgatcgtaatgccatctttcggatacgtattaggatcgggtgggacatcaggcatggatgcagaggggccaaaaattggactgtggtttattgatttgaaatcagtctctcatttttttttgtcaaccttgactttggtagtgtgcaatcaaaggccttaagacatggacaaaacgtacaagcaaatagaaggcaagactgaacacagtaaagatgacaatacaagcaagtgaacgaacatcagaaggtctatatagaaatctacatacagtgcctgctatcgattcggagtgttggccctatggttagccccaaccgccctttttaatacattctacgcattcttttcccttcatggatgacatggactcatctcaaccaccaagggcgagcgtcaggaaccaacagtgtaagggtaacgacactccaaataatcagacccaataggcaagcctatcaaggtgcagatcacccaccagatacttccttcaagaaggaaatttccaatgtcccagaaccaaaaataaagtaacatttaaaagccatatatgatatgacatttcagctgttacactgaaaagaacagatactacacttgatctaagccaaaaggcaaagagatctaaggaagggaaaaaagggtttgcaagggattcaagctccttttatagttttcgagggctggggccatagtgaaaatcctccgcccttggtcgtgcctccccagtttttcaccgtcatccgggtaactggtaccacatactacatctcacagaaaaggaacctatccaattcaatcgcctatcatatcaagagcgccatcctttagcagccaagttggaattattaagtctggattcacttgaagagccatgtttgaacagcctcaagttgaactcagcagtgagcagatcaatcaggagcagaaacgggccctagacgcgatacgagtatttcttcagagcaagacgtcttacgatgtgttaccagtttcttacaggctgatagtgtttgatacatctctcctggtaaagaaatccctcaatattttattgcagaacagtattgtttctgctcctttatggaataataagacaagtcgttttgcggggcttcttacctcaagtgattttatcaatgtcatccaatactatttccaattccccgacaaatttgaccttgtggagaagttaacattagatggattgagagaggtagaaaagagcataggagtttctaccattgaaaccatctccatacatccattcaaatcactttacgaagcttgcgagaaaatgttagtatcaaaagctagaaggattcccctgatcgatgaggatgaaaatacacaccgagaaattgtagtaagtgtgctaacacaatatagaatactcaaatttgttgccttgaattgtaaggaaacccgtatgttattaaaaccgctgaaagaattacaagtcggcacaatggctgagatgtccacagtgacaatggaaacaccggtcattgatgtgattcaccttttgtctaacaaatgtgtgtcttctgtgccaattgttgacggggagggcaagctagtcaacgtatatgaagccgtcgatgtcttaggtttaatcaagggaggaatgtacactgacctttcattgtctgtcggagaagcgcttatgagaagagctgaagatttcgaaggagtctacacatgcacattgaacgatagtttggcgaccataatggaaacgttgcggaaatctaggatccacagacttttcatagtcgataccgacactagcttgttgggtgttatcacattgagcgacattttgagttatcttcttttcagtcaataaagataaatgccaccaaaatacgaattacatttaacgaaccagtcacactatcaataaatcaagagtttatttataaagaccttttctcctttgcatcttactcacaagtcttacttttctgtcacgtgatatatcacaatctttatggaataggctctgtgcctttgctttttcgctttctctctatctcatctcagattactaaccatggaagaaaatgcccatcctagcccgtttatgtcaagaccctaagccatgggaagaaaaaccttcacttaaacagattacgcccagaagtatcctagcaggtcttttgattggaaccattgtactcacttccaattttcagtttgggctacaaacaggatgggtatcaatgatgtcacttccttcggcgctgttggggtttgctacgttcaaggccctaagtaagaaactgagttatcccttcacggacgtcgagaatgtttttgttcaaagtgtggcagtcgcaacgggaaccggtcctttagcttatgggtttgttgggatcattccagctatggaaaaattcatgactgaagaagagagtggactaggtgctactttaaaactttccttaacccagttgattttgtggtcactgggtgttgcattctttggagttttctttgcaattccgctaagaaaagaggtaatcatcagggagaagttgagtttcccatcaggttcggccacaggaactctcatcagtgttcttcataacacagaactatacgaagacgggaataagatcggtaccgataagggtaatctccctagccaagataatgatgaaagttgctcgcatgattctcaatctaagcaaggaccggcacgcaaaagcaatgagtcagcagggtcagcagcagcttattcaccactgaacgattgcactgttatcgaatctcaagacttagtcactctgcaaagagttgaagcctacaaccataatattcgatcattggtttcaaccttcagtgtttcttctgtttatactatattagcatttttcatcccattgctgaggcaggttccgatatttggtacctatctctccaagaactatttgtggaactttcaaccatctccggcttatattggacaggggatgatcatgggattgccatctgtttcttatatgttgtttggatctatactcgggtggggagtattggcgccattggctcaaaaactagaatgggctcctggcccaatcgatgactggaaagttggaggacaaggatggattctatggattagtttggctgttatggtgagcgattctgtcatcagttttttggttgtgactatcaaatcttccttgaatttctaccatagaaggtatgctaacagtgaccaggacagtttgccattacttaacagcgaaacttcatcaaatgatgaaccaaccaatagcactaatgagggaaactctcttcattttggtgatgaaccgactaatagcttaaatgaagaccactctctgcatttaactgatcccatttctataattgaggatgaattaaacaccccagacacgatagaagccaaagatgtggatgaaaaacacttagtttccaccaacgctgcaaccataggtgtactcttatcctcaattttatgcatcgtcctcgttcgatatgtattcagttcaattgttcctatctacgctttggtcacagcagtgatacttgcacttttcctttcaatattggccgtcagagctttaggtgaaactgacctaaacccggtcagtggcatcggtaaaatttctcagttgatatttgctctcatcatcccagcatctcaaccaggcgctgtattgatcaatctaatagctggaggtatttcagaagctggagctcaacaagctggtgatttgatgcaggatttgaaaacaggtcatttgattggagcttcgccaaaagcacaatttgttgcccagatgattggctcagggtacagtgtgttactaagttcaatcatgtataaagtttatgacagtgtctacgaattaccaggtccaatatttcgcataccaactgcaattatttggatcgattgcgcaagaatagttaacgggaaaggtctcccgcctcatgcgctgaaatttagcgtgattttcggactgatttttggaattgtagctattatcaagaatgtaatgccaaaatctcataagtggcataagtttttggtgtacgtcccatccggagttccagtgggaattggtatttataacactccaagttttacgctagctcgattcattggaggtattgtttcttacttttggatgaccaagacacgtaatagtcataactcaaagattcaaatgattgtgttcagtagtggattgatattgggtgagggggttttcagtgttataactatgattctaactggtttgggattataaaaatgttctataatggataaaaatagtttgttccgtttttgatgacttatttattgacactttttagagacattattgttattattattattattaatcttttgcacttgccgttttggcttctctgtaattcttatccttattttgatcaactcttgcaaggaagtcttgtttttccaagtagccacccttattgtgggttttaagctgagcatcaataccatgcttatcgacgtagcgggcccaatccaatcttgatttttctaaagtggaaagcttggaggcagtagggtcactgatgatcttgtctatcagagaaggtcgtttcctcctaatcattcttttaactactttgccatcggatagtatttgcgatggattgtaatgcgatctgtgaattggctttgaagggacatttttgagctttacagagttcaagtatgcttttgcctctgccgagttgacatgaactttcttggtctgaaaaatcgtctttcctgcaaactcgtacgatgtttcaattgtaatcatctcatcagggctgttagagctggaatcatcagccttgtcatcatcagcagtactgagtggcgattgctttttttttgtgtttttactgtcctttctcaattgttcccataccgagtctatatcaacagatggagtaagagcacggacggctcttttctcttgtttttcgtgtttttcggcttctctttgccttcgtgtcttgataagaccgcctgcagataaacctagcttatcgaaattggactcttgttgaaagtcttggtcatcgtccgaatcaccgttatcattatcattgtcttgatcgttcttagctgtgggatcgtaatcataatcttcggattcattgtagtcactattttcggatccagtggttactctgccatcaggagcatcaatagaagtgtcctcgtttacgaggacttggccagtttgcgtgtccttgctggaagccatttgcattttgttcaagggaaaagtccaggatccatctgtgtgaatatatgttattgattaggaatcagttcgcgaagatcttaacaagaaaactggaggcgagtttgactagggaccactgaccattgactggcccaccataaaggtgccaagtgcttactatataaccacgtcacgagtatcataaattcatatactaactttgataaaaaataattatgggcggaaaaccaacttctgagctgaaactttgccatccttgagcaagacggctgcttcctctgcatgctccaatccattgcccaatatcttggcttcaataggaataatttccccattgtgaacatacttagaaacataactccaaaattcaaggtggctttctttggcgccaggttcagcattgaaatcaaaaccaggaaaatgttggtcttcacctagagtggtgtaggccaaggtactggacaacttaacattcttgttcaactcaacccctagctcggtcaaagcgcttgggaaaattacctgaatgttatccagataggagtgtgctttctcgggaagaacattgtaagcttctttgtaaaggttttcatcaccggcagtcaggtaagtgtatgtcaggtcctcgcctgcaaaggccttgatctgatcgaacacatcagcgtcatggtagtcaaaaactttatctgcaccaatagcttgtaatttttcaaaattctttcttgaagccgtggccagcaccttcaaaccgtagatcttcttcgcaacttggatagccaagaatccagtagctgtggcaccacctaagatcaaaatgtacttggagctgttccctggagccttttccctcagtccaaaaaagtgatggaaagagcctccgatagtgacgagtcctaacgtaatagtagctgcagcctcaaaagaatcgatcttacctgaaggtattacggtatcattagaacgggactttaggctcttttgataattaagagaccatctggagtctactacggcatattctttaaacagcccatcggcaggatgatgctggtaaccaccatgagcgaaggaagagacatggtcaccaacattgaagccttcaactttgggaccgactttgaccacaacgcccgaagagtctgtaccaacaacattgcccttgactccccaaccaaagagagcatgtttccagtcagttgggttagcagcaaaggccttttggtggactagtaattgatagtcattgagatcagtaattgtggggatctcagttacatcgaacaatggacccttttgggggtcagcggaaaggacaacggccttctgggtggaagggattgaagtcattaggggaggatatactttaagttaaggataagttatttgggattcaagggctggaaaacccaaagggttttatacatagttgaaattactaatagatttccaattagatcgattgcggattgctactgcgaattgcgtcttggatgagtaacaggcttagtcagattacgaaacatggcttttatgtcagcgagttttcatgtgaacacgaatagctactacctgtctactctagaagatctagaacaatctggtgagtcgaatagtagcgagtttctttacattttttgttaggttgaacttgtccaagaaattggattcctggaaactcgctgttagttcttagtgttcaatgctatgattaataggtgatcttgaacagaaagccaaaggaaatccaagttgtcgcaacggtctgtaagtcaagagggcgtaagcaacttttgaagtcaatttcctgtaaaacgcacatctctaacgattgaggcatagaatgtcattcattatttacaattatattagctatgcttattgcaaaaataggtcaattggttgctggtgaattcttcttcattttctttccagctgctgtcaatactaatgggagaatgacattgttcacaactatccaggcaactaaaataccaaagtgttttccaaggttgcccttccaggtgttgaacaaaactactctggcaatagagtatgagttgtaaacgggaagtgcgtaagtgatcttgaagacaccaggacacaaaataattggtgaaaaagtagctgaaatgttcaaaatcacccaagtcatcagccagatagccatcaatggtgggaaaaacgctgttgcgataatagccacattctcattggcaccaccaacagcagccatggtcaaataattgcacatccaatagactcccaatcccccgctgaatgctttgtttaggtcgacttggaaggctctcgtaatcaaagagtaggccagactcaaaaacagataaaccacctgagagaatatggctcggtatacgagatagtgtgaaggtttcaaaacttgtgcagctgcaccatgaactggaccgaagaatgcaaactggaaaaatgtgattatgatcatgaaaatgagaccgacttgttgtggtgcttgaataacagatgacgacgatggtcttctatcaatcgtgttgaagctcagctgtttgaagagcaaaccagactcaatcagagcttcctgttgcgtaacgtttgagatgtggttttctacaataggtctgttgacagcctctgcggttcgaattgtcacctcctcctgtaatctcaacaaagttggcaacacatattgggagattcctgtcaaatctcttccagtttcgtatatggtaaacagtagtgttgcagtggtgttgaaagatgaatctccgttttggtaagcggcgatcaactggcttgttgcagtgttgttaacataaattccagcccaataattttcatgataaatatcggtttccaacttctcgtatgcatctccatcttccccattcaagtattgttcatgcgtaaaaacattccaggtagctagccgaggaaaatttccagaatgaacagtttcgttgaccaaattgctgatgtaattgttttctgtgtcatcttccaagatcacagcaaattgcaggttcaccaatcttgtatttcgttcatacatcgaaccccaataaatggagaacacggaaaacatgaatagtagcaaaatgatcagtgttatgattgcttttttaccaagatctgccctggtagcttttaggtgagaatcaaagaaagaatgcttggtgtgccttagtgacagctcttccgtatctaaaggcttttctggagagaagctttcagcctcactagtttccataccatcgttcctgatagcctcagagtcattgctagtcatcataacgtcatccccaagactcctacttcctttttcgtttgtctctcgatcgataaccttcatattttgtgttatgttattctcttgctccagtcaaatttagagggatagattcctatttatccccccgcaagtgacttatataacaccaggaaaaattcgaaacccgaaacaaagccggccggatctttttccccctgctggagttcctgcactgctcggggctaattatgcagctcgaccgatcgtttactatgagtattactaatcttcctgagcgcgggtctgctaatccccgaacatcaatcgggttatggaacggaggtgagagaaatagcttaaaacgtgcggctgaaaaccagaccaacaattgatttctatgtatgttgggtactgattaccttttcttactatatagccaattgatcagatcaaaaaacatccccggctgagtcttgtttcctggagttctgtaccagtttagaaggctcatagtgtagatcttcaagatatcctcaataagagcatccggatctggcgacccacttaataacgtctttacgataaagatggatgactggttgcagccattgctaacggctttgattgtcgatttagatgcaaaccgttgaatctgatccaaagttcttttcaagtcaaagatttgctcatcagacagcttaacttcaatccgggctcggcagaccttagtctttaacagtttatgtgctttttctccaagctgcaaagtgttagttctggccatcaaattcaataatggcataactatttcgacgtttaataggtctgtacttcgtttgctgacaaaagtgtccaacatatccaaaattcttcctttgagaaacactacggtgtccttgtcctgtttttgttgctttttcttaccgtttccttgagatatcagtgcatgttgacgttccttgaagatgtttgccagcgttgcgtcgatagccatcatttgctcatcgtccatagacacatcctcagaatcttcttcgtaggatgagttttgaccagaatttgtctcgtgttgctccgctacttttgaagatagccccagcacttttgctaaagcttcattggttttcttgtcgatttcatctatgctgacctcgcccttaacactttcccggtcttcttctccattttcgttgtcatccccatcttctccttcgccctcgtcctcgtcttcgtcctccacctcttcattcttattatcgaacagtttttccttaccttcttggttctcttgaaccttcaaaatatcaaacaaagattgcaagtgtgaaagttcaacctcattaacaatatgctcccagactaccaatgccagcttcttcatcaaggaagagtcctgagatacaaaagagacaataatctcaaccaaaatttcaaccccaacgcgctcctcattcgaaaccatcttgtcatatgcagtgctgatatcttgaatcatattaatggagtcggcatctccggcgaagacattgagaattgccagactgtacaatatctggaaacaaacaatatgcatagcttttttttcatcagaaatgtccttcagttgctcttcaagggtggatagaatttcaagcccctctgttttgaactgttccaactcgtcgtccaggctatgacgcagctgtaagccggagttcttttccaaatcaaccaatttattgacaatataagtgggccaactgctaccatcagtcggaggttgagaaagcacttcactgagaatggagatcaatctttcatatgccgtatttgatatagcctcaaactcttgagtgttgggaactttgaaaaaagaaaccttaattaaatgatcaacaatattttgaacccaggtaatgttggtggtggataaagatccctttttatctctcacaaaatgaagcaattgatctagtatagatagataatcttgaaggaagttagcataatcgggctgtagtgtgttggcccaattgatgataaagtccgttacttcatccatcacaaatccatcgctgttgtcaattattgttgaaattgttttggtcttgctcatacgatcaaatttgacattgtgacgaagcagagttttcaaagttggaacgacaaactctgcttctttacaaatttcacagattctagccagaacctttctagccatcttgttgagctgtctatcattatttgcactttgatggattagattagccattaagtttggagagaataaaaatttcacgtgggaaggctttaggtccttatgttctaagacagccaaaagaacagagaaaccccaatactttttttgagaggaagaatcactactgaagaaattttcatcaataatgggtgcccagaatctctcaagagtcagtctttcttctttatcggctgctctttccttgctcttctttttcttctttggtggttcatcaatggaagtgtttataagttcatctataatcaaagtccagacagtgtgcaaatttggagtccatcccctttgttttcccttctgatcttcatcaacagcgccttgtcttagtaccaaactcaactgaggtaaatttttcaccattaaagggttaccttgactccaaagttggtctccattttgcttgtatgcatccgtagaaagaactaatttcgacctagctttccatggaatagtcaaatgcactaaaataccttctagggataaaatgaccttattctcaagcaacgtgcttaacaaatagttgatgatttcgaagtctttaactagatcatactgaactaatagactgcagatagtactgaaacaagtttcccttaaccaaggtttggtggaacttaatttcagcaatcgtcttaatatcatctttagagtcgaataatcgtcatttttcacaatcttcgagttcaacagggcctggatgccgaataattttccaaacaacgtctgtttgtcgatcttcccgtgtttattaggtgctactttctccagtactttatacagctcgttcaaatatgattcgacagttatatcccctctgcctataagtagaacaatcaactccgatagagccaaggaaaaaccaactctggaggacgctctctctgaactaagtcctttaatcaatcgattcaaggcgtagtcgtagtctttttgattgtcagcctccacaagctctttaagaagactactagctcctttaatcctctcttcttctaaatcagaggccaggtaatagtaatgatccagagacactgaagacattatggtaactgaagaaaaaaaaataaatcagatcctgagaaatattttttgtgagagagaaagttagaggagaataaccgtgctaaaacaaccaaaatgctcaaagaacaactgacttaatcactgggtttccagctagaagactaggattgaactattgcagggagtgccaggagtgaagggttaagtggcagagcacttcaacatatgaaaacaattacgtaagacgatatttcaagaggagatgagattgacttaaaacgctgaaaaagagaataagaaaagcaagaacaatgcaaagtcaagagaggtatatcacttggcggtcaagatggagctggataccaatttttctagtttcctccatgtatttcaattactagggccttccaatctaattcaaatctaccgactatataatgaatttacatccttacataaggtagtgtattaccaataatacctcgccaatgaaagtcgcccatagttcaccctgaaaacttgtctactctcaaagtaactattaccaacaaatacaatcatgtcgtcttggcaaaaagctggtttctcgtaagttgccactaggtgtatcattgtttatcacaccgtctcgttactaactttcgaagtttcaacaaatatctgtcaattgctgccagaactgtcagaaaatctctgaacagcgacatcagagttgctgctgaaaagagaggaattactgatcttaaggctcaagtaattgagaaaggtgacattaagtcaactgttgagctaggctctagatagacaaatccaatatatcagaagcttgattttatccaagtgaaataactgcaaaaaacagatatgtctcaccaaattagctgatggaaggttttgccgatgaaaaaagacctttagtttagatttaattgactttgaaatggatcaacgcaagaaacgtgggcattatctttcactgggttgaaattctttttgatctgaatagtgcgtcttatccatctgctgaaaagcccaaattgtggtattggttgtcttgcaaagttcacttttgtgcctctggattctcctatccttcataccgcttctttggccttaattaatagcctctcttgtatttccttccgcccaggtccttccatccttactactcatggacccctcgcgttcgtatcaaatattgacttcgcgaagccacgccgttcttcggtctccagtaaatccaaggaagtcgttattccttccctatactaaatggatctatgctttcccgattattactccccagaaccctccttctagccaataggagaattggagcaagtagctttggtagacggggtgttttgaatggaggcatttctttctctgtattgaaacctgatcgggtatgccgaccccagagagtcatatttcaacaaagattttttggaaaaacgtcgacgaatagagacagtcaggaaaaatctcccacatctatttccaaacagattcatgaatcaaaagtagagccagtgaaacgaaaggatgagattgcgcccgtcaaaaaggagttggcaccccagaaagagactaagagctggaaagagttaactcgactcctatttcttgcaaagagagacatcaagcttttttctctggcagttattttactttttacgagtgcagccataatgatgagcttacccaggatcacaggtcaagtgttggatgcgactagaaagtttccaagtataggtgatatcgagatattcggactgggtttaaactatttcctcatgaccatgatggggctccttcttgttagcaccgcctgtactttcggccgtatcatcatactgcgggtcctaggtgaaagactagttgccaggctgaggtcaaacatcatgaaaaagacactaacgcaggacgcagaattctttgatatacataaagttggtgatttgatatccagatttagcggcgatgcttacgtggtcagtagaagtattacacaaaacttaagtgatggtgttaagcactcgattgtgggagtttcaggaataaccatgatgatcttgttatcctcaaagttgtcgattgtgattcttggatttgctccacctttaatgattggatcgtacatttatggtaagaaaatccgaaaaatatccagagagttgcaacaggccactggttcactgaccaaaattgcagaagaacagcttaacagcattaaaactattcaatcattcacaggggaaacaaaagaacttagcagatataattcccaaattcgaaatgtgtttaagattggatttacagaagctaagacaaatgccactttttttgcttcgactgatgttgttggcaatggaactttccttatgaccttaggttatggaacatacttggtcatgggtggtgagatgactgttggtgacttgacagctttcatgatgtataccgagtatgctggtagtgccgtgtttggattagctagcttttattctgaattaatgaaaggagcaggtgctgcatctagattgtttgagcttatagacagagaaccaaaaattaaaaacagtgtcggtgagcaaattaagtctgccaaaggaaacattgagttcaaagatctttcattctcatacccaacaagacccaaaaatctaatttttgataagatttcattcaaaattgcacaaggttccaacgtgtgtattgtgggcccatctggaagagggaaatcaacgattacatcgctccttctgagattttacaacccttccagtggccaaattcttctggatggtcaggacattaccaaatttagtgtccactcactacgaactttactaggcgtggtgcaacaagaaccaatattgatatcaggtactgtagctgagaacatcagatacggactacccaaatcagtccatgtgactgacgaaatgatcattgaggctgccaagagagcaaattgtcacgaattcataacgaagtttaccgaaggatataataccaacatcggacctagaggatcgctcttatcaggtggacaaaaacaacgtattgctattgccagagctcttatcaagaatccagttatattaattttagatgaagctacatcggctttggattccaaatcggagctggcagttaacaatactctaacaaagctgatgagagatcagcaattgacaactatttccatagctcatagactatccacgatcgagagggctgatttcgtgctagtcttgggatatgatggaaaattggcggaacatggccgattccatgacttgtattccaacaaggattcgagtctttatagacttctccatgagagacaagaagagattcccgaagatgatcaacctacagcgcaagagtctgagcctgactctatttcagaagaagagtctgagacgcgaaacgaaatccttgctgaggaagaagcagaaatggaagctttgcagctaaaagatgagctttcgatacaacaaccagaagttattcatgaccatcgcaaggaagataacgacatcaaacgttaggaaaaaaaaatgatcaggctaataataatattctctgatattttgtatatatgaagatagacaaaaatgaaacatgcttacataaccatattttatattgtttacatgtcgcgctcttccctactctgtttgttattcttacatttctcttcacataacccgctaggatctttcattttccatggtccaatgtcaatatctgataagctattgtcgctatgcaatctttcctttttagatgagctgctacagctacagtttgaaggagcggacggttcgagtcttgcaacatatgatataaagcgaatacagcaaatagtcaatgacgttgacctgtatttgacatctgtggataaggtattcaaagggtttgaccctgaaaaaaccgaactgaaacttttcattaaagacagagatgaatatatagaatgtttctccaaggtggattccattgacagtgtcattgctcaattgctaaggtacctggagaataaaccagatattaagatagaccttctgcttaagcgattgaataacacctgtgaacaactaatggaattgaaacgaatcatctatccgataaaaaagcaattgaacatagcaatgcattattacgaaataaacacagaaattttagatgtgatactgagagagattgaagtctgcgagaagagatcgttcaagattcatgagctacgcttttcctccccaatgcgacttttcccacatattgacttggatatattgaatgaaacaatgcgaaattctctacaattacctactttcagcgagacagatcaagagttatatctggaatataacaaattgacagagaaactataccctattatagcttcagtggaatacattcctcctaggttgaatgaatacgaatctttggccaagagatatagacctgagactttaacattcctaggtgagaaatacttgaggattggttcaagattagagaaattagtcggtcaggtggaggacctgaaggaggagctgatagataaaagatgggatgagttgtttcgttatttgataggagaacttgataactacattaatgacattgagaaagagttatttgttcgaaactgcgagtcgttggcacctatgtgcaaatacaaaattgatatcgtattgtcgacgctcaagttattgagaagagctattggagagaaactgttggtagaaatttcattgttgcaaaaatacaactcacttaataaaagaaacattcgtatacatgacgaattatacaacagggaccttcactggatgttggatagctttcagaaacagaaagaggaaaacactatcatatttgatggcaaagagcagcaagaaataccagtttttagagaagagagggttgccacaagccgtgtcagcagtagcaggttttcgagtagatcatctgcgcacgatctggatgccatgtttccattaaaacctacaataatagaatataacccgcaatcagctgagaaacctatagtggatttgcttgctgataaccctcaaacgcccgattcagtttcggtgacaccgttgagagaaactttgaaacataatgaaagaatgtttagaaatgttgatacaagaactctacttgaccaatttgaagcgatgtctgtttccagcgaaacaagaaaagaaagtcccctatttcaaagggtctcgcataagagcagcactaataacgaaatggggaaaaaccaatcggcagtctacagccctgctatgagtccatcaatgattccacgaagaataggatccagttgtaattcccggccaacttctgctctggcctcacgtccatcttcaagactttcatcatctagaccgatatcaagaccatcctctagagcgagtggccgatcttcagtgctcagagtcagtcgtccgccatcgtcaaaaggctctagaattccccaaccagtatgctccaagtcaagaattcctatttaccagggcaaaacatccaagtcatcacctgcttctttgaacttcgaacgttctgtaaaaaagaatagtgcagccgagaaacctagtttcaagaaaacaaactaatcaagcggacacaccaacatccgctgatacataaccaataatatcacatatcatctgttacctttctccaaaaattcttgtcaaccaactattcttgtgcacttcatacttttcatactcactgaactctctcaaagttccatcagaaagtatttcaccctgttgaatcttcctttctttaccattgaagattctctgataaagttcgtatcctgggagaataaccaagggcagtccaaaaataatcagctgtatatatcgccctctctggataacttcttttggaagcgtttttttccctgacatttcaacctcttgccaaagtggagagcagggatgggaccagttggatcgtttctgaataggaagaaaataacaacctaacaccatcatctcgtctttgatttttttttttcctctaatctttttctctcttacttgaccagttgatacttaagatcaggccaactttcggtataccaatggccaaagctgagaagaaatcattttcaaacggcagcaactcaaaagggctttcgttgaatggcccaaaacaggtagccgccactaatagtgtgttcaaattcaacacccagttaggacagcatattcttaagaatcctttggttgcccaaggaatcgtagacaaagcaaatataagaccttctgacacagtgcttgaagttggtccaggtaccggtaatcttactatgagaattttacaaaaggctagaaaagttattgcatccgaaatggacccacgaatggcagcagagctcaccaagagagttcaaggaaaaccagaacagaaaaaactagacataatacttggcgacttcataaagcaggatttgccctactttgatatttgtatctctaacactccttatcagattagttctcctttggtattcaagttgttgaatcagccaaaacctccaagagtggccatcctgatgtttcaaagagaatttgcattgagactgttagcaagacctggtgattcattatactgcaggcttagtgttaatgtacagatgtgggctaacgtgactcacataatgaaagttggtagaaacaattttagaccccctccacaggtcgagtcttctgttgtacgtattgaggttaagaacccaagacctaacatcgatttcaatgaatgggatggacttttgagaatctgtttcgttaggaagaatagaacaatctctgctggctttaagaataagtctgtgattgaaattttagaaaaaaattacaaaacttaccttgctacgatagctgctgagaacaaccagatgtttgtggaggagccagataacaacatgactgacctgatcaaggaaaaagtcaatctagttctcgaccagacaggattttcggatcaaagagctggaaaattggatcaagtggatttcttgaagttgttgtacgctttccacaaggtgggaatacattttgcatagtttcaaaatgagggtttaatggttttctttactgtaatataatatacatcatcgtctctttcctttagcaccatctctttctacaacggaagtgacaccagcttcttctaagttgtcttcttcaattctaatagcttctcttctttcccaccaacgttcctcggacaattcaaaagatttggttttcagttgcttacccctagcatcaatattttgagagattgcccattttaggaattcggcgcctgttctaacgtagaaacttctcagggactcaaaaggtttaggaataggcaaccaaggagtaggatctggaatctcagcttcttcatcctccatttcaacatcatcagatgaattttggttgattcgaggagattctacctccaatccgttattggcagtatccatctcatcgtcttcactctctccatcttcttcatcgtcgtcatcatattcatcttcatcttcatcatcctcgtcttcctccctaaatgtttccaattctgacaaatcttcaaaaaatacttttactccatccagtttagcaagatcgattgaataaaaagagtacaagttaaactcatgttcacccttttcaaacaagcctccaaatatatacaattggtcaccgagaacagctgtggtggcattgaatctaggatggggaagttgggacgaatacacataatcaccggcttcattctcgtcctccttcaacttagatgtctcagcagaagcactctctggcgtttcactagatggttcattatcattcaggttagcctttgctagaatttcattcaaaatgtcttcaagatcttcatccctagacttctctttcaccgccgcttgcttgactttcctgggtgaacgaagggacaggttgtaccatctgttggtatcagaattatagctcagaagcgtgttatagaactcagaatccaaagattcttcggtttcttcataatcgtaaactccaccaaatagaattcctcttcctttgtgatattgcatggaacatccaactcttggcgagggctgaaatccttgttttcttcttctctcccaacgaactcctttgggatcacttttcatttttagtgtccaagtgtcaaccagagtctttcccttttggagacctcttccagccttaaccttgcaatatccaccatataaaatagcaccttcctcgttcgcaattagggaatgccctgaacgagcttctggaacgtcatggtttgttgggaactcaacttgttgccatttgtaagtagtaatatcaaacaaccaaacatcattcagatacgtggtactggtaccgaggtcattaaatcctccatgaaggataatgtagttcttccaataagtcattctatgcccagatctagatggcggagcctgacgaacgtctactcgggaccattctttagtggcggtgtctagcatccaggtgtctgagaaatggtggaaagtggtctgctttggggatgaaaattctccaccatgcaacaaaatgatcccagaagggtgataaaccatggcatgagatgaacgcggtgagggagacgtctttgataaatacttcttccaggtatcgttatctgcgttgtaaacatgtaagtcattataaaagtgaactaatccgtccttatcggtgacttctccaccaaacatgtataattccttcttaccagcgttattgcacccaaccatagccgtatctcttcttcgactaggtcttccaacagtctcaactataaccttttcaagattctcttgttctttggccaaagcactgatcacctcctctaaattaacgttgtcttccaagtcgtcatcaccctgcttcttggaaagtttcttgttcttagcctcagccttcttctgagctttggcatttttctccataagtctagcctttttgctatccttgtttttcttgttgtctttctttgccatatttcggtcgtaaacttggaaggaatgaacaaagtaattgagaaggcagttccttcagaatttaccctctaggttttccttctagaggaccctattgttctagtttttttttctccccatcacacgactgactctcatggtcgagaaatctagtagattctctcaccttgacaaacctcagtgaacagttcaccacccactgctaaaatggatcgacaacttacccaagctgtagaaatagcgttgagtgggacatctgatcaaagattacagcaagaggtaagtagagtctaaaaagacttctttttctttctaatttgtctaaatactaacgatgcaaggctattgatttcatcaacaagatcaaaacttccgatgaagggtggcaacattgtgggaacctattaactagtaattttgagcttgatcaacaaacaaagtttttcatttttcaagtatttgatgagaaaatacaagcattgaataatgatcaactgctaatactgaaggacttcctaattatgtatctgactcatatgttggaaaatggtattattgaacctgtatatctcagaaacaaactagccaaatcttttggtctgttgtttgtctactcttatcttactgtatatccggaattcctcagagatctccttcagacaacgaaggatgggaaccacttagcagtggattactatctccgaatcctgctagttatccatcaagaaattggtgacaatctgattattagagaaagatcaagcgtggaacacaataacaaactgaaagaccaaataagggcgaacgatatgttggctttgacactctcatggaaaaacatactacagcgttactcaactccaaagacaagcacaactgatcctagggatcaattacaaggagaaatattacacaacagtttgtctgccataagtggtttcatatcctggattgagataggtttaatcatggaacaagaattccttggtctgatttttcaaactttggaaaccagtgatcagcaactacaaattggagtcttgaactgtttgaacgaaataatttccaagaaaatgcctcctttaaagaaattggaactacttaacttattaaacattaccaacacaatcaataatcttaagttcgaaggcctctctgtggacttgatggaggctgtcaccaaattaatcaatacagttggtgaagaactgattcgcattctagatagctcttcgattgaagagttacaaaaccaacaattcaaaaatgttacgtgcgccaaattagtggaattattgcctctggtttgtgaattgttgggccatgactatgacgatgtttcagttaaaattttctcctttatagccaattaccttttgtttttgaagaagaatatcaccaataatgcagttgattttcaggttcttagctctgacgaaattttggctactcttttgaagaagattatagagaaaatgaaaatcgacgaagatgatgatggagacgatgatgaggcaatggaaagcttcaaggaggtcagaaacaaactgaaaaatttccaagagtcaattttgatgctcaatgagacgctagcattagacattattaccaatgttatcaaccaatcattgtttagtgcaattgaagcttcaaatataaccgttgactggaggaacattgagttgggattatttgaactgaacagctataatgagcttttgaggaataatgtcatgaacttgcccaagacgatgattaataactcgcaaccctactatgtgttcaacgaaatgctatgtaaggttatcaatcattctccaaaagtgttggtgaaccatcaattaattcagttatccttttttgagctaattctgaagaattatagctttttcatcaacacacatattcaggttgagaaccaagacaagaatgaacttctactgaaggtcttgaagatatttttgtctaattttggtgtgtttaacgatattggtaaagtgaaatacagaacctggtttgttttttacagattcattaaattgaccaatccacgagtcccagacccaacattagaggatttgattaatactttgctgcctcttcttgacctacaaaggtccctgaacgaactaatcagtcaaccagcttgccaaggaaattacgatattgatctaagctctctccaggaagatagtatcgaacatcgcttgtaccttttcgaagctgttggtttactcatttcttttattgacgaaactaacgttgagtttaagattaagatgattgaattggttttacaaccgttgttttcaattgtcgaaagctgcattaacaattgtagttctgctgattcgaataaactaattgttgtacatgctcatcatgctctgatgagtattagttcagttgttaagggatttgaaacctccattacttacgagaagaatgtcaaagttgaagaggagaaaataatcagtaatctacagcagatctctgaagtgattttgattacactggagaattttattcattacccaattattcgtgaggcatctcgtgtgactattgttcgattgtttctgattttggttaagaagccctctctaactcaggatacgattgatgcaatatttagaaagtttttggaagtcataatgaatcaatttgacgaattgcagacgactgaagtaactgacttttttcatttcattactcaggttggtcactattgcgcaggttttgagaatatttatagcattctcaactctcttcttgctcctctttacaacaaggtacttgagcgtttgaagctgttggaacaagagggcgacaaagatccccatttagtgagggaaaagaaagagttaaagaagtcactggtctctttcttcatttccatatccaacaaccatttgacatcgatccttgtgacttatgagaataagtcgctgttgaatgatttgatcaataggttattgaattattcaatggatctttctgattcagctttgtgcaaactagccattggagaactgggatgtttagtcgaaaacataggcactggaagggtgacagacgctcaggatattgggattaaggcaaacaatgcgtttgagaacgttgacgatctgttgatacagaacaccattgttctagtatttgaactactgtttaagagccctcaggttgatactaaggatgctcaatttcgtttgatagtcaccgagatcacaagattgttaagaaaactggtggtaatgggggttgagcagccccctcaaactcaaaaagattctcaagggaataacattactcctctaaaaccaaatgaggctgttttgcaaaatttacagggtttcatggctaataacatgcaatttcccatcaacgtggtaacggacctacttcagaagcttatctcccaacaggagagacatttcagcaaatatctgttgcaattggtcattgattaccggggaacttgaccaaaaaaaaatcaccctaatagaccattggcatctctataaaaaatgaatacatatgattttttttttacagcaatataaatatttactgtatgctctctctcccaccttggagttatgtgacctctgagccaaaacctgttaccaaagaaactcctaaataaaccatagaatggtagtgtgtcacacaaaatatactcgggggagtcaaggtttttgaatagtgccacctttcacatcagcataaagaaaagactgtttaagaaaacaagatattgctaatcaacttattcaaatgggagaattcaacgaaatattgaatgacccctcagttgtgtcgctttctgtggatgacacacctcaattaaacaatgatattcctggcaatcagcaagagacctctaacaatagtgaactagatgtcattacaaagttgcttgaaagcgcatctttagcagctgcaaaggagtccaaggagaagattaatttgtcagttgagaaggaccgtattgtgtacaagccccatgttctattgaaattggccgattctccaatggtggcccaattggcaccaactctggaactgcctgagcaaagcttttggagattaaaatctgcccgcgaggcaactaataataatggaagtttctctaatacaaaatcaagaaaggccaagagggaaccgaagaagcttaaacagcagaagaagaatgaccagcaggaggactcagaaactcctcagtggatgctggataatgacggtcctgtaggtaactctttacaagactttgaggtgtggaggttgaaaatgagactcagtgaaaaaaagagaaatggcattgaagtgactaaggaagaacttgaagagcttgacagattgaccagcggcagcacttcgataaagaatggtatcctcgaagagcctttagaggatggggaggttctagaaccagataatgacctagagactgaatcctcaattcagggaaattctattgataacttctttggtgctatgattggagaatatccttcagatttaaaagatgaacagaaacacaagaatgccaattcaaggtttagttcattgttcaaacctgaatcggaagacaaacatgtctcttcccctgactcagtggactccccagaaattcgtcgtccaaaccaacagcaaacgcaacatccgaatctacgacaacaagaacagaatcttcctcactcacatacttctcaatctcatgtgctaccaattcagcaatcgcagttacaaacaccaccaccgccccaacagcttgcaaaccaatcacatcactcatctccacatccgcaacaacctcaacaccctcaacacactcaacaccatcagcacccccaacaccatcaacaccctcaacatcctcaacatccctcacatcttcaacattcaccacatcctcagcacccacaacaagagcaacgacagcaactacagcaacaacatcaacagcagcagcaacaacaacccccatcatctaatgatcattttttcatgaaccttttgaacagatccaagaatccagatgatcctgctcaaggtaacagatctaatcaaccattacctatgggttatcctcctggaatgcctcctccaaacttcttcccccctggattaatgggaggacatcctaatggaccccatggaatgcctcctggcataccaattccaactggtcagcacggagtgccccctggaatggctccaaatgcaaactctggaggtgcacccccatatgggcttccaccaaatttacctcctaactttatgccaaatccaaacatgcaaaactttgcaccaatgccgttccccccgggcatgtctcctcaacagcttaacatgcctcctcaaaaaattccaaattttatgctcccacctgagttacagcacatggaatccgagaaaaggtgaagttagattatacattaatgtttatccattatggctagcaactctaactacgctagaaaatttttgagagctgtaagaaaagatttagcatctgtatgaactcatctgaaccgctcgacagcttagagtcagtctcatatagaattcttgacacctcaattttttgctctgagttgagataaatattctttaagagaagacatgaatgcaatgaggtcaagatagttgcactattgtagctcttcaagaccagcatgtacagaaattcgtagatcttgtttaaattttttgattgaagagtctctatcagggattgtaccaaattctgaggaatcagacctgcaatattctctatgctatcttctccaaacagcttatgaccagtctgaagaaagtttatagatttccttaaatctccgttggaaatgtctagaatttgggttagactatcgtcatcgatgtcgagctcctctgattgacttatcattttcaaagttgccaacgaatttgcactgttcaaaggactaaatctgaacttggaacatctggaagttattgggtctataattcttgtgatatagttacagataatgcaaaatctagtaatgtgtgaatagttctccattattcgtcgcagcgcgctttgggcatcaaaagtcatggagtctgcttcatctagaataatcagtttgtatgggggacatgggtaattctctttatcctcgggggtgggatttgtgacgcttaatctagcaaagttcttgaccttgtccctcacaattgatattcccctttcatcggatgcgtttagttctagtacccttgatttcatcaactgggggccgaaaagctcccgtgccatggccaaaattgtggacgttttacccgttcctggtggtccatagaagagtaaatgaggcatattcgcagatttgagttgattagacaggactctgatgacgttggactgagcagagacctcatccagctttttgggtcggtatttttcgacccagggagtggacataattggggatcgatggtttaactgaataaaagtacgcgtccagaattatttttttgagttcctaggagggagaggcggaaagaaactccagcgaatttgatattatctgggaggtagaatcaattttccttctcttggcctgtactcaaccgaaccaatctccgatttcaattgcagaccagactcattactctatacttcatcatggattcagagaaagagatcccagagagcacgctaacgttgccgatatcgcgtatcaaaaaaatcattaagatggacagtgatcatgtcagttgctcagacagtgcaacctatttgctaggggtctctacagagctgtttgtcaaatcgttcgttgaagttgcaagtggtaatgctaagattgaaaacagaaaaaagatcacatatcaggatttcagcaaagtcgtcaggacgtttgacaaccttgcgtttttgaacgataccgtgcctccgacaatcaaagttagagatctaatagagacagagactgctaaagccaaccaggcttagagaagtgacattgatgtatatcaaattagtctatttacagaaaaatataagttcagatgcggcattgataggagggaggttcatagttgctaataaactacctaaaccctttcaacataattatgagtaaattccttttcagtctttccgttttccacaaaattgcgggcacgttgtaataataacaatgggtcggttggtcctttgtatggttgaaatagttgtttgatttccggtacattggaagaaacgaacggacgaagagattcgctggcagaagcccccgtcacaggaacgacaaaagtcctcgtacgggcagggtcaatgatgtaagagccatgtttggtgaatcgtccaatacctgaagcacgagtacctttgtaaaagtttttgttaccctgttttgttcctagaggtactctgttgttaccagtcttggattctccataaaaaagagtgccgtctttgtaagttttccatggtcttttcagaagagacccagcagaactatgaaaggatctgatcgattttacttggctcatgggtggtgatgctatcgactaaagggtcaccttcggatttttgatttttgattttcgattttcgagtttttcaaacttcgcgaactttttccacgggtctctaaaaatacttgagggatcatcaacattggcattcttggattcttttcctgcactccaacctctagttaattctttgtctccagtccgtgatgtcgcaacagcaatactaccaacagcaacagaatcagtaccaacctccctatggagctcctcctccccagcagtacggtaacgctcaatatggccagaaccagtatcaataccaccagcctcagtatgctcaacaaccaatgtatgtccaacaacctgctccgcaaaaagataacggctgcggtgccggtgcctgtggatgttatggagcatgtctggctgctctgtgtgtctgttgtgctgccgatgctttgttttagaccaaaaactaccccagataataaattagaaacaatttgaatctttccttcaaccagaaacgatttcagtgatgtgtagtacttctaagtatagtaaaataatctctgcaaagctacacttcctgaaaggttatctaaaccgtggactccatatgagcggccgttggtcgacacctaaaagttgcctcattgctgacagccctctgaagtgcgtgatcccttaccttcctctgacaatgtttacgcctcgatcgctcgatcatttgttcctcgcagaagagaatctgcgtcaagtttcgcttggccatcagcgcgcgcctaacttcttcccccctaccttgcttcggaaataaagggagccccgtccgagcgcagtcccgcgtctccctgttccctctccttctttttggccttctccagatatttctccgttgttccttctctctctctccatcttctcctttttgagggtaactcggtcaggttttctgcaagtaatgaacaatcaaccgaagtcatggcaatttgttccagaagaaatatttgttaccctgatcaagaacatcgacaaccttaacgatttgctccacttatcccaaacatgcaagttctaccatgaagtgattctgaacaaggtctacacaaacttgctatttgtaaactcaaattacattggacctagaaacttttatcagatacaggggaatcaattggtggagaagggagatccagtaagctttactgtcgttgaggaaggggccacaattaatcggttgattgcgactttagaagatgctccaaatttggtcaaatatatcaaacatatcatcatctataccagtagcaaggagtttacaagtcaggtggagaatgatgaattcatcacaaagcaaaacgtctatcaacaattgtatggacttctaatcaacaataataccgagctccgctatttgacgaattttgactactccaaccttcataatgcctcctttttgatcaattcgatcagagatgtttccttaagagataccaaagttatcatgtatgaaaatgacgacctgacctttcacgaagataattcatcatctcattcaatccttcccaaattgcaaaatctacagctattgaatttgtctgatatcgagtattgctcttccattgtgaaattgtcgttgtatctagacaaattcacatatattgatatcaatttatcaaattacgaacacatatttcagaaactggaaattttggaacttcaatctgtcaagacaagtgactactttctgaaaaaattaggtcagcatccaaatgttaaactttccagccttagaacactgatgttagcatttgatcataccgcaaacaattttttcaatgagtttgagcttttggatagaatcaatttgtccaccctgaaaagtttggatctcaaattcaaatgctcatttactgcctgtttgaaagattgtttcatgcatttcatgtacacattatatcaaaaattccaggaacattcattaaagactcatgactcggcatgtggacttgagcaattttcgttgttaaattcatcgatgtcaaacatgttgtcgacgacttcttctgtatatacggagttttctactccaatctatagatttctgcaaagtgttttgtttgtcaccgatgaaaagaacaattttgccctctggagaaaaatgaggtacctgtatttcaacaccaacgattttatttttatccctcagttgatccccgattttccaatggatttgtcacaagaaagatgcacattcaaggtgacgccaacttacctcctgttcaagtacgaatgtttcaatcaaatgttccaggacgactatttgattggaactctggagtctcttattatacccgattatttctacaattggaaaccatttttgaaattttcaagttcgggtaaactgattaacatgagaccagatttggaatcggaattaacacgattcgaagaagtttccgatacaccatgcctcgactacgtacaatacctcaacgaatgcggttgttcaaaatgcaatcgggctcggctgatatttgaagaactttcgttggaaaaatcccttcaagatcaacccactacttttagattgactagagattccgtgctggattccaaatacagactatcgtacatgacagtgattcgaatgttgaaatctagactcccgttgtctgaaaacatgtcaaaatattactcagggttagatctgttacagctgccattcatgaatataacggatatcaattggacggatatgagctcctttaactcgatcgttctattgataatccataacatattggacgagatcaagtattttgttttgaatattcccaatctcagtgaactttgtctaggtggaatcttttttcgaatcacaagaactcgtcatcagatcagcattgtatctgttactgataggttctctctaaaaattgaaactaatgattatgattaagtatataaaggtaatgatgatgtaatgtctcggttagaataatccgaagcgcgaaggtaaggggcaaagtactgggggcactctaatcgcagcctaagattgtctcccaacacattgatcttttacacagtagctagcaatgagtcactatacttatcttggagatagcgggcttcaaatttcccgtgttattgtggggtgtatgtcttttgggtcgaagaagtggaatgaatgggtaattgaggacgaggataagatttttgaaattctaaaacattgttacgataagggcatcagaacatttgacactgccgattcctattctaatggggaaagtgaacgtttattgggcaagttcttgaaggtttataatattcccagagaaagcgtagtgattttttccaaggtgttctttcccttaggagataatgaaaagggcttcaactataccactagagcgcaattcccccaacacgagctgatcaatcgtcaaggcttgtccagaaagcatatcatcgacggtgtgcgatcatccgttgaaaggttagggacttatattgatttgctgcagattcatagattggatccaaatgtgccccctaaagagatcatgagagccttgaacaatctggtagagagtaaccaagttcgatacctgggggcctcaactatgaaaacttggcaatttgtcaacttgcaaaacatagcagaacagaatggatggcacaagtttatttcaatgcagaactactacaatctcctctacagggaggaagagcgtgaaatgaacgactactgcaaacataatggtgttggtttgattccttggtctcctaatgccagagggatattaaccagacctttgaaaactctgacaaccagagcaaccaccgatgcagcaatcaagatggtaggtctggactctttatcgccagagagtgaagagataatcaacagagtagagaaactagcatcgaagaaaaacgtctccatggctgttatctctaccgcttgggttcttcataaaggttgcaatccaattattggattttccaaaccttcgagagtcgatgaagcgttggaggctctggacttggaactgctgccagaagacatccaattcctggaagagccttatcgggcaaacaatgatctgtttgggtgagtcatatcaggtcaagatctatccgctcatccacgtacataccacgtacatatttgtagcagtaagtattttatcccgtttgtcctaagtatcaatttttcacgcgcatctccaattttcatgtgtcattgcataatgtctggatgagtaaatcggaaacttggagttactatgggggacccttcgtacaggggataaattaccgcgaattagtgcataccgttttacttttgcgaaagatgacccctctagagtgggatatcgataatctgcaagctcaccacttaagggaaaaaaaaaactccccatacaaatattcttttcctctttcagttcctccatattcaacacaacagtccaaaaaggttactcatacatggaccgtttaactggtcatccggatctggatgatgagtacgacaaagagaatatgaaactgattatagtctgcgttggtttacctgcaaggggaaagtcttacattactaagaagctcactcgatatctgagctggttacagtatacaaccaagatcttcaacgtgggaaacacaagaaggacccagaacggtaagccatccagtgttcctgtagatggccctcgtcctaaggcagaagcatcaaaccaccatgacagtgccttcttcgacccttacaatgaccagttttgtcagctccgtgaaaaatgggccatggacactttagatgaactattggactttctattatacaaaaacgggaatgtgggtatatttgacgctacaaatactacgaaatcacgaaggagatgggttgttgaacacattaaccagaggacaaatggggatgaaaacttcaaagttctgtttctagagagcatttgcacagataaacaaattattgaaaaaaacattagactgaaactaagtgggccagattatataaatatggatcaacatgaagccttgaaagatttcaaggacaggcttaggaattacgaaaaagtttacgagactattgacgaccaggaggaagaggagaacgaacggtacaatattcagtatctgaagataatcaacgcaggaaagaagatagtcagttataacataaatgggtatttatcgtcccacaccgttttttatctcctgaatttcaatcttgcagaacgtcaaatatggttgacgacgaatggagagacagagtataaccttcaaaataggattggaggtgattccaaattaagcaatgagggatggaaatttgccaaagcattgcccaagtttatagcacagaaaagaaaagagtttcaacttagacagttgaccaaacactatatcgagactcaaacgcccattgaagacgtaccgttggaggagcacaccaagccagtcaaatattctgatctgcatttccatgtttggtcatcggctttaaagagatctactcaatcaacaacattttttccatcggaaaattactctctgaagcaattcagaacgttgaatgatctctgttgcggatcactggatggtttgactgaacaagagttcaaaagtaaatacaaagaagaataccagaattctcagactgataaactgagtttcagtttccctggtatcggtggggagtcttatttggacgtgatcaaccgtttgagaccactaatagttgaactagaaaggttgccagaacatgtcctggtcattacccaccgggtcatagtaaggattttactaggatatttcatgaatttggatagaaatctgttgacagatttggaaattttgcatgggtatgtttattgtattgagccgaaaccttatggtttagacttaaagatctggcagtatgatgaggcggacaacgagtttaatgaagttgataagctggaattcatgaaaagaagaagaaaatcgatcaacgtcaacacgacagatttcagaatgcagttaaacaaagagttgcaacaggacgctctcaataatagtcctggtaataatagtccgggcgtatcatctctatcttcatactcgtcgtcctcttccctttccgctgacgggagcgagggagaaacattaataccacaagtatcccaggcggagagctacaactttgaatttaactctctttcatcatcagtttcatcgttgaaaaggacgacatcttcttcccaacatttgagctccaatcctagttgtctgagcatgcataatgcctcattggacgagaatgacgacgaacatttaatagacccggcttctacagacgacaagctaaacatggtattacaggacaaaacgctaattaaaaagctcaaaagtttactacttgacgaggccgaaggctagacaatccacagttaattttgatactgtactttataacgagtaacatacatatcttatgtaatcatctatgtcacgtcacgtgcgcgcgacattattccgagaacttgcgccctgctagctccactgtcagagtgataacttccccaaaataggatccaactgtttccaattgcttttggaaatgtggattgaaagaaacctcatagcgtctatattactattttcaacttcagcttatgcggcattcaaacccaggatagttaaaaaggaatttgatgaccttttgaatccaatatactttaacgattcatcgacagtactaggtctagtagatcagacgctgttaatttccaacgatgatggaaaatcatggactaacttgcaggaggttattacacctggggaaattgatccgctgacaattgtaaacattgaattcaatccatccgcatctaaggcttttgtattcactgctagtaagcactaccttactttagacaaaggatccacctggaaagaatttcaaattcctcttgaaaaatatggtaacagaatagcctacgacgttgagtttaattttgttaacgaagaacatgcaatcataagaacaaggtcttgcaaacgtcgttttgattgtaaggatgagtatttttattcgttagatgacttgcaaagcgttgacaagatcaccatttctgacgaaattgtcaattgccagttttcacaatcttccactagctcagattcccgcaaaaacgatgccatcacttgcgtaacgcgtaaactggattccaaccgacacttcttggagtcgaacgttctgacaaccttgaacttttccaaggatgttactagcttgcccgccagtgatccattaactaagatgcttatcaaggatatacgtgttgttcaaaattacattgtattgtttgtcagttcggatagatacaacaaatattcacccactcttcttttcatttccaaagatggaaatacgtttaaggaagccagtttaccagattctgaaggtacatcaccgtcggtgcactttttgaaaagtcctaatcccaatttgataagagcaattcggctagggaaaaagaactcactagatggtggtggcttttattcagaagttctacaatctgactctacagggttacactttcacgttcttctggaccacttagaagcaaatttgctttcgtactatcaaatagagaacttagcgaaccttgaaggaatctggattgccaaccaaatcgacacttccagcaagtttggctcaaaatccgttataacatttgatgcaggtttaacgtggtctcctgtgacagtagatgaagacgaagataaaagtttgcacatcattgcgtttgctggtgaaaatagcctttatgagtccaagtttccggtttcgactccaggaattgccttgaggatagggcttattggcgatagtagtgatgcacttgatattggcagctataggacatttttaaccagagatgcagggctaacatggtctcaagtttttgataatgtctctgtttgcggctttggaaactatggaaacatcatattatgctgttcgtatgatccactacttcgatctgagcctttgaaatttcgttattctttggatcaaggtcttaactgggaaagtattgatttaggcttcaacggagtcgctgttggcgttttgaacaatatagacaatagcagtcctcaattccttgtgatgacgattgccacggatggtaagtcttcaaaggctcagcatttcttgtattcagttgatttttctgatgcgtatgagaagaaaatatgtgatgttacaaaagacgaattatttgaagaatggacgggaagaatagatccggtgacgaagctgcctatttgtgttaacggtcacaaggaaaaattcagaagacggaaggctgacgctgaatgcttctctggtgaactttttcaagacctaactccaattgaagagccatgtgattgtgatccggatattgattacgaatgttcgcttggatttgagttcgatgcagagtctaaccgatgtgagccaaatttgtcaatcctgtccagtcactattgtgttgggaaaaacttaaagagaaaagtgaaagtagatagaaagtcgaaagttgcaggcacaaaatgtaaaaaggatgtcaaacttaaggataattctttcactttagactgttccaaaacatctgaaccagatctcagcgagcaaagaattgttagtaccaccataagctttgaaggttctccagtacaatacatttatttgaaacaggggaccaacacaacccttcttgacgaaacagtcattttaagaacatcactacgaactgtgtacgtgtctcataacgggggaacaacttttgatagagttagtatcgaagatgatgtgtcatttattgacatctatacaaaccattactttccagataatgtttatttgatcactgatacagatgagctgtacgtttcggataatagagctatctctttccagaaagttgacatgccttcaagagctggtttggagcttggagttcgagctctaacctttcataagagtgaccctaacaagtttatttggttcggtgagaaagattgtaactctatttttgacagaagttgtcaaacacaagcttatattacggaagacaacggcttatctttcaagcctcttttggaaaatgttagatcatgttactttgttggaacaacttttgattccaagctgtatgattttgacccgaacttaatcttttgcgagcagagagttccaaatcaacgtttcttgaaacttgtagccagtaaggactatttctatgatgacaaagaagagctgtatcctaagattattggaattgctactaccatgagctttgttatcgtagcgactatcaacgaagacaatagatcattgaaggcgtttataaccgcggatgggtctacttttgcggagcaattgtttcctgcagatctggattttggaagagaagtagcgtacacagttattgacaattgggaatcaaaaacacccaatttctttttccatttgacaacttctgaagataaagatttggaatttggagctttactgaaatcaaactacaatggaacaacctatacgcttgctgccaacaatgtcaatagaaacgatagaggttacgttgactatgaaatcgttctaaacttaaacggcattgctctcatcaatacagttattaactcgaaggaacttgaatccgagcagtcccttgaaactgctaaaaaactgaaaactcaaataacgtacaacgacgggtctgaatgggtgtatctgaaaccgccaaccattgattcagaaaagaacaagttttcgtgcgtcaaagataagttgagcttggaaaaatgctcattgaacctcaagggtgccactgatcggccagacagcagagactccatttcttctggttctgctgttggtctactttttggagtaggtaacgttggggaatacctgaaccaagattcatcaggtctagcattgtatttttcgaaggatgcgggcatctcttggaaggagattgccaaaggagattatatgtgggaatttggagatcaaggaacaatcctcgtaattgttgagttcaagaagaaggttgacactttgaaatactcattggatgaaggagaaacgtggttcgactacaagtttgcaaatgaaaaaacatatgttttggacctagcaactgtgccttcagatacttcacggaagttcatcatcctcgccaacagaggcgaggagggagatcatgaaactgttgttcacacaatagacttcagtaaggttcaccagcgtcaatgtttattgaatttacaagatagtaacgctggtgatgatttcgaatattggagtccgaagaacccaagcgctgttgacgggtgtatgctagggcatgaagagtcttacctaaaaaggattgcatcccactcggattgttttattgggaacgcacccctatcagagaaatacaaagtgattaagaactgcgcttgcacaaggagagattacgaatgtgattacaattttgctcttgccaatgatggaacttgtaaattggtggaaggagagtctcctttggattactctgaagtttgtagaagggatccaacttccattgaatattttttgcctactgggtacagaaaggtgggattgagtacttgtgaaggcggactagaactggataattggaatcccgttccatgtccaggaaaaaccagagaattcaatagaaaatacggcaccggcgccaccggatacaagattgtggtcatagtagcagtgcctttattggttctcttgagcgccacttggttcctatatgagaaaggaataaaaaggaatggaggttttgccagatttggagttattcgattaggcgaagatgacgacgatgacttgcaaatgattgaggagaataatactgacaaagtagtcaatgttgtagtgaaaggcctcattcatgcattcagagcagtttttgtgagctatttatttttccgcaaacgtgcggccaagatgtttggtggatcgtccttttcacacagacacatattgcctcaagatgaggatgctcaagcctttttagccagcgacttggagtcagagagtggagagcttttccgatatgcaagcgacgatgacgatgcccgagagattgacagcgtgatcgagggaggaattgatgtcgaagacgacgacgaggagaatatcaattttgattcccggtagatagctcacccacggtcacacacacaaacacacatacacattaacacacagagttattagttaacagagaaaactctaacaaagtatttattttcgttacgtaatccgacttttctttttaccgttttctattgctcctctcatttgcccctaaaagttgctcctcattactaaaatcaccacaccatgctcgaatatgatgttactaaatgcaaattgtagtcgtgcctcttgtggtaatactatagggaatatctctcgattactcgattctggttaattttttctttttttataggggaagtttttttttcttcccctttctctccagtttatttatttactaagaaaatccaacagataccaaccacccaaaaagatcctaaacagcctgtttttgaggagtttttcagcagctaagcttcatcagttttttaatacttaatttattgcccttcactttgtttcttgtggcttttaaggctctccggaacagcggtttcaaaatcaaatctcagttatttgtttgctccgctttgtcagttcaaagatcatggtttccgaaaacaagaatcaatcttcgattttgatggacaactccaagaagctctctccgaagcccattttgaataacaagaatgaaccgtttggcatcggcgtcgatggacttcaacatcctcaaccgactttatgccgcacagaatcggaactcttgttcaacttgagccaagtcaataaatcccaaataactttggacggtgcagttactccacctgctgatggtaatgggaatgaagcaaaaagagcaaatctcatctcttttgatgttccatcgtctcaagtgaaacatagagggtctattagtgcaaggccctcggcagtgaatgtgtcccaaattaccggggccctttctcaatccggatcttctagaaatccctacgatcaaacacagtcacctccacctagcacttacgcctccaggcagaactccacccatggaaataatatcgatagcttgcaatatttggcaacaagagatcttagtgctttaaggctggaaagagatgcttccgcacgagaagctacctcttctgcagtgtccactcctgttcagttcgatgtacccaaacaacatcatctccttcatttagaacaagacccgacaaggcccatccctattgccgacaaaaagaagaaatccatgacaaaggcaataatttctacgccgaaatcgcctgtcatcccattcacagactatctgcaacgtgaggatgacgacaaaatccatattttgattggtgctactggtagcgtggctactatcaaggtacctatgataatcaataaacttttccaggtttatggacctgacaaagtttcgatccagcttgtagtaacgaaagctgcagatcactttttgagaggactcaaaatttctaccgaagtcaagatttggagagacgcagatgaatggttcaaccctggaggatgtcgtccaggagatgccatactacacgttgagttacgaaagtgggcagatatatttttggttgctccattatcggcaaacactcttgccaagataagcaatggtttatgcgataatctacttaccaataccattcgatcatggaaccctacaatcccaatctttattgcgcccgctatgaacacactaatgtacactcacccaatcaccaaaaagcagctgaacatattaactgaagaattcaagcacgtaaccgtgctgaccccagttgaaaaggtgttgatgtgtggagatattggtatgggcggtatgcgagaatggagtgaaatagttctcctgcttaccaagaaaatcaaagaaattactaaacagaaagagaaagaaagagaaggtaccgcgggtgtcggaccggatggaaaaaccggtgaggaagatgtgggaggtgacgtcggcgcagaagacgaagatgaggatgaagatgaggacgacgacgacgacgaagatgacgacgacgatgaggacgatgacgatgacgatgacgacgacgatgacgacgacgatgaagtccaagatgaattcgtcgacgatgaagatagtaagtccgttgacgccaaggataacgacaatgatgacgaccaaatcttaggagaacttgaaaattgataatcttaatacatacaaatcctattatcgttatttaagtaaaataatgcttgcattcctcactcaacagtgacagatttagccaagtttctaggaaagtcaacatcaatcccctggttgactgctaaccagtaactcattaactgcaatggtatgacattaattaaaccttgcagacaatcaacgttctcgggtacctcaataaaggccaattctttcttgttagtttgaagtttttgtccctcattgacgataattataggacgaccttctctggcagtaacctgtgagatagcagactgcacctttggaagcagtgaatctttggttgctattgcgataataggaagatctttatccacaagggcaagaacaccatgctttagctcacctgcagcaacaccctcagaatgaatgtaggagatttccttgattttcaaagagccctccaaagcggtggcaaattggtaacccctacctaacaataaggcattcttctggccattcaagtgcttgtcacatatgtctttgatctggtcctcaagttcaagggatctctttatttgttcgggtattcttttcagtccttgaataattgaaatacaacgattgcgcaaagcgatggaatcactggccaaggacagggcaaccatgaccaaggcgatgtactgggaggtataagccttggtggaggcaactccgatctcaggaccagcgttgacgtggacaccgcaatcagtttgacgagaaatggaagaaccaacagaatttacaataccaacagtagtagcaccctgttcgatacagtattggagggcaagcattgagtcagcagtttcaccagattgagagacgaaaaagcaaacgtcattcttcgaaactggagatgatctgtccaggaaatcagaagcaacttccaaagagacaggcactccagctagttcttcgaataatggtctggttgcgagacatgagtggtatgaggtaccgcaggcaatcattagaaaacgactagctctcttgatagtaggtagccagtctttcaaacctcctaaacgaaccacgttttcgttgaagtcgattctacctctcatggtgttgaaagtagagtcaggttgttcgaagatctctttctgcatgaaatgcttgtaaggacccttcataatctcagccaactccatttctaaagtcaaaatggatctcgtggccggaatacccttttcttttgtggcacgatgaatgtgcaattcaccgttgtagatgtgaacaatatcatcatcttctaaaaatagaaccttcttggtgtgctcaataacggaggatgggtctgaagaaaggaagaactccattggcatcggaataccatcctctgaaagaaaagctcttgactgcgatttgtggaatttactgctgtttgagggtttggcagttttgtcagaaggaaatcttaaagagttaggagaggcaaattgactctctgggtcatcattgaactcaacatccacaaaatcgaccttcatctttctctcggttttaacacctacaagcaaaggagaacccttacgagtggcaacgatctcaccagggtagtgtgaagatctgaccaatagaccataagaaccttgaagctcgtagaggacctgtttcatcagttcattaaagtcaacttcatggccatttttcaggtttgtatcataaatatgtttgaatagcatagcaatgcattcagtatcagtgtcggtttgaaacttgaaaccctttcctttcaacagaattctcaagtctctgaagttggtgatgataccattgtgaaccacgacgaactcgttgtttggatcagatgtatgaggatgacagttgttttctgtcacgtttccgtgagtagcccatctagtatgtgcgataccaacgtggctagagaagattttgtctgtatccggacgcagatccttttcgatgtggtctctcaaggcggcgaccttgccaacttgtctgaagatgaaagccttgtcgtcgtctccgtcgacagctaagcctgtggagtcgtaacctctgtactccaacttctgtaaaccttctatcaaggtgtcgacaatctcgcctcttgatttatccaccaagtagttaacataaccaaagatcccacacatattatctaagaattatccgacggtgtgctgagattggagagtaataagtccgggagttatctctgattgaaggaagagataaacaaaatgaacagaaactaaaattaataggttgagggcgtttactaggaaaagtgtttttttttttccgtcttcttttgtacgtgtatttctatttgtatcttgagaattaagttgagcagggcaggggcaggtgttttcaattgcctcttttggctaattgattcaagtattcttgaagacgcgaaaatggtactacctgttcttgcagggctgttatataggagaatgcaggataaactccgatgtgcgattcaaccctaaccacttttagagggcctagaaggctatttttagaaagtgatcttgcttaagtcttggtttgcttggtttgaaagtgatggagacgtatcataggtgcttatccaggtgatacgcttccagtgcaggtaatactattggttttctgcagacaataattagttttatgtgtcatggtaaattataaatagttttcgaaaggaaaaccaacggttctttttcagatcttaaaatacgtttcgtattctgggtctgagatctaaaaagaactgtaatatctaagggaaaattgccttatagtaaatgaaatcgtcctagtgaaatatatattaattctaaactgacgagtgagcagtttggttcaacacactttaccgtagtcagcggggtctaatatggtcaattatcttttacccgaaccctgcttacatgtacaagttcagaggaaaaatatccatcgcgcaacgcgaaactttcaatatctgatcttcttgcattacctcacatctttgtttacaattccaaggacggaatggttactatggccccaaccttcaaatccatccagaaaatcagtgaagtggaagatatttcctatgctatacagcaggtgtttcaaagctctcaaacttctattgcaacccacagaaaacagatcgtaatactgaagcacattcaggtgagagctcatgagctgaaccttgaatcctggtttaatgtgaccttttgtaaactggtcaacaaagtccttgtcgttaagagaacagagtcagtagctgatagagtgataaagcttatagcaggattcgtgctttctgtgagtgacgttttgaaggagtctcaaacagaagatgagaatgctaacaaagagcttgaggttgtatttgaagaatttatcgaccatttggtacggcacctgatgaaaggtattgatgcgaaggacaaaaatgttagatacagggtatgtcaactcttgggtttgctgatgagaagcttaaacagcatagatgaggacttattcgagctcatctcagattgcatgtaccagaaattgtttgacaaagaacctacggtgcgtttgcaggcggtgcatgctgtcgcctgtttccaagcagatgaaaatgacagcggtgaaaactcagaagaaggtcatttgaatacagccacggaacgattggtctttgtgatacagaatgatagtaatagtgaagttagaagagcggctctcttgaacttggagaaaacccctgaaactttcttataccttctagagagagctagagatgtcaatcctgtgaacagacgacttgtttattccaggattatgaaagagatcggagatttccgaatactggagtacagtgtaagagaagctctacttacatatggcctgcatgacagagatgattctgtccaaaaagcctgtgtgcagatgctcagctatcaatggttagacactttgaatggtgacatcttggagctgatcgaacgtttacatgtgacggagagcgagattgctgaacatgccataaaagtagtattgacaacacgaccagaatacatcaccaagatgaaaatgaatatccaagttttggaatcactaactgcagaaagtgcgttccttttcaaagtttacttcacttacatcaatgaacagaatatgatagataagttagaagagctcccggaatcattgacattttctagagttctttcaaagtattttagcacaagactgaagataatggagcgattcaatgcaaacaccacagaagagcaagcaatagttgatctcaaggagatgaattttgtcattgataagttattggaagtgtccacggactatgatttttccgatgaaattggccgtagatcattactacagcttttaagatcaaccttgtcatctcacaacctccaagaatcatctatcaagcttgtgatgcgaactctttctaaactttccgtgaacgagagagacttctgtcaaatggttgctgaaatcattgatgacttaacaagcactgacacacatcagaaaacggtggctcaaaatgagaataaccaagaacattcaaaggacgcttctggtgactcttttgtttctgctgtatcagatatagaagatgaagatattgatccagaaactactgcgaccaagacgaaagagagagaaactcacactgtcgcaagtgaagttatgctttatgcgttacaaattgctcaaggaacattgatggttacgcatagcaacctgaatgaaaatatatcgttgatgtctctcattgatagcttaatccatccagctatcaaacaatctgagaatgtcatccgtaacctagggttgtcatgtttgggtttatgctgtttgcttgataaacagttggctattgactcgttgtttctgtttggtctttgcgttactcaaggtgtggatagcatcaaactgacagggttgaaagctatctttgacattttgtctacccatgggatttcgatactagatacagagggtgggattgattctttatcaattgctaaattattctataaatctttaaaagatttcaaaagaccagagttgcaggcaatatctggagagggattattcaaattgtttttagcagacattattactgatgacgatctttttgaaaccattttattgacatatttcaatccatcaatcaatgagaatgagactttgaagcaatgtattagctttggtatacccgtgtatgcttacagtagtgccgtgcaccagcagagaatttccagagttgtagcagatactttaaagagaactatgaaactgtatgacgaattagaagataaatctaaagcaatttcgttgaacaccatcctgcaacaattaattcactggacggatccacgaaatgttgttggaatatcggaggaagagatcagtacgtcgggcacccatgctgagtttgccagccaactcgtgcaggcaatggaatcaatgactgaaagcaagacctttgtgaagagttgtgttttggcattgcctaaacttcacttgacagatacgaaagaagtagcactgctaaagcaggccgcacaaaatttacgagaaatagtacttactgtcgaaggggagggcctgtacaaaatggatattcctacagttaacgctataaacaaattttattcctttgtggattccttacaggatgaaaaaagggaagaagaagagcaggttattgaggaccatgactttcaatccaccgttgaatgaaaattggttatctcgtcctcgtttctaatatttggtccttgaacttttcatctgttccatcccttagagcttcgaaatattgaagaacatctgatgcaccgatatcgtctatttcctgagctttaacatattcaacaccttttttgctacatgcacttccatatttcagattctgtggatctgattgaatatcagacttgatgcaaaacaatggagcgttggctgccgtatatcctgttatattgtgccaaggagaacctaggaatcttacaacatagaataataacagcataccataataagtgaacacgttcaaatatttcatgaaggataaacttgtgaaaatacctggatgacaaacgtattgtataatattcccctgtttcaatagttgtttgtaagtagccgaatgtaacaagtctactaatctcttggacccctcgtaagagacatcagactttaataattgcatatcttcaagggataggtatttgctatccgacatgatacttgatatccagactattctggctccattagcattctctagtaatcttgatattctatgaataaagtagtaaggtccaaagacatttgcctggaataccaatcccaaaccgtcttttgattgcactccaactctctgtatcttgtaagtaggaaaggtagccgattgtacggggttggtcaagacttgtttggtagcaccaatccaatcgataccatcgtaaacgccttgggccgcattgatgaacaaataattgatttggtcatatgaattgttcaaatcataagctgctgatattatagagacaatgtctgtaaaatccaccaaaagatagtcaaactctaggtctctcggagagggaagttttgaattgaactctttgattgtgtcaataacttctttcactctgggtagagttctggaagtaacaactaaggtaattggatcagtgacagcctctaaaagccggtagctaatgttaagacctaaattgctattggttccagtgacaacggcgacttttctggacattgcaagggaacaaagagaaacagttattgtatgatgattctgccttactaaacgatggtaaacgatggatagagctggaagattacataatcattgattttaacttgagacatgagacatccccccaaaacttaatatgagcgagaattaaagatcttgtttcagattccaaatatgaaacagcgtatctgactacttataaacttacatggataagtcattaaagaactattgggaattcgttttgcaagagcagcagacaatgacacagagaaaaattgtctataacatttctagcgactatagaatccagagggttttgggtgagggtgcgtatggcatagtgtgtcttgcgaagcatttgccaactggcactgatgttgcaattaagaagatccaaccattcgaacgaactttgttttgcttaaggactctaagggagatcaaaattctgaaacatttcaaacatgagaacattgttgcccttctggatgtccagaaaccaatgagtttagaaaccttcaatgaagtttatctaattcaagaatacatggaaacagatcttcataaagtcatattatctcaaaatctaactaatgaccactatcagtattttatttatcagatactaagggcactaaagagtctacacgggtgtaatatagtgcatcgagacttgaaaccttccaatatcttgctaaattccaactgtgatctcaaagtctgtgattttggattatcaagggtgcatcttaatgatgatgggcgagcctcacacgtaccaaagatttcaatgttgacagaatatgttgcaaccagatggtacagagcacctgagatcatgttgacatcatctcagtactctacggccattgatatgtgggcggtaggttgcattttggctgaattatacctccgaaaaccgctatttcctggtaaggactatcgacaccagttgctactaattttcgaaatcatcggcaccccaacaggaattgattatcaatccattaaatccgtcaaagcgaaagagtacatcaaatcgctaccttgctacagcaagattccatttggcaaaatatttcgtcacaatgaccctcaaggtttggaccttttgggaaagctactgacttttaatccgcagaatcgaatatctgtggaggaagctctaagtcatccctacctgtcatcctaccacgacccacttgatgagccattctctaatccaatccctccagactttttctcatttgatactgaaaaggctcaaatggatggaaacgagctgaagaaactactgtatcaggaaatcatgacatttgatcagtaagcacttagtccttgagtagaggaggacaagttatgctctggtccctggtagttgttttcagttttcgatgtgttccttttaatttgtataagcttaataccctaatcatcagcatttgaccgcagcttccttgtcgaatcttcaccctaagaacgttttgatcgaaacgttatctctcaaaacttttattctcagcaccccggctaaatcagcatcaaaatgataaattcgcttataggctttctcttttatcagtgctaatgaatgaagaaccagatgatttgacatcgttgggggtggagctggtaggtcaggacacattagagcaccaaattgctagtatggccgatactgcaatgttagaacgagataaagaattagaattgaaaaggttggagaagactaaatctcaaattcaaaagtggcaatccaagcaaaggtccttggaatccaaaataaatagtaggaacacaaagattagtgaaagagaaaggtttagaaaagaactgaaagacatagaggagaatgaattaaaagttttgagggatgatttgaaggaaattaacaccagacttcaggaaacaatgaaagcatcttctctgaaggcaaaagagacattagacgaagttgagcaactaccaaatgagacaaaaaaagactttctgataagaactgggaaaatcactgcttttggatctgtcaatgcttttacgcaagacaatcccgaagctcctgtagagaagagccatcaatctctaatcgctccagggattgatgatgatgatgattatgtttacccgggagaaattgaagaaattgaagaaatcgaaacggaaaatgagtctgatgatcaggccgcaataatctcttcaaagaaaaggaaaagagcaagatccattgagcacgatgatgtgtatgtgaacagcgactcaactgaagatgagtatgatacccaaacaacacgacaatcaaaagatgaaattcataatatcgacgatggagatgatgcgttctacaacgcacggcttaatgcatgggttaccaaaagatcccagaagcgtgaagttgatgcaaaccccgacgaagaagaatggtttaaaccacaccccacgaaacaggatgctatccttgatgatgactacagacttcctggtgatgtttaccctgccttgtttgattaccaaaagacctgcgttcaatggctctgggaactttatttgcagaaagttggtggcattctgggtgatgaaatgggtttaggaaaaacggtccagattatttctttcatagctggcctgcattatactaaaaaactgaacaagccggtcatcgttgtatgccctgctacagtgttgaggcaatggtgtaacgagttccatcgttggtggcctcctcttcgtgtcgtaattcttcatgccataggcacagggttatcgggaagcagaacttctttacagaacgaagcgtccattgaaaagcttttagaagaagaagaatatggtagtactaaaagccttgcatctctaaaagcggagtccagggttaaagagttgatcgattcggtttttactcgaggacacgttatcataaccacttacgtgggattgagaatatattccaagcatttattaaaacgggattggggttatgctatactggatgaaggccataaaattagaaacccaaacagtgatatctccttaacatgcaagcaactaagaacacccaacagagtcattttatctggaacaccgattcaaaacaacttaacagagttgtggagtctgttcgattttatatttcctggacgactgggaactttgccagtattccaaaatcagtttgcgatccccattaatgtgggaggatatgcaaacgctacaaatttgcaggttcaagttggttataaatgtgcagttacacttaaagatctcatatcaccttatctcttaagaagagtgaaagccgatgtagccaaggatttacccaagaaaagtgaaatggtgttgttttgtaagttaacagctcctcaacatgcgctatatgaaaagtttttgagatctgatgaattgtccaggattctccagggcaagagacaagtactttatggaattgacattcttcgaaagatttgtaaccatcctgatctagttgatgttcatgcaaaaagaagatcgaaaaaggatccaacttatggatctgcttctaagtcaggtaagatgcaggtggttaaaaaattacttgaactatggaaaagccaaggacataaaactcttcttttcactcaaactcgacaaatgctggacattttagaatcatttttggaaaggttgaatgcaaagggtgctgaagaggaagattttgtacctttcaagttcctaaggatggatggtaccacttctataggcgttcgacaatctttggtggatgtattcaataatgatccgtcctataatgtctttcttttaacaaccagggttggaggtttaggtgtgaatcttactggtgctaatagggttatcatttatgatccagattggaacccctccactgatgtacaggcaagagaaagggcttggagattaggtcaaaagaaagatgtaacaatctacagactaatgatagctggatcaattgaggaaaaaatctaccatagacaaatattcaagcagtttctcacgaataaaatcttaaaggaccccaaacagagacgattcttcaaaatgaatgaactacaagatctatttaccttgggagatcctgatgagaaaggtactgaaactggagacatgtttaatgggatggagtataatttcaagggtaccaaacccagacactctcagaagttgagtaatcgtgaacgaagtgaagagccccaagatgacttggtaaaattagcgcaaataaatggtgtatctggactccaagaatttgatggatcgaaagacgagcaaatggatagtacttcaagacaagaagaagagttgatgtccggacttttcgcctcatcgggtgtacattcggcccttcaacatgattctatcatggactcaacagaacccgaacaaaacgaggcagagttagaagctagaagaatagctgccgaagccgcaaattctctcagagagtcaaggaaattagcccgcaaatcgaaaattggagtacctacatggactggaaagtttggaagcgccgggaaaattctaaacaagcagcggttccgagacaacgcatccggtgtgtcgtccagttctattcttcaaagtataagagccaagagagatttagacacgaagaaaaaggagaggccggatttcaataatgaagacaacgaccgaaaattactgatcagaagaataaatgactttatgttggtgcaaaatggatacaaggctgactcgcagaccattcttaacagtttcaaagaaatcaacaacatcattcttatgagatctatgttgaagcagatatgcaagtgggatagcaaagaaaaagtttggattttgaaagatgagtacgtggagtgattgatgcacatgcttcatttcaggtttaccctttccacgtaaatattctgtaggttagatagtccataagtattaagagtgcttagatcatcatccatttgttgtcgaactgaagtttctttaatgatgaaataaatgttaatttgtaggatgtttgaatcaatttgctcgcaaattgaaccttttaatttgaggactgtgtaattgggaaacgctattaccggaaaagatctgtctttgtcaatgacatttaaattcagcaatatcgatgctatggttgttaaaggcttggcagttaccgtttcgttagaatcagcttcaacgttgtaagtgtcacagagttctctccatctttccaaaaccttaggatagacaattttatgagatttgacctgctgaatgaaatacagttccaggctctctttctgagtagcagtaattattgagccatccagcgttgacagattcgcattcaggcggcctaatagctgatacaattggtcttcagaagagttttcgaataaaggattgaatgttatactgacagttcttaaatctagttgagagatttcatccaccaatggccattccgttatctgattctggttaaaattgatggacgacaccttggttacataaggtataatcttggtaatattatttccaaaaagattgatcgtttcgatgttttttgtcttgaacatagtaaagtcaacaaaagtgacatggttgtgtgaaaaatctaaattcgaaagtgtctgtggcatttgcttgattatcaactcaaactgcaaatttgaatagttgttaccagagagtgcaagagtagtcaattcagggaagtacgaaagaaaggataaatcttccatgtacgtgcttgtcagctgcagagtttttaatgtcaatggtttcaattccttgcacgctgatatatcttgattagtaaacctattctcgttcaagttaagaacttgtagtttaggcagttgaacgatcaaattgaatacttcactcagatctttcaataaattggaactcaggtctaagtcaactagatttggtaatagttcagttatgtggaaatcatctttcaggtcggacttataaacacctaaagtggccagggaaacaatttcaaggttgaagaagtcaccttgaatctttgaaaggttatcaaagccataactttccaccattttcgtaccaaattggattttatcaacacctttatcggcatcacttgccttcaaatctattttcctatggtgctgagtagccgatagggactcttcatttccatacttgtaaactattgcttcaatgaagtgtctcctccgatcaaatttgttcatattctttatgaatgaagctgatttaagccccgattgggttttgaagtagcaaactccatttagggtcccgttgttcttgcctcgttctgctctatcccaatctataccaatggcctcaattcctggccatttctcaatttctcccacatatcttatagttcctctgtcaccttggactgaaacacgatcacctattcggtattgatcgtttgtggcgttcattcaccacaataggggagtcaacttgataaaaaaaataaaacacgaatgctctgctcgataacgaattacaagataaatattcacagcaataatattttacattacgtacgtacacattagtagagaaatacaaacatgaaactacagttccaaggccatcagagaaccaataaaggtcaagatcagacgaggtcgaacttcgttgatgtcttcaggaactaaccagattagggctcccaactttcttgcgatggagatggccaacttggcgttggcgtatctgtcttcctctgtgctgcccgctgtaaccagatcgtaatcaacatagccaggtttaagaccatgaaggacgtccaatagaaaaataccagaagaaagtgatggttccttgaaggatctgatttgggaggattttccacctttggcaacttgagcattagcccattgaagaatttccctatcagaaatctccttaccattcactgaaagagaactcaaagtattgttgatgtttcttctcattaattgccagactaagcccaaggtcaaagttttggtaccatcgactatgtcagcaccttcgataccaaccagagagaagttgttggccttaccaatctcgactgcgtaatttgtgttttccagtgccttgaaacgagaaagttcaaccccgttctttctcttgtttacatggttaagcgatacggagccaggcattaccttgtcaaaagcctgcaaaagaatagtaccatcctttagatcctcgaacaagttaacgattggaggatcgacatccaaagaatttaaccacagagtaaatactcttgcttccctttcgccttcagcgtcaaattcttcaatctcagccttttcttcctcctcaatagggtccaaacctggataggtattgaacaaatgagcaacaaacgccaagttcagtttaggattacctgcgactagagatgtcggagtcagatactttcttactccaatccggtcagcagagtccaatatttgcgaagctcttgtcaataaatcggaagtttttaggggagataaatcacaatgctgtggttgaagttggttcagcaaatacgtgtaagcttcaccatcgcttacgtctttggaaaaattggagattcttcttgaagttccagctgcctttaaatggtagttcacccatcttagtaaaatttgttctgggggcaacctcaaaaattgctctaacgtttcatcatcttctagaagacgatataactctgggtgcagtttaatgtcaatcttgctcaacagcccccttctgatgatttgccaaataattcccaaaatcaaatgttctctaccatcaatgatatcttcagagtgcacattaacgacaacacacccgatagccttggcagaattgatgacaatgttagcattttcagacattgtgaaattgttgagcttcttattgccctttgggaagttcagaacacgagtgtcgatagtatcagggaccgaatcgttgataagtttggacaaaacaagaccatcactacattcatcaaaaatttgattactgtcggtagggaacggtaatctatcaccgatatcagggtctccggccaagacggagttgatgtgtctggtaaattcgactctctcttcgtcattgattgtatgagtacttccagaagacgcacccttgaacacatgtttagtgctggctttagctcccctatggaatatgtcagaggtatcagttcttgtaggttgcttagggttaactttggactctttcaacttggagaccaactcaacaaaatcttcaagttccacatgaccagaagcgtccacggagacggtcttcaaggtctcacggatttcgtcatacgagccatgtccagcgttagagacactttcaatcacctcttgcttatcagcccaacctttatcatctaggtcgatctttcggaagtcatcaatgacttggaagagatcttcctgggtcaacacaggatactttttctagcaggttagtggcaatgtttgcgaattgagaattaatcaaggacttacttgtagtttcaatacgctcatagctttggatggcaaagaatggtttgtgaaggtgtaatttgtattagaatgtattcggggttaagagggtcattcgcgacctaagcaaaaatcagccactttatagaggcgtgctattcactgtgcatagatggatgattcgtacggacagggcgcagctcagtaatatgactagaggcaagacgtagaatcggcaacaccacgctatatttcggattctaggtcctgtttaacgctacttctaagcagtgacatgacctgttctttgttttgatagaattgggcctcatccaagggccaaatatcagttgttgtgtggtgactttttctggcttgtgataactcccacttaaggtcttgtgctatctctttgaactcctctagctcatttatgttcatgtcttggagaaaactgttatggttggggaaaatactcagcaaattacccaacttattcaccttctgagataaaggcttccgcttgccggaaaaattgtcaagtacctgttttgtcagggctttggtcagccctggtattatctctagcactctgtttgactccgaatccgagtcgtcattatcgtcatcattatcatcatcatcattggtggcagaactatgaagtccatagtttagtgtatgtattctatctgtagattcactctccgtgtcgaaaaagtaattggtagtagtctcactctgttccaaggccttgatcttgctccaacgcagaggatgctttgtgttgaatattcggtaatcgtaatctatgtaatctagctcattggctgattggtttaacaacactctatctgtggtgtttccctctgatgctgtttctggtgttgtttttgacttgtaggcaaaagaggaaagtattctgtgatttgtcggggtcttgttggcaggctcctcagtgtctgaaattcggttactaatgcttcggaataactgcttcctaatctgaggggacttatctgacatggtgagctgaaaagtcaaggctacaaaggcgagatgagatagaggcaatacacagtccttaaaagcgcatgggcgcgcgatgccattaatcgatggcatgttagctatatagtgggtaatagatgctttatacaacagttttgacctcaaaaaatctcttgaggtagtagatctggaacaatgagtttgaagcaatgattattagttggaaaacagaccaccatttgactctggagttggtggattcagcggtgtttctatgcgtacgttctctgacaacttggtatccttgctcattcttcacatcgtgtaccaattcttgaaacttacgcacagacatgtcaacactctcagatcggggatcattaacgtccacataaacaactccatgaacgttgaaagtgacatctttggtggtaatggggctatctttgttggagaagcaatacttgtatttaccattctcgttggcgacgacagattcagttccatgagagatgcccttcgtattcctgataactgttccactgggactggtaattaaaaagtcagcagtcagctggtctgtcgattgagggtttctgtcaccgacctggaaagaaatggacaactcatcattcttcctcaaatcttcaaaaaaacattcaattccatgcggaggaagaagcacagtatgagccaaagagtagcagaatagtgaaaggatgacaaatatcttcatcttgtcgtgagttctttctttcagtcaacagggaatcacttgcctttgggttattttgaacgcgtagattcggtaagctctaccagggcacgcgcgcgatcaatctttgcaaggggagatttctgtaacccacacgacccatttctcttcagcctagtaattaggatcgatcggcttacatcagcaatcttttacgtcagaactattatattaaataattacttctttctaaaagcacatccctcggacaatctggctttaccaccagttggggtgcacagcacggtggtgcatgagtcgcaggttacagcagtttgagcatgagaaaaaactgtggtgatctcgaagcatcctgggcacttgacgtccatgaagtatgatctaggagcttgaactaaagtctttaatttgtgttgcttggcctcactggctgggttagggtgtaacaaatcttgaactaagacctaataaactgttagtatgaagttggttacaatgagggagaagttcctggtcagcctggggaatctaagtgactaaaaaacaaaccgacatgagtcatgcctgtcagggcatgtcattttactacgatcgcttgtttttgattgtacatccagtcttattgatcttgttccttgaaacgattgactttctcttctgagcaaacattctcataaacggttcaataatcccattgttttttaccgaaaaagcatcatatatcaactcaatggaactttctgcttcaagctgacccttgactctgggaacctcttcttaaagttgctacttaccatttttgctctcctctttagtgatgaagtaaaagttttaaatttcgctgactgttgaaaattgtcacaaggtgggattacgtcagcacattcgtttttggtaaaaagttcgtgcccaagtcgattttcagagctactactaggaaaaaaaatgaagatacagactgacaattaccgtacataaccgtatatttaggaacatatagaagtgacgaacatttcctaaataggaagctggtgtgttttgaaataaacaaatgcgagatcttagatacaatttaagaatgctcacgtatggcggaattagctcggaagaatgccgaagccgaaaaatttccctaaacagataacattggtgataggtggccagaaacttgggtgagcaaaactgaacacgcacgacacaccactaatttttggcgtgtcagcgataagccgatcccctccgctccctctacttcgtgcgtaccaatcattttctttgtaaaccctctcaaaagacactatcaatttatcagtaccaacatttggtaccccgcggggggttaagaaacaaaattagaagaaactaacaatataaaaaaataaatgattgctatccatctctgatctcaccattgttgacccgatcgtagaccgacttttgtttaactatgcctaatactttgaacctttcttctttctattatccaccccataagcactatattgtggtttcttctcggcaggcttgaggatctggaaggagcacagcaaactttcgtcaacactcatcatggcgcctgcattatcaaactcaccgcagtagttgggggccgaaaacagagtcaccaattgtctcttggaaaagaattcgtacccatcttcgaccacttgatgagccctacaaattaagtccatgtcatgtctgtgtaggaatcgggacacgacatctggtccaaatgtaaaagagactcctctatcattttcactccatcccgtgatatccttgtctgggtctgaccataacaggtcacataaaagaccaacgtccggaatgtcggttggcctcataattcttctaatctggtccatatttcctaagtctgggcttaaacctccatgcattgcaaagatcttctcgtcgataattgccgcaattggcaaacagttaaaacagtctgtgaatgccttccacaatttaatactataacgtctcttacattcatcgtagaagccgtatattctattgatcgaagcacactcatgatttcccctcaagatgaaaaagttttctgggtactttattttgtacgctagtaacagacaaatagtctctaacgattgtctacctctgtccacgtagtcacccaaaaacaggtagtttgcctccggagggaaccctccgtattcaaacagccgtagcaagtcgtaatactgtccatggatatctccacagatcttgattggggcttccaattccagcagaatgggttgttggatgaatatttctcttgccttggtacacagatattttacttcgaactcttccagttctactagcttgcccggtttcgaacccctaacttctaagagcctgtcaataacagagtcgaggtcgaatgattgttgatctgccattttaccaaacctctgtcctttttgaatgtgtgttttttttttgcctcttttgactgagtttactcctgtctttctcttttaaatgtatttggaaaaaacgatctgccagtgataaccctaacaactactagtaatatacactcaaaatccaggaccaattcaacggcttgtccaaatctgatcaaaaatggtgttaacgtaaatgttgttccaatgatgtttgcctttgttaccagcgagatttttacacttttctttttgtgaggagaggttttactcgatacactacctcgcgtctttggctgcaagttttaggttacggcaactgtgccccagagctagagggagggagttggacagagaaggggttcagaagtgcaggcccctggcgggcaggtggaatattgatctttctaggtggccccgaggggagcaaaagaggtgcaaaatggcaaagcaattgttttgctggaatctatttttgcacgtatggattgctttaagctttgtctgtggggttaggttacatatatagatatcgttctttattattcttctcaactttatgcaaaacgagtgtcagaggatggtgggttgcagcagtgctccttagcgaacactgctttcgaagttcgaaggctgcctacagatgaaggaacgcttactggttctaaggtggaaactagccaataaaactctgcggtgacagcaattgacccacgttccattctaattggatgtctcttggcatgtttatcttgaattttccggcctatgttatctagtaactagggagtcatttacgtaaccacctatacatgtctcctactcgactcgatttctcgaattgtttcgttatccccagatgcctaagctagttaatctcagttaagctcatcctaaatggcacaggagctaccttttaataatctttataaattgagacgagtggctgcagatcaagccaaagcatgctttatatgctataaaccttctgatgtcgtactggttacagttgtctccaaagaaaagccagacttcttctacttgtgcaaatcccatcttgaagatacccatttctgttcaaagctatattttgagtcagtgggtactgacttacagagtagagaggctcaattgaatcaactgaagataaaaaaggtagagttggaaaagaggttgttcaagttggaagacgaagaaagaaagaagcagtcagctctgaacaaattgtatgacatggtcacaggcgacaagaaaaagaagcaaaaggacaaaaaagatgacaattccactactgagaaggacaatgatagtcagacaaacaaaaactccatcttagagatccgtaaaagtctaaacgacactatacaacaaatcgacaacaaatccaaagagtatcttcactatcagttggattcaagtttctttaagtctaggctgaaaaaatactatgaggccgttaagagtcaacaaaggctgcagttcctatccaatgagtctaattttccctctaccaaaggcctttccaaacttactcaacaggaaaatgtttaattaattcacagccctttcagcgatccaacattcccatttgtcagtattccctttgattatgtttccacctacaaagtcaaagtttccctccagctgatcaaaagagaatgttcggtcactgctgaaaaatgaatcattatcgttatccttctcagaaacagcacttaggtttttcaagttaatttgtctaaggttatccagctctttttccagcatttctttgatttgaaaaattggtttagccatgaacagatcattcttattgcaagcaagcaggatatcgactccattgggcaaggtctccgtcctgttcaatatttgaaacaattgctgagcaactaattcgcaatactcttgagtaaatgccacgctatcgatcatgtaaattaaacccttgcaacttttcaacaagtctgggttattgaggtcggtgtaaagatacaactgtaaaagcttgttgtgcccaggatagtctaccaatctcatctcgttcagatgttcttggattttaaagttataagtgtcattaggttctatgctggtcactgagtgaactggtaattttctatttgtcaaatagtgaaagagaagcgtcttcccacttcctgatggtcctactattaagaagctgtgcagttggtgcttactttgaatcttatgaaaaatcaagaagcttgctaatattaccaatattgctactgctaatgagattagaaagctgttctctaccattagccataaatcccagggtaaaagaggagagatgtactttttgatggaatgtcgatatctgagggccccttcgcgcggccaaacttgatctggagttcctacagcgtcgaccggatatggtgagttctacacctattgacagttccttcgcgagggcatccaaatttttccagcctccaaagttactcattcgatcgctttttttcagaatttcatatacattatcaaaatgtcttcgtttggccaggttttcagagttactacctacggagagtcccattgcaagagtgtaggatgtattgtggatggtgtcccaccaaatatgtctttgactgaagaggatattcaacctcaattgacaagaagaagacctggtcagtcaaagctcaccaccccaagagacgagaaagatagagtagaaatacaatccggtacggaaaatgggaagactttaggtactccgattggaatgattgttcgcaatgaagatcaaaggccaaaggactacaaagagactgacgtctatccaagaccctctcatgctgattacacctatcttcaaaaatatgggattaaagcctcctcaggtggaggaagatcttcggctagagagactattggtagagtggctgccggagcagtggctgaaaaatttcttaagcagctcaacaatgtcgagatcgtggcttttgtctccgctgttggagatgtttctatcaacagaaatcctaccaatcctgaatttcagaatttactgcaaacaataaccagggagacggttgatgccaaccagccaatgaggtgtccagttgagagcgtgagagaccagatggcagagattgtcaccaacttcaaacacaagcaggactctatcggtggtgttgttacctgtgttattcgaaactgtccaattggattgggagagccagcttttgacaagttggaagctttactcgcccacgccatgctttctattccagcaactaagggatttgagattggtagtggatttgaaggtactagaattcccggttcccagcacaatgatccgttctacgtcgaagacggaaagttcaaaactagaactaacaactctggagggatacaaggtggtatttccaacggggaaaacatctatttctctgttgccttcaaaccacctgctaccatttctcaggaacagcaaactgcttcttatgagggtgtcgacggtgttctagctgcaaaaggtagacatgatcctaacgtcaccccaagagccgtgcctattgtagaagctatggctgccctagtcctcgcggacgctgtattgattcaaaagtctagagagtttgcactcagtgttgtttcttaatagaattagatgtgtttctatagtttcatattgttcataatagtcataatgtctttactaaaactgctgataatctcttcattatccgaattagtggtagtatcatcagcgtcctcctcttctattattgagggttcatcaggattcactattcgcagcgttgaaacaggtctcgctgggacaacatgcgttgaatcatcagagtctgaatgcttcgttattgtagactcggtcccagttgaattggaataaagggactttggaacgtcatcctctttgttgaattccgtttcttgcgaggaaaaggaaatttcggatgtccttttgtccataaacatattcgtcaatgagggtagccttaacattttcacgctccttcgtttggatattgtgttacctttgcggttggtaagatcaatactcagctcgtcgtcattgttgttgagctggataggagttggaagattgtcactttttgaacctccaaaaaatgccatgtagttggagatttccttctcccgttgcttcatctcctttttcttgttgtatttcttaacgagcacgacagataccactatagataggattatacccagcactggaacaatcgtactaaccgcaataactagaggtttacttgtgttccttgatgatgttttctcatcaactttggtgtagtcaactgaagcgatatgctcaaaagattcagtgttgtatagataagccctaaatttgtctgtttccgtttgattgactaccaaaagagtatcgtaaatgattgcggccccagtcaaagtcgacagggaaatctcattatctggggaatttttcaagctgttcacagtactaatagattcgtctagagaattccacacccaatccgtagaagatatgtttaactgcgaaaatgatggggttgcaactccatccaagagagtccctccaagcatgagtaatgactcaaccttgtggtctggagtttctgacgaggatgtattcgtatggaaaactggtaatagcaaagggctcattcttgaattgatggagtcttccagagttggctttttgaaggaccaagtttcatactgccaaattgccatctgtgagaaagatatccaacccctttgtgctttccccccaactaataccaccgtgttatcattaattggaaaatttgaggatccgtagaatgcagcaggctgtactgaggagtttaactcttgcgatactccactggaaatgtcaattttcaacattctttctacaacggacccttcggtagcttgatcctggcccgcagtttttagacctccatatatgtagatagcagttggttcttcaaatgtggaaacaagtccgctcagggaataataaggaatggtgttatttttagttcaacgtcgtcccaggttttttgattcctctggtacttctgaatttttatgaagccggtactattttgaacagagtatagatctccatcacctagcaacgtcacatctccttcgggaactgtaataagattcccaagcgatttttcccctattatatctccgcttttgaatttggcattaaaaggtatttggatcaaagaagatgagctttctgggagaagatatatcgtctcattatgaaaatcatatagcgtgttccaaacttgggcatacgtcaagtctattagtaaccatatcaaccataacgtcgaaaagatcatcgcctgttatggtcaacaattagatggtgcaaagtttaccttcatcttctccgtggtcttttgacaccttcaattagtttaatggctactggactaaatacctaaataggaagttgtaaacaaatacccgaaatgaccaaactgtggaccaacgagtgagaacgtcaaatgaacggatttaacccaaaataggttagcgcagtgccacttgggtcttcgggtttcttgccgtaactagtgcccaaaccataaagtgtattgacgcaattgtcccgagccgacccatcatttcattcagcgatgttggcagaggggtttcgactgaaacaattggcttaggttgttactagcttcaagtgtctcctctcgttgcgcgcctctactgagcactgtgctgccttgccacaaaatttgtttccttcgataagccgtcacttccagaactttctccccccaccgtgcaaatcgatcgccctagcgaaagttttttctttttctgtttgcgtcagactatcaaaatttccttgctcactcggaattcccagctcacaattttccatcctttcaaggcaagcacaacaatcaccttagagaatattataacccctacaagcaattgggaattgccagacatttacaacttgtttctccttttagactgagctaccagtgaatatctaaatagctgtgtctttttggtcaaaagtcagatgcaccctttccttgaggatcgttcaagcgcctccaagcaaaactcctctaggcaaagcccttccaaacgtagcaacacgccacgcaaatcatattctcgtgagtttctccacaaagtgacggattctttcaacagacttgcctcacctttggcgtctcagaatacctccagatcgaatagcacaacttctctcaataaacacttccaggttcacgataaccaccatcacgatgcattgaataatttcttaagcgtctccataaagaagctgttagacacaacacactcagattcctccacagcctccaatgctacgacaatgggtacaacaccttccttgaataaagacgagaaaacttattttgacaaagagctggactcttctatctcgttgaacaaggtcaaggagactaaccatgtttttctagagtatgatcctgttagcaagagaaagaaattaaacacttatgaattgctcaaggacctgggccgtggtcagcatggtaaagtcaagttagccagagatacaactactaatgctttggtggctataaaaattgtcgatagaaaatcaaagccttccttaggcaaagtgcataccaacacagaagaaaaggtcaaacgtgagatcgctatcatgaaaaagtgtgatcatccgcatgtcgttaaattgattgaagttctagatgatgctacgtcaaaaaaaatatatatggtgctagagtatctagagaaaggagagatcaaatggtccaaaaaggatgatgttacaggtgaattgcgtccatacctaaaatttcatgaagcaaggcaagtcttcagggatgttgtcagtggattggaatatctccactaccaaggtgtcatacacagagatattaaaccaggaaatcttctagtttctaattcgaacattgtcaaaatctctgactttggaatttcttatgcttcatcccttgaatcaaacacagagtatgaacttgctaaaacagccggaacccctgcatttatggctcctgaactttgttctacaaatggctacaagacagacaccaaagtaactcacaaaattgatatttgggcgttgggtgttactctatactgtttgctgtttggcacccttcccttttacggtgattcagagtacttactatttgaagctattaataaagaggaactcaagtttccgccagctcacaagtcttatatgacagatgaagagtttgaaatgagtcgagacctgcttgagagattgctgcgaaaagatcccgagagacgaatagatataccagagattaaaaaacacaggtttttcacttgggggctttccagaattgattccaagctgtacagcagtaatttcaactgcaacaagaaaatcgctgttagcaatgaagaagtggacgatgcagttattggcattcgtaatagaatcaaacacaaacttcagaaggctttgaagttggcgggattatcttctgtatctggttccagcactgcgtcaaattcttcatctcagatcaaagtcactagaaaaagtcaacctaggccttcttctcatatcaaattcctatccatggaaacatcacaaaacgaaccagtgctatcggaggtccaaaaggaacccgagacaattgtcccgatcacctcttggcctccagcttcgcactacaagagagattctatatcagcttcaattttatccaaggaaagatctggatctattgactcttcatctacagctccagtagagactagagctctagctaatggtgatgtatatgtcgactgcaatcctagagcagtttcgcatttgtccgacattgtctccaaggatatggagcgaagattaagtgtgatgagcaactctaatgggtcaactcatgggacaaacaatgcaacacacagtgaaccagttgatatggtgttttctcgaagtaatatccccaccgatcaaggagcctcggcgagcgcaatgaacataccagagtcatcaagcgacgactcattggactgttttgatggttctccttcctcctttcatccaactgataacaatgccgaggctggctcattacatactgcgtcaagtaaatccattttgagtgttccggagaatttaaaagcttttgctttggaaagttcccatggccgtggcaagattaataacaagttctcctttggtgaggacgaatcctcttcgcagtcatcagattcagactctagtgctcactcagaatctgaagaagatgatgatgatggtgagctgactttagttcttggtcctaaacgagatatgcctccttttttgaggcgaagaatagcatcccatgaatcaactctacctacagttggaaacatgcccaaagagcaagccatcaagaatgtggatcaggatattgccaatgcctgttctcctgtgcagtcatctagtgatattcctcgatctgaattggatccatttgtggtgctgaataccgagaacaatcatgcagaagtgcaacaaccttcaaaagaaagaactacacgagcacacgttgtatcaccattgtccaaggacgctccattgtcaccaaaagcgaacacatcggcacatctagccccgaaaatcagttacaacccacgactctacagaaatcattacaataaagagttttttgttaccccgtatcaatcggatgcttttcactacaatgcagacgaaaagagaagcaaccagaatccctgcgctgcaacatcttcccacaatgataataacgacagattcagatccaggaataattccataacggtgggtattttacagcggggcaattcgaaggatgatagtatatgagccagtcaatcaattaatacgtatcggtgaatacatccactctaatgggcctaattattagtatgaatgtctaatttgacacacacacatcaaataaatctagtaaatcagaacagtatcctcttcaaggaaagtcttaggaaggggttccttggttggctcaccgaagaccaattgagctcttagagtccaaccttcagggaaggcattaccaatctccttggaagcattgataatgtatggatggtaatgctgtaaagaagctcctagaccttcctcgtgaaaggcagcccaggttgatatttgagcgtaaccgttagagttggcagcccataatgggacctcgctgtggaataaatctggaacattctttttcaatccctctactgtgggcaaatggtcgaagaataacacggttccgtaagccttggagaagagctctagtttagaagtatatggagaatcttccgcctttgctagttcagcggctttgctccaaagtttctgatgattctctggggtcacaacaattgccctgatgctttgtacgttaaatgaggtgggggaattcttaactatagttctgacaatttcctgaattttctcttgggaaattggtgacttgttggtcaagttgtagttagttctacgggcaacaacagattggagtaaagcggagctcatgactttgaattggaattgaatgtgaattgagagtgcagttggcagggaattactggactatttaaacaattgcacacttcagtgcggcgtaagatctcgcgtacacagcttactaaataattagtaacacaaattaggtaattgacaagttggattataaatttgactcattattatgtaactaaaaccccctattccctattaactatacttcagtactacacgatacatttgtaactgctttctgctgctttgtaattacttccgagtttcttggctcgtactttcgattttctttcgtaggacgctcaatctattgccgatactggaaataaacttctcaatcatctttcgatcctcatcatcaagtttggattcctcagtatcatccggttccaacaatgcttccagcatccagatagccgtagcatacgatagttcagtgcctaccaaatcatcgttcttcaactcatttactaccgcgattcggctgatttcgatggcacgatcaaatatcaacttctcagccacaacagttttgtcagtgtccgactcactttcctctagttgttctttggcattctgtaacttgagtttgataaactctgctttttcaagtgattcgttaaatttacccctaatccattgaactaaatcgttcaatttgggtgatgctggtctacttaaagaattcaatctccaccactccatggcaatgttcattgcctttgacaataagaataatgttttaacatacaacgcaattccttcctcaccaattgtttttataagtatgggcgataaaggttcattgttgtaccctgactgagtaccctcatcgtctccgtaattatcaaaaacagctgtttcattagaaggaggtaacggtgccagttgactgaacttgatttcagctagtaatttgatggcataagctttagtcgtaaggttacttaatctttgaataatctcctcatctgaagttgatgatgtaatagtcaaagagtgcaatggacgagtgatttctcttgttgtagtcgaattgagcatattctggttaaaaacagtagatgtcagtctttcagtgttcttgtctttgtctttttcttccaacaacactggtgtagcctttggcggcgaaggctgcttgaataacctattcgacgcaatgttaatagcctttgaaagagcgttcgtggggctaattgaaataggcactttccgatctccgaagcttggtcttctttgattggaaccagtagacgaagacctagaggaggatgaatatcttctagtatatggagtaccaacattattggttaattgcatagctaaggcaccagatccagcatgctccaattcatcagctaaagcattgacctcaacagcacgtttctccacgaccacgtaatctttctccgagaccaattcccggcgaggttgcgattgtacttccgtctgtttctgagtagttttgttgagtagcatcgacgagtctggttccatgtgttgtatattatcgttcttactaggcagttgatcttggtcttcctcttcgtcctcttcctcaaggagggcttcttccactccattctttgcaatattagtgatgttgttgtttatgtttttatctgtgattgagttccgtggtagatactcgctaatgaacaaattctcgtcgatgtgttggttctgaggtaagagaggttcgtcgctacaaggttgaagtttggtcgtgatcactggatcgttaaaaaactcctggaacgacattctctcagtagcttgttgtttcaacaaaccacaaatcaattgtataatctctggaggtacttgagcaactttggggaagctgatcttgtccttctgtctttcgatattgcgcaatagttccacatggttatgggcaggaaatggaggtgtcccaacactcatttcgtaaacgacagcaccgacagaccataggtctgctttggcattgtacttctcatatcgtaggatttctggagccatgtataaaggagatccacagagggtctctgccatcgatgtggcaggaaggaaacgggcaaaaccaaaatctgcgatcttcagcactggtaactcccacaacccagtgtatttacgatcctcaaagacctctcgagaaaccggaggtgaaagtagcaggttctggggtttgatatctctgtgtaccaggttctgggaccgcaaaaacttgagagccgaggccaactgctgtacgaagttgattgttatgacttcgttcaggcctttgctattctccggagatggatacttcttgaacaccccggttatcaatggatggttggagatcaattcttctctcttagttataaaataggataaatctcccaaggagcaatactccattaatagatggaaataatgttttgattgctcacaatccaatagagcaacaacatgtggatgctttaagttctttaaaatagagatctctacctccaagttctcaataagtttcttatttcgtaacctggatttaatgactgatttgatggccactgagacttgggtcttactattgtagcccttgtacacgttagcaaaggaaccacgacctatctcagcacctaccacatagtcgccaatctttctgtcaggcatttgtggcaactgtatggatgacaacgaagaaccagacacgtaaggttgtatacggtgtgtggcaactcttgttttcaatgtttttttatctcttgtgctagacactcttagggtagtcgctcctgataagataaatattattgcacaatttataggttgtatgagatgctaacaggctgggggaaggcgactgttgcaagtctttatgggtgcaatagtgcgtagcggagggaaatcttgccttctcgtggggtgcttttcgaaggcaaaaactgggtcaggtgaaactgcttgttaataaatttgtgagtgagtcactcgttactaagattaagtgcggattagtctatcagaagtcttgtaatcggtatgtttcccccccccttctaaagggtaattccttatcgggaaatggtcacgagcgattatcgcagattatcgcgggggcggacgagaaaattagtgacctgccagtaggcgccctgcagtcactctgttcgagggagagcacgggcggaaaggaaatatagaggaagagactcaccttagcttatcccttatcaggttttgggtggtgcactagcggtgaaactcatcccagtagtttagagagtcgtgggtggaccctactcaaccgtgtatcaatcgtgtatcacgtatttcatttataattagccctgcctattatacaatcctaccttttcaccaacgtagtggtcccttcaccgatgttaacggtgcaattgtgctatatgctatcaaccatctccatcaaataacagttgtttatctcaaactcctggaactccaactgatatttgcaattcatatcataatcgtatggtgatcttgggggtaaaatctctcccctatgcagtttgtatgcgacttttataccctcacaatgcacttctcctgatgtttcatgcttacttacatttttggaaatgtcaataactttgtgcataggctctgagtcggccgacttgattgaaacgctgaaatgaaatttgatgtagtcacattcctcgtccaccaggagggtcatcatagggacgttcttgaaactgtcctccaacttcgaatcttttgcgacaaattcttcaccatcgttggtcatgagtcttctggtggatctaatacctccgagctggtatgtgcttgtggtagcgtcatcatatccacccaccatctgtctatgcataggatacatctgatccatttgtttcaattcactaagtttgctgtttaagagggaaagagtgttttcattcacttcgttaggtttgcttcccaccaccgagacagttccactatgtacttgcgatgtcacgcaactagtctcgtatgtgcaaacctggtcactttccacactttgaggcgagaacacggatatgaagaggttctcttggtgtgctccaagtatatttttcagcttggagttcatatgttcaagtgacaagcttctcatctgtctgttacttttcaaaacgcgacatagtgtccgactgtcgacctgctctatcacgatgcttgccaactccagtggcagatccaaaaatccttgactggtcattatatacaatgttcgataaactggcttatttgtttgtccttaaaactgggtattcgtcacatttatagatgacaaaatctttatgagtcaagtgtgtaaacctatccctgcagacgatccctacaatttcgggagcatacaatgcgatgtctttccgactttctccttaatcccccctgaacaccctacaattttgcagaccgtttttcgcctctaaaaagtttatccgaattcaccccctattctcacccgatttctcgtgaaattaatccggtaaagaccttggcaattcacgctacgcatggagcaactgacgattacgagttcacagtttagtaatattcgtcattggtgttcaatgaaatgctaattagatggtggctggagtccccttatacagattggcgtgtcatctattgctaatgtacaaatatttctctttctttgaccaaaatctgcctcggtatttcccggaatcgtctggcggctcggaacaaaacagacaatagatcgaaaaaaaaactacatattaataagtgcactatttcatcctttccgtgataatatagtcctcatccttcaataaaacttgcaggttgaagatgcatcggataacccaattccattctaccatcttatagttttcatcttgtttagtcaggacctgggaaatgctctcctgtagtatcttatcttcggaaagacagattatgtagtacgcattatctgacgacttcagcaatcctttgacatctttctccgttagcggcttcttgctcgaaagggtctttactcccgcggctccaaatgactccaatatccgagaaatcactacacttttagctggtagcgatgatgaaatgttgaaattgaagctgtcaaaaagctttgacgcgttgctagcactggccaatttaacgatattctcgttacccagttctggggcaacaaacaactctcgtacttttggattcttgaaatcaatgtgatgtcctatactgtactcttccagttcgggtagatcttgttcctgttttgcctgcaacacggacaacaggaagctctcatgaagtaacaggtttggcgactttgatagtgttattaggaatttctcggtcctcattatgcttggacttataatgcaattgactttggatgatggattatctacaatcttgattccaactgtggaaagttttttcaggtgaactttcgaaagtgtaattgtacatccagttgtaatcgcatgtaaagaatacttcgaaggtagtattacttctgtttcaacgacagcgctatcttgcacaattttggcacgtttcaggtccccatccgaaacatcatagttaaggttcttacgcttggattgcttctggaataaattcaagtcttccatatcgtcgtgaagcttcgccgcggctttggatttcgcttttcgtgatgaagtccttgcagcagatggtgcaggtggtgagctagcaatgccagattcagtggcactatgtgacttgacggttacgatacttgttcttgattgttgggatgatatagcttgattatgtgagttgttttcaggtgataacttgtggttgaagcttcccttcgacaattcagaatcttgaggctgaaagttctctttctctggcgtcacgttcaataagggccgcttaactggtggtattttcttatgtgactcgccatttttttccttcagtttgggctcaattgtttgtttcttggtatcttctttctgaactcgaggtgactttttgttgctgtccgaaaaggtcgaagtcatgctgtcctgcgtaatcgatggttggctttctctctgattacttcgttcaatgccatcaggcgaagagttttgtgatatctcggtttgtatttcatcctgagctacagagagagcactatctacttgtcggatctcacttgactgagtttgagatagtttctctttctttgtctttcgttctgatgtctttttgggtttatttgttttcttttcataaaactgcttcaacacctttttatccaaagatgtacttcctagaatttgtgtcaagttggtttctttagggaaatgcacgtaaacaggatctttgtcattgagaactttccaattacgatagcattcctctaaccaaaggtggttaaccaatttgatgtctttccaagtacgcgcaacctcatattttaatccttgcggttttgacacaattaaatgcgtgtttttttgggataatgttcttgtaaattcgccgcccattaacgttaccagttgatgaacatacaatctagcatcacccgtaaaattagtcacgcttattacaaatttttcgaaccctggaagctttccaaagacatatgggtaatggagcagcttctctagtggagatatccattgatgatgcgaaaacatccaatagagccaattcaaattgcctactggtatatccttcgtgctagcctcaatataaacaggtccctttctataatggcatactacgcaattggcctccgaaatattggttgtaatttttcctccgttgttagtgatcatttcttgaattgtcgaaaggataaaacttgagaggttcaaatcgttgtagaagaagaaacattttccaaccagaaagtcatcagattcattaccaaactctttaaaatcacttattgttcttggaagcttcagcctgttattcgcttcgtcattgagtcgttgctctatatggtgaacagatgacgaatcattgatctcagaatattgtaaaaacctcgggttgggaaacaaatagggagactcatctatccgtctctttaatcttaggcaatcattgatccagtgcggtaaaacgatcttaatcggtatctcctcttcgttgttagcatttatagtagaattgtagtgattagcgacggtgcatttaggatcatcattgtctgttgtcactaaatgggttgtaaacttggttagttcgtccatgcactgtccaccaaaagccaagactccactgatgactgcctctttgtccccaggaggaatatcagatatacacaagaaaacgtctttgaagaagagtgctgggttgggagagtattgtttgtaggtattcaggcggccattacgaatagaatcataacaccacttgctagtaacaacaggtatcagtttgttctccgctaagtcatacccttcgaaatcaatgtcgtttgcaatgatggttcctgagttcaagattgaatctgtcagatcgtgtttttcaaccacaattgagttctgatcacacccattttcaatgagagcatcctgtagtcgataggcctcttccatcgacagcgatgccgattcaactatgagaaaagacgagtctttgaacagttttgccttcatgttgaaatgtgtgagtgctgttagcgtggagagtaaacagaaaacatcataaagacgcgatttattctcttatcagagagaaggaagcgggcatatacataacatgggggtacgcaaaaaggtaatctactgtttatttaagataattgagtagactaagtacgatcacctggccattgcatggaatggcaagtggcatttggctttcacaagccttttgccttcagtaattgactaaatactggttgtgcaatttttttccagcgcgttctgctggaagccccaaaaagatctttagacgtgtggaatacaaacttctaaaatttgaaaaagactgctgccatgagccaactacgaattcatagacaagcaatattgttgaacctatctatctcagggccaattatacttctctttggaaccaactaaccacatccagatcttctcccctcagctatctctatcacctcaaattcgtgtaccacccatccccatacatcgcgattcgcttccagagataaactacacttatcctttatataaatcattatgtctgaggcagagcaacttatagcaaaggtaggtgaatacttcgtatttcactcattacactgtactaacatcttctcaggctgacaagaaatgcgccccggttagtgggtttgcctcatttttttccggctcaggatcctataggttcgaggaagctgctgacttgtacactcaagcggcaaatctgtacagaattcaaagaaagagcaataaagccggccatgttttcgaaaaagctgcagatgctcaaattaaagctgattccaaagatgaggctgctaattcattgattgaagcctacaagtgttacaaactggatgcaccatcagacgcggccagatgtctcaacaaggcagtcgagttttttgccctgaagggccagttccgaagaggagctaacttcaaggctgaactagcagaattatatgaaactaaaatggcagaccctaagcacgctattttggcctatgaagaagcaggcgagtggtacaggggagactccgcagaggctctagccaacaaatgctacgttaaagctgccgatttgtcatgttcagatgaagtacaagattttttgaaagcagctgaaagctatgagagaattgccaaggagtcgttgaacaattcgttagccaagtggtctctgaaagattatttttttaaggccatcctatgtcgtctagccttgaatgattaccctagtgcctctgcattgttagagaggtttgtttcctgggacccaacgtttgagaaaacgagggaatatgaatttgctcttaaattggttgatggtctcaaagaaggtgatccagatataatagcttctgcttcccatgaatacgaccaaatcagtaggctggataacttcaaagtgaaaatcttgaacaaaataaagaacaacattagagactctgatgacttggctgaagatgatttaacctagttgctgtattagtttgtatttaaagagggattacgatatagtacgtcattaattgttgatattggcagatcccatattccactggtactcttgaaacacaagttctctagttctgtgtctgagtttggctcatcgttggccaacacgctattctcgtcaacgattgtcaatacattgttcaatggcactgtcttgatctcaatattgtaaaacagtagagccacgtacatgtaacacattaacatcaataaaaagcttggaatagctacactccaccattttcttggatagtagtagattcccattgaatttaaaatgctatctggaacaaaacaccatattgtccataccccgagaagtaatccgctgatgacatacagagaaaaccctttatactccaagtgtgggatcgagtatttcgacagaataacgtcactctctcttgcaagactatctatgcttccgtcttgaatctcattctctttgtaaaagggtattagtgatgataaagacaaattgctcaatgataagtttgatagtttagttggcttgtaaaagtctgactccaagtcagatgcaggttctggtgtgcgtgatctcaaaggactgtttgattgagaccgtctcttaaatgataagtttggagagctaaggtttctccgaaagcttcttctcatctacccagatgcatgaatatgaagtaatgatatagtacagcgaaccgctctggcatctggcacgagagaagattatatttgcttatataatacactagtcttgctacatactgaatgacctttgagctatgttactcatcctccaatactttcttattgatgtctcaagaaaactcatttaactacttctaattaccagggtcagcgttggtactctgactactagaatctttcttagtttcctcaatacttgttgaaggggtaccttccttgcggacgtatcgtttattgtgaaatacttgacttttccgtttcggtttgtactctcttgttccattcctgtgggttttgcctgtagaggctggacttaacttggaagcttctgattcaacattttctgtatcttttggctgagctggttgggttgtcctgaaagaggtagatctactccgctcaactttggcgttatccctggatctaggtctactcctaggagctcgatcttggtctttaagagaatcacgttcttttctttccaaatgatttaattgtccagaatgaccattggttttatggcccggcaaatattgaagatcattgccatttttgtcctttggaagtgctgactccttatcattggtcacagttgtgactgcagaagcattgagatttgagggggattcaacaagatcaggtcgtctgtaagttttgttgtgaaactgtttgacagtcctgtgctgaactctatcgtccgtattaggaggtgatgaaaccaggttcttatctttttgatcatgtatagatgtgtctttcttagactcccgctgagaaaaactctttcgtgttttttcagaagacttgttttcaaacctttgagtttccaaatccttaccagacctagcttgtctatctggtctttctttcttcttgaatttgaacggttgcttcttttcagcttcctttctcaattcagtctttttctcagaatcgccttcttcaagttgctcccttccagtctccgtctttggtgattggtcttcgttctctttctctttctctttctctgcctctttctctttttctttctctttttccttctctgcctctttctctttcttcctttctaattccagtgccttctccttctgtctctcctttagtttctctctttgtttctctttcagcttctcctttcgctctctttccttttcctttctttcatgctcttttctttctttctctctttttgcctcttctctagccctttctctttctctctctaattccttcaacctttcttcaatctccttctctttagccagtatattgacaggcttagcagcaccaaatggatttatcttaggtgtgggcacaggttcaggatttatttttttagttttgagaacatcttcaggaacggttttcacaggcttggcagcaccaaaaggattaaccttttccacatgagctggcttcacgtcttcagtaggaggttcttctctctttagaatcgtcactggtttcttggttgtagcagagccttctaactgcggttctgcaactttctccgtagtcttcgcagctttaagagactgtacttctggtttaactccagcacttgtctcagccaccgaagcacgtcgtggttgtttacctaatttgaattggatctcttcagcctcatcgtcgtacccaatagttttgttgtaatctaggatactctgaaaatcatcacgatctgcacaggccacagatatgcgaattctccccaggttcaaatcttgccacttcagcaccttctgcagaatagcagccgatgctacttgaacaaatgcacatttccttcgctggtgactatcagtccccagtcttgatatggtaggaggatgagggtcaatcaaaagctttatcctgtcataattgcaaaatcggctctcaaacagatccttgattaatactctggtagctgtttcaggtatgttagaaaacttggctatgaaagggggtccttgaagcacagggaaatctcgttgatttgatctgtaatgatttccaccgtatccacgatacgcgtcgtgatgtgtaacaggcttgcctataggtacagagatcgaattgatatcaatgtcatcatcggcccaatcgccaaactcttgatctgttaagaactcgcccaatgacattttcttgggagcttttgacgtgttagtacatttctgctatttattgatttccgctcaattcgcaactaataacatacccatttttgatccttgcttattcaattaaattcaattctattccttatacaatccaggtccaataattaacggggataagttataacttgtgcctatgaaacacaaaatgaaaaggataattaatttgccttcttggctagggcaatcttataaaaccttaccatcccgagtgggagggtcatcatgagaaacagtgcacatacttggtcagtacacactatgggctcactaagggtggtgtgccattttagttttgagtagtgtgatgagctccgacttggacttaatcgtcgtcccctgtacgttcaattgcggagattgctttcgtaaaagagggaatggtgcctcaatgcgggaaagcaactttgggtgaatgaatatgaatacttgaagttttggtcgtgaaagaacattgacatgcaatttaaatctcacattccaggtggaagtattcacgtatgacataatagagtaatcgcactgctctacactggaaaataacctcacatttaaaccattttgaggacacctatgtcgaattatctcttccaaaagcactttttgggccgagaatggagtgtatatgactgtttttctgttggagtaggtcaggtttagtagcatataaagatagacgcagtactcagcttcttcgatattttgattattaccgttttcaatttgtataggcattccggctactttaattacttgaacctggtcgttcttttgaatgtgttttgggtcggtcgaatacaaattgaatatttcttctggctgccttagattggaggagagttttagtggtggacttgtagcagtcaacttatgaaacaaagaacagttgtgaccaaatcgtgacaacttattttcttcatcgaatttggaatacttggtgctgtcacctaataaagccatccggtttacgtttttgagaggcaaggcggaaacaaattctgggacttgttcggcatcatcaattattaagttattgaagtggagattatcttctttaaccagttgatctaaactcaaaacgcaaaaagcagcctttttctttaatagcgttattctttgatgcggtgggaagaacaatatatccctcaggaatgtaataccttcaatcatttgaagaatctttctgtagccctctgtcatcccttcaagggtatcacttccaaaaatcttgtgaagtgaaatatttctctccgttgaagggctgcctttgagcttttcccactctggctgtatgtactccttaaaaaacaatatcgatgaagttacatcgttgccatataaatgattcatgtccacttgtttggctatttgttgaattccatctaacaaaaccgacagatccttctcaaaatcgtatgtcttctcgtgtataaatattcggaatccggggcagtccagtaactcttccacaaacctggttgagcttgtcaatatcaaacttgattctccaaaatttttataaaaatgatttgcaataacagcagaaaccaaagattttcctgagcctggaactccatccacaatggtcagtcggctcttcaatgtagagagaacgaccctggtctgttctttggtcaaattttctttaaccttagaagttaacaatggacttgatttgaccactatttcaatatcttcttcaaatgagattatgaaaggtgccgataaggattttattcctttccttcttttagaatcagcagactttgtattaaatccagaattggaaagctctgcccattggacatttgtcagctggatattgtctttagtttgaagtggaaagcttgagacatcgacgtgatgaaaaatgctagaataccattcgggaacctctagtttcatttgactacgttcgaaaagtgtcctagcatttgagctattcaacttttcaggtatgaacgctaaatttgcagattgaatatggaaatcaagtttcaaagagatagttaaagactttcctttctttgttgcctgaagccggtggatctgtcccaagcatagttgcttaatcccgagttgtggttggatattatggtccagttggttgggttcaattatatgcagaagaactagagaatctcctggtttcaactgggaccaactatttttttcttgatgagtatcgacgataatatctgcagtaaaggcagtttgacgtattggaacatcagagtcccacacctttacatcctgtagtactagttcctctacagggcagagtttcctactagatccactaaatcttaacggatctgctgattcaacagagattctgtcaagtgattttttcaactcttcgaagatcaaaacacacatttctgcatgataaagtaaactatgtctaaaacagaagtcagctgaatccatatactgattaccaattcggggcaaaatcttatattcgtaaaatatagtcttctcgtcaatggctagtggacactctgttacttgctgtaagtgcctgatctcgttgtagacgaatctcctataatcaatttctgacaaggaaagtttcaccaagggagttgaaatatctaaacttattgctacctgctccactctttccacgctcaaatggctccatatttgcaaaaagttcttctttaggccttggtaaaacgattggtcttgctcaaacaatgctaaatgaattctatcgaagatggaaaccttgttattcagaaagttctcctgtaatatcggctgtccggtaatatcatcaattggataatccaagtagtaaactaatacctggaaacctttatcggaataaacttggggaaagaatgtttcaatgtaagagacataacgtaagtgctttaacagaggaccaatgaagcgtctagtaggaagctgtgtaattaacgttaaaagcaatgattgcacattagggctctgatccaactgaatcaaatcataaatccagctctccggtggagcctccttatagagatcttgaaagtcgccaggtatcaaactgctcacattaggaagaacatgccaagttccaattgacgtaagcctcttagtcacttttctcaaaacaggaaaatgagtattctgaaaaacagagttcataaactgaatcatctgggattgaatatactcagaatatttaccatcgtgtcgtttagctgtgtacgaagtgataaactcaacaatcaagtcaaatcgggaatcattaccgaacaactctaaaagttgaagatcattgaaagagtagtatagatggttagatagtagcacaagaagcgcaacgtgatattcagttgaatgttccgaaaaatgctcccatagataagtggtcacatcggtatctaagaggtgatgtaatgcatctgtctgtagctcctcttgcatcagctggcaaaacacttccttcaatcggtcctgtctattggaggagcctagttcgacccaccagttttcggacagattgtgcaaggtcatcaatctaaaattggcggtctcctccttccagaaaccaacttgtactcccactaagtcgatactgattggagtttccttcaaccttcaggttcgctaagaaacgcgaaccaagtgggataaaaattttcccttctaaaaattttcctacctataaaactaccatcgatacaatgaacagaggtagaggaggattttctcaaagaggtggtcgtggaggctttggtagcagaaggccagctgttcctgaaggccccccagatgttgttcaagaaatgggattgtttgttcattcatgtgagggagacattgtatgtcgttccataaatgaaaagatcccttattttaatgctccaatctacctagaaaacaagtctcaagttggtaaagttgatgagattctaggtcctttgaatgaagtttatttcaccattaaaccatctgagggtgttcaagctaaaagttttaaagaaggtgaccgtttctacatctcacccatgaaattgttaccattagaaaggtttttgccaaagcctaagcaggtcggacccaagccccctaagaagaagggtggcagaggcggtgctgcgggtggaagaggcggcgctcgtggtggttttggtggtagaggtggagcccgtggtggcttcggagccgccagaggaggctctcgtggaggctttggaggagctagaggaggcgctcgtgggggttttagtagtggaaggggcggttcccgtggaggtttcagcggtggcagaggaggaaaacgattctaagacgaaaacatggagtttgaaaaccccaatcaatatatgtgtataatagtaataagattgaccgaaagaggaatcaagctggcatggtgcgaagttgaatcgcgtcaaccgaggtaaaaccttgaagtagtgtcttgtgaccaacaatttttccagtcagcattcaaatttaagccgttatgcatgaaacacatataatcgtgaatgcggtcaaaccctaaaaatcgttctatgcagcaaataaaatgagcatcagctgttgtggctattgacagcttattacagcgagtgatatcactattaattagagtgaaaatgaagttgtctgggcaaagtcaaatcttttgttaactcatgaaatgtggctttaattaattcggtgcaggacggaataaatttttcaagccctatggtgttcggtatcgggttatcaggcaaggttgcaagatatttgaacactaatgacagtgcgaacaagcacatctgagatcggaaaaatgacattccttttttcgcaattttcttaagttgaaggaaaaaaggctgcatccaaaggatcaagtttgagatgaagcagccaatttgacatattaacgcctcatgatcttaagctaaaaaaactgtttagaaatgcaatccatgaataacgtgctcgatggtgcagcctttctattgtgcgaatagctggcattttagtttggggtgtggcgcttgcattattgcttcatgcgttcttcgcaactttcagctctgtcaaaacttccaaatgtctataaaaagtaccccaagatcctcttctaacacttttaagaaaacaataatatcaaatgtccgaatctccgaatcctaaattttctccggagttgaccaaagacgattccacagaagcattcacaaaatatgagggttctgatgtgctggaagagcagagtacaaaagttggagtagtaacacaggaacttaatagggccctacaaccaagacatgtgtctttgattgcaattgcaggaatcattggtacaggactgtttttgtcttattctagaagtttggcgcaatcgggacctctgtcgttgcttttgtgtaatatgttgattggacttgtggtatatttgacaatgttaagtttgggtgagatgagtactttcatccctcagagtggttcattctgtacttatgctaagagatgggtttcagagtcttttggttttgctattatttgcaactactggttcaacgatgcggttagcgttgccagtgatttgactgcattacagctgttgatggggtactggactgacttccattattggattatttctttgatcttttggttcttcttactatttttgaatgttatccatgttcgattctatggtgaagctgagtactggatggctattttgaaagtagccactattgttgccttcttcattgttagtatcgtggtgaatgttggtcacaaccccatgaatgagtacattggattcaggtattggagtcaaggagatgcaccgtttgtggatggttttaaaggtttctgtaaatgttttgtgtttgtttcctttagtttcggtggtaccgagtctattgctattactgcaggtgaacaggtcaaccctactagaactatgccccgggttatcaaaacgacattctataggatcatcatcttttacgtcttctcagcattcttcattggtatgaatgtgccatatgactaccccaatttgtctaccaaaagtactgcaacctctccgttcactatcgtcttccaaatggctggtagtaaaagtgctggttctttcatgaacgctgtgattgtcaccagtgtcgtctctgcgggaaaccatgccctttttgccggtagtaggttggcatacacgatgggtacagaagggtatattcccaagattttcaccagaacgaataggtatcaggttccttacgtgggagttttgatcacctggtttattggtggtgcatgctttggatccagttttattggcgcaggaactttgtggacttggctgcaatcattagtcggagtttctaaccaaatttcatggctttgcattgcaattactagtattaggttccgcagaggattagaggcccaaggcagaaccgacgagttggcattcaaaaactggacatatccttatggcccgtggttctgtgtggggttcatcagtcttatcattttggtacagggttggggctcttttgatccttgggacgttgctgaatttttccagaattacattcaactattgatcttccctacctgctttgccgtttggtatctttacaaacgggaccgcttcacgcggcgtccagagatggattttgatactgacagataccatgaaacagagaaagacattcttcaaaacaaagctgaagacgaggctaaaggatttggtaaggttgtcttctatatcaagaactatattatttaacttccagaaagagtttgtttgtttttgtttttagagtaataagggtagcaataaaaatgagctgttgtttaatctttcccttcttctcctttcaaccctgttccgtaacccctaactgtatattcagtccaaagctttcaggcgactaccaaatcaatgaagaactacagtcacaagtgccgaggtcaaatgaagttcctttggaacgaaaaagtcgggccgacttgtagctgataacaaaaataactcttactgtacttattaggcaatagctagccttacacctaaaattcaccatttagactatgctggttcggccccggagtcaccaatccgcgatgacagctacataaaatcttaaagtaccaagactagtgcccacattaaaagcacatgcagcattaaaactttacattctccgacggagctcagaaagttttggagtcaatcgcaccgaaaagaggaccaaaggatctctggtcagtgtaattattaagcaatctacgttatacactttatgcatgccaagaggggcaagtcgaaccctgtcccctcatttggagtttcgcgaaccagatcacgcattgaaacaaacgagtttttcttttggccccaccagaatgcataagccactataacttaaaacttggcaacagattttagtgccctccatcgagtagggggtaagttgccttggcaaaaaaaaaaggttggtagttagggatgaactacaaagattgaaaacaagaatggacgtttttacaggttcgtaggacatttagacctcttccattctacttcacggtagtgttgctggaagtttgctcgaaacttccccacttttggcggtcatgggaaaagttttcccgtagtccagctgtgtatatagtcccgccctccacagtcgtatgtttcgggagagtcggtatctatgcactccgataaaagttttttactaatctatataaatatacccatgctcacccttttcttgaaaatcgaatctagttgtacccgatatcatggctgataattatagtattaagtctttgcaggacagtgagaaagctagaacacccgatgatgatgaaaacagtttggcccgtgtggttctatcccaaaatgaagaatacatctttctaggaagacagaagttccgtaagtcagacctttacgccgctttcggaggtactttgaatcccggtgtcacagcaccaccaattcacaagtttggtaatcctgctccactgggtttatcagcttttgctcttactacttttgttctttcattgataaacgctcaagctatgggagttacacaaacaaacgtggtcgtgggactggctctcttttacggtggtttgatccagctattggctggaatgtgggaaatggctgttgaaaacacgtttggtgcgttggctctgagttcgtacggaggattttggctgtcgtatgcagttttgaacatcccatggtttggagttgccagtgcctatgagcagtccagagatttccaagtggccgtgggattctacctactgggctggactattttcaccagcatgctatgcctctgcacaatgaaatccaccgtcgcattctttttgttattcttcttcttggccattacattcctcatgttgacggttggagaattggctccctcagttaactgtaccagagcagggggtgttcttggagtcatcacagcttttatttcttggtacaatgcttacgcaggtctaagtaccccagagaactcatatatacaggtatcagctgtacccttacctggctctgcaagcagaggtctccgaaccaaatagacatgatatgtatgaaactaatgttcacttttcacgaattgaaaactttttaaacttgggtgtagtcattatcttttaaactatattatcgtccaattgactctcgagattatgtaacgatttgaacttgttcttgattctcttatatcttaattgtctctgttttttgtttctgagtctcatgtacatgtcattaattgccaaagcagctgtagatccgccaacgttgcaaataatatccctccagtcgaactctctgtacgcgagaaacccttgtaagaactcactggcaactcctcccagaatgatgcaacatattattgttaggaaacgcaagactcgtattgacttgatctcaaagctccaatagaatagagtagtgagaagaaaaaatatcaagaaatgcaacagtttatcattgtttagtgaaattctggtaaatccaagtaggcctgctactattagtccaagaatgaatgctactccgggttagtaaataggatcgatcactgatgataagagccaagcccacattgattcttaccaatgaacacgttttttctaactggtattctcataatacgtcgtgtgtctatgtcatgtattactatcgatgtaccctaaaggcttgtttggaagaagtagctttcaaacttaatctcctagacggaagacccacgaaatcgccttgcccaattcactccgctcgtaccagctaccccggccaaaacttataccagttcgcccccacaagtgtcacatccaaacacctttctccaatttatcctcaacttaaagcggcatattctcctctcccaacttaaccgttttgcttcccaatggcttcgtttgcaccacaaggaacctttcaacaaccgttgtctacggaagagcttagattctatggccagcttttcaagtcgcttgaccctgagtccttgggcgttgtcactggagatgctgctaggtcaaccttagagaagtcaggtttgccccctttggttttggggaacatatggaacattgccgactctaatgcgacaggtttcctgacccagtatggctttgccatcgttatgagactaattggccacgttcaattgggaagagaactaagtccagatctataccaaacatttggcagattgccttcttttaacaacggcgctccggccccacagcaacgatcacttccagaacagtacactggcacagcacaatctatccctccattgaccaatgctgatgtgacgaaattcggacagatttttgatcagactgccccaaccggtatcctctctggtgcagaagctagaaatattcttcttaaagcaaagctaccaaaccacgtattgggacaaatttggtctctggctgataaaaatgatcttggcaggctcaacaaatccgagtttattattgcaatgcacttgattcaggttgtgcttagtggagcagtgactacaattccaagctccctccctcaatctatctgggatgttgccaacaataccattcaatccagcccagccccatccattacttctgttttgaatacacctattcaaagacagttgtcttcaaatcttaccggaccttcaacacatgctgtccctgttgaacaatgggctatctcacctgatcaaaaacaacaatatgataggattttcgaaggattggataaaaactcttcgggatttttgtcagcatcggagtctgcaaagtttttaatgggctctaagctgccccaaaacgtacttgccaatatctgggacctatctgatattcaaaattctggaaaattttccaagacagagtttgcaattgctatgtttttggtaaacaaaaaagttcaaggtgttgaattaccagaaattgtacccgattcattgatagcaagtgctggtggtgtagctccgaactctagatctcgtttctctccacagcccacgcagtcacctcaaccacacccatcacaatctgttaaacctaaactttcctctcttgatgagttgtctggtctattcaattccgtttcacctactcctcctgcgggtcagaatagtcatggaaatttcaaatctccccctattgcacctccatcacgtaataacacagaccttggcggggtaaagcaatttgttccttcttctacatttggtcaacaatttttggaaaaagaggctaataagcaggaagccccatccttactggaagagtcttcagatgatgaagatgataatgtccctgagactattggtgtccgcagacaagcacctccaattccaaaccgcaatgagaaggctaatcttaactatgaaccaaattatggtgcattgaaatctgtacaggatacgaagccttcaaccgtacgtcaagtgtcatttcaggaagcccctaaaactcagcagtatattccacaaccgaactctgacttattggcagattctaatcctgaagtatcaagagatttgtccaaagccaatactgacattgccaacatttctaatcaagtttcatctcttactcgccaaacaagcgagctgaatgataagcgtgacagagctcaagctgaattggaacgaatcctaaaattgaaggagcaaatccagctcaagttatcaaacttacaaacttcttactctgctgaagttagtcaagtcaaactgctggaagagcagctagccaaagaaagctcacaaactgagcaactgagacaagaggcttctttacaggaagcaactttccatacgtctcaaactaagcacaaagaaatggaagaaaagtatgctcaaattgaggccgagaatcaggggttaaagcaacaactatcatattatacgtcttccaactctgaactcaagctcaaactggaagaacttgagaagcaaagcaaacaatcttcaaacattctctcagtaactagccaacagtttaccattgctcaaactgaaaatcaacagttaggagaaaagattgaacaactaactcaggaactgaaggatagtgaacttaaaagtcatgagttacaaaccagcaccgaacaattggaccaccgaaaaactgaacttttggaaaggaataagactttagagaaacaactagaagcatatcaggcagatatagagagtcgaagcagtcaattgcaagaagcggctagggagatacaggagctcgagctgaaaaactctaaactgaatgatggggtcgaacaaaagaaagttgagctttccaatcttgctaatacttctcaatcccaagaaggcttgagtgccacggctggtactttagtgggaactgcggtcgctgctgcggctgccggagctgcaggcgcagcaattttttctaaagagaataagaataatttagaagatgccgccaaacagtcgactattggttcgcaaactgaaaaagccctttcagtcaacactgcggaaacttctgttgcctctcttcctcaatcagattatcaactggccccagagagtactctcacggaacaattcagcctaccgcttgtgagaccagaatcgctgacgtctagtgtgcagaataatgcacctcaatctgtgagggatgaatctgaggttaggtcgtctatctctgtagaaggtgagtactccaataagcaacctcaggaatcatcgcctgaggagcaaaggcccctatcatcggaagctggttcttatgaactagtagaagctgagaaggaacatagtgagtttccaggtgagttcccggctcaatctgaagacactctggatgaaaactcgactgcttttacgaccgcaaatgcttttgctgatagttcaaatgcttcaaatgtaggggaaaacataaccagctcagatgttgcaacatcggtagacgtcgaaaagtccatacaatcaaaccagaatgattcctcaaagaattcagatatttcggcagaatctgacaagatccaagatcgctaccccaagatagagaccacagaagatgaaggtgctgccgatatagaggttaatgatcctcttccagaagagaaactgtctagcgtgactgataaagtagcctcattatctatcactccaggagtggtggaacctatcccaacagcagaaaatagccaattctcatttgaaggagagagctctgaatttgataatgaggtgtctaagcgcttagattcctttcaaaagcctacatctgaacctgattctgaaacttcgtctgatgaagatggtcccgaagatttggataaaaaggtacaccctgacgttaccgcaagtgctccggttgaagtaaaagaagatcaagaggcaacttctgaagatgatgaggaatttcacgacactgtggaagaatttcccacgcctagaacagttcctgttttttctaacaatccgtttcccttattttcaaagaatgatgatgctggtgttccagtactgaaggatgatcacgttgaaccagcacatgatgtggtcaaggaacaggatgaattcgctcaactcgaggaagcagcattggatactagtgtccctggcaaatttgaattacctaaatcgtctgtccctgcctttggtgatgaagatgtacaactaacccagggtactgctaatgaacaggacgagttcgcagatttggttgccccccgcttggaagctggagaagaatttgatgagttttcaaagttagaagaagctcctatagagcaaaccgatcaattaaatgactttgaaaaccagttcactaacgatttctcaaaccaatttgcagaaagtaattttttcaacagccaaacgcagacctttaatgatactcagggagacactgaaggaagtaaatcagatgagtgggaggttctatttgctggatttggtaatgctaagcaagagacttttgctccacccgtacaggagcaacaaaatcaagagtcgtttggccagacgggatttggtagcagctttgatatcaatgattcgggcaaccaggctcatgacttagcgattgaggaactggtcggaatgggatttacgaaagaatcagccgttaaagccctggaaaagagtaattggaaactggaggatgctacgaactacttattggatcatgcataacttctctaccatatggtatttactgttttgttattattgttcacgtacataaaatgtaactttatggggattttagtaaacgatttgtagccgaatgctggatgttacgcgctgctctccttctatggaaagagccctctttacaccatacagtaaacgtacagcacggctgatatccccttttggctagtaatccccaacagactaagattccccacttagagttctttcactcaaagaatcatgtcaaccactgatttagacacttcaattcacaatgctctgcctctcaatttgcaacctacccactatgatctacagatttttgacatagatgagactaatgacacattcaaggggctggttaccattgacttggatgtgattcaacaaacagacagactggtgctcaatgttagagatattgtgatagatagcgtgcaattaaaatttaacttaacaaaaaccgtaactgaagttggatgtacaatcgaacctacggacgttgttaatgagactgtggtgctcaaattccaagagccagtcaaatcaggatcattgaaggcagttatcaattacagtggtgtcattcaatcgaatatgacaggtttttataaatccacctataaagatctggcatctgatgagattaagacaatgctgtctacacaatttgaagctactgatgccagaagagcattcccatgtcttgacgaacctaatcgtaaggcaactttccagctgtcgatcgttacgaggacaaactacacagttttatcaaacatgccggtcttgtattgtcgaactttagatgacggtaagaaattcgcaaccgatagtcgtgaattaaaggttgtacagtttgaaaaaactgttgtgatgagtacatatctattggcctgggctatcggcgagtttgagtatttagaagccttcacagacagatcttacaatggtagtaaggttccaatcagagtctatacagcaattggaaacaaagagcaaggccgatttgcccttgaaacgtccacaaaagtagttgatttcttcagcaagatttttgatatcgactatcccctaccaaagctggacttactatgtgttccaaatttcacctgcaatgccatggaaaattttgggcttttgaccttccgtgcaaccgctttactctttgacatcgagaagtctgatcctaagtacaaaactagagttgcctacgttgtatctcacgaaatagcacatcagtggtttggaaatttggtaacaatgaattggtggaatgagctttggttgaatgagggtttcgcaacctgggtaggatggttagctgtggatgagctatatcctgaatggaacgttttctcaacattcgtttctgaatcttacgaaagtgccaaaagtttggactctttgagaaattctcatccaattgaggttgctatcaattctgcaaaagatattgaccaagtgttcgatgcaatttcttatctaaaaggagcctcagtcatccgtatgctcagtcaatcagtcggaattgatgtttttctgaagggtgtttctatttatttaaagaagcacaaatttggcaacgcaaagactgttgacttgtggagtggtatctctgaggcctcaggaattgatatttcaaagctcatggacaattggatcaaaaaacagggttacccttatttgaaagttgagtctgctggtgacaacttaactattactcagaaaagatttttggcagctggagacattaccccagaagacgacaaaaccatttggtgggtgcctctaaacatttctgtcggatctggaacctccgttgctgaaaactatgccttaactgagaagtctgctgttattcctagaccagattctccatttttcaaattgaataaggactctgtcggtgtttacagagttttttatagtgctgacttgctgaaagagatttcaaagaatttggaccacttttcagcagaagacaaagttggtcttcttgctgatgtgaacgcagccgcaattgctggttttctaccaacttcaaaactacttgaattcttattgcatttcaaatcagaaactgattacgtcgtctggtcagaaataatcaagtctgtggagcatttgaactccgtctggtctgagacctctgatcaaagactatctaagtcacttacgaaattctgcagagagctttttgcctcacaaagtgaaagacttgggtttgaacctaagggaaatgagtcgtattttgatggtcagctgagaccattgattctgttagctgctggtactagtggattggagccagttgttaccagatgtttagagctggttgaaaattccacagctattcccccgtcgttgaaacaagtggtgtactccacagttctaagtcaaaagaatgcaactcaagaacagtttgacctaatcttgcaagacctctacaatccttcttcgccagacactgttgaaacaattctgatatcgcttggaagtgtccaaaatgatcttgtgattcctcaagcggtgaaactacttgaggattgtctcactggccatggccgtattgcccttatgaatgttaactttctagctggctctctagctacaaaccctaaaaccagagtactagtttggaattttgtgaaagctcattacaatgccatctttgagactatgcaaacaagtgtcattttatttgatcgtttcatcaagacacttaaggagcatgccgatatttcaattcacaatgagatacttgagtttttcagtaacaagaacgtggatggcttcaacagatctttgcagcaggccctagaccaaattaagaccaattatgcctggattcaaagagacaaatctaatattactgaatatttaaatgtcgagtagctagcacttcatgaatagatgtttattgtacgagtactttgagacgcgacgcgcaccttgtcactttctttcctcatgcatgttgagagaagagctcgtcaagtctatcactaaacagaaactaaccaattttcaactgctttcgatatgtcgaaactgtggattgccaattggagcatctaataaagcacagttaatcgaggatatcagcctctgccttgcaagagagtctttgtttaccgaaaacaagaaatactccatagtttccattgatgttggagttaagaactttgcctttacaaggttgcaattggagggtggaaatgttttcaaatcaagatcctcactaccatccatattagagtggtttaagctggacttggaacaatttgaaggaatgaaaactttctcccctttagcatactcaagaatggcatactatttggtggaaaagctgatttgcaaatcatcagatacaggactgctcaccccttcagtactgctcatagaacgtcaacgatttcgaagtaatggagggtcttcagtattggaatctgttatcaagtccaatattatcgaaaatatgataatctccaacgtttacgcaatgggtcaaatgaacaacgactacaaaacaaatataatctcgtcttctccagcaagtatggtgaacttttggacaaactacaaaatgagtgacggatccacatatctttctatgaactctaaaaactccaagaatagcagaatggtacttgtggatagatggtttgatgcacttttgaaaggaacaccagcaagttttttgctgggtgaccaactttcaaatagaatcaagagcaaggagttggctatacttgcgagatgtagcaacccctcaagacgtatctatctactcatggaaatgttgaacaaaccttcaatcggatcaagtgttgttaaaggggatgaccttgctgatagcctgttgcatggtctcagcttattgagatttgagcagaataaaatgaagctaagggaaaatttagaggatttgcatgccacgattaatcaaattgaacaaagtcacgtacaggagatatcaatcatcaatcaatagttgcttagtaattttcatagtcctttcaagtggccactatcagaaagaagcagtcaatttttatggtccatgaataattgtgttgtgccctccgtcaataatcatcaactcattgacacagtttttgatgttttcattcaaactatctctaatagtagtacagatagtttcaacttcatccttgcacggaataggcttattcaacaaaaaagaaactagagagtagtttccacttagcttcactacccaagtcagccctacgatttgtatggaggacaacttgttaagataattcctaaccaacatcaaacagacctgttcaaacagaatatcacatctgttttttatgtggattctgaagaatatttgagacaccacattgtcatgaaacttgcacaagactggagacaacccttttcgaagaatcaacaacttatatgtcgagtctagcatgaatgctgaatcttttctcgagctgatgaatttctttacttggttgtagtagatgaaggtatctgttttttccagttgtgcatcctgcactctttcaaacacctcccattcatacacaagcggggggttatccattttgtccatgatcgaatccctttgtgcctcgtatattgttctgtcatcctttgacaacagaatttcgaaagtgggcttactcaacaaggcaatagatcgcaaatttaattcgtctccagacgattgtgaaccacattgttcagatttgttcgatgccgtattatctacagttttattttcttgatcatttttgcgtgttatgtgtgacattttccttcgaaatgaacctactctatgaaaaagagtgcttcttcctgttgtctcgcaggatggaacagatctcaaggagttttcaccgcattctagatctttgagagtattagtattacaatattcttctccgtccactactgagggattactgagagactttcttctaagaatggaaagaaagctgtcactattcatgggtggtacaaaaggagtggaagatgtcactggtatcgagaaattgaacaaaaaactaggcgacttcaatttttttggcttgataccgaaaggcagatttttgaataaaaggatgctactcaatctggtagagctctggtttggtttattttccctcaaagacttgagtttgtaagttagacttagtttatttcatcgttggtatgttcctgtgtaccctcggtttaaaaccggaaataaaaaactcgaggcactgaaatatttttttcaatagaatagtttttcctttacattgatattcaaactatctcccaatacaaagcgccatgagtgttgaaggaactaggaatgtgggctcctctagtttggataccacaggaaaacctaaatacgggagaaacaaacaacttggtgccaaactgaaacgttatgggagggaacgtaaagaggctctggaagctgcccgtagaacggatatactgttgcaggaagaacccggtttcttagagccagaaaatgaaatggagaaaacatatgaaataactcaaaaggatttaagagaaaatgtagacattggtaccgcagcaaaggggtttgagttgaagttgaaagattatggtccgtacagcattgattacagcagaaacggtagagagctgttgatcgtgggtaagaaaggccacgttgccagtatagattggaaaaaggggcagttaaatacggagctgcatctgaacgaaacatgtcatgccattaaagctttgcacaatgatcaattttttgcagtggcacagaaaaaatacacttttatctacgacaaattaggaactgaaattcatagaatgaaacaacatattgaagccactagcttggagtttttgccttatcacttcctcttggtcactgctggtcaaacaggagtcattaaataccaggatgtatcgaccggtactctagtagcagagctaaaaacgaaaatgggaccaacactatcaatgactcaaaatccttggaatgcagtcattaattgtggtcactccaatggagcagtcaccttatggagtccctcgatgccaaccccgctggtgaagattcaagcttctattgctccggttagagctttggcggtcaacagggagggaaattatatggcagttgccagttctgatagaacagtaaaaatttgggatattcgaacctataaagaggtggacacttacataacacccattccagccacctctctggacatatctgatactggtttgctgtcagttgggtggggtccacacacaactgtttggaaagatattttcaagaagagacaagaccatccttatatgacacatcaaatcagaggttcgcgtgtccaaagtacgaagtttgttccatttgaagatatattgggtgtaggtcatgcctctggcttttccagtcttatcatccctggggcaggtgaggctaactttgatgcttgggagatcaatccttacgaatctgcccagcaaagacaacaaaatgaggtccgtgctcttattaataagctacagcccgaaatgattacattggatcctaacgtgattggtactgtagataccgccgtgaagcaaaaaagcatgctacccgatgacgacgaggagaaagatgcagaagataaagaacctggcgatgaagaaccgaagttggatcgttacgttcctgacaaaaagggtaagcaaacagctctgcaacgtcatatgcgcaagaagactcagaatgacctagaagaaagaagactccgtactgaaagaaatttgaagagagagcaggaattaaatggaagacaagaccatggcgaagaacttcagaatccagcactagacagattcaaatagatatagatacttttaataacatgtatattagatagattctcgatgggtaaatcaatcatttacttatctattcgtcttcctcttctagagtgaaaggtgccggaagaggggcattcttattggtcaactgtctcacagtcttgatagtatcggctggctcatcgggtcttgaatcgtgtagaacaacgataccaccagtacctctaaactttcgaacaggctgatacctttcgtccttaataaaggaaatgtattttaactgggcaggaacaactcttgacatattatcgatctgataaggagtgctgacaaagttggtcttagtcgaattgttggtgaactcttcagttgtgggctgttcagtttcgacattggaagttgtggtttccagctttttatttgtttcttcgttgtcttttgtttcttctttgacagctggaaattcctcgtcaggtttatcgatatccatagcatccgattctttctcttgcctcttcttagctctagccttggcccgaacagtagtagaaaggatcgctgttgccaatttatctgtttgcttggtcttggcctcttcaacttttggaggataactaaacaaatcttcgcttgtgtgacaattaatcttgaactttggaactttgaagtcatctctaacaccaatgatcgatgttggcgtaaatgacaaagaaaggaaatgtgaaaatgggaaccagtaccatgattggacaaaaacagcaagtccaacaaccgacttcaggtttaacgtaccagtttgactgttttctagctgaatggttacattacggccacctgcatcaataataccttgagctaggacagctccaaatttagccaatgactcttccattcttgtgtcaataactttagccagtttctctctaatttgcttgaccttggggcaggttttctcattctgttggatcaaaatcatagacaatgcgacgaaagcgccttgtcttacaaagtcgacagggtccttcgtaaggggttctagaaactcaattgcagaattcaatcctctaccagcacatgcaataccaactgccatagcagtaccatatcttacgtgagggttgtgagattcagctaatagttcaactaatgttgtgactgttgtgtattctctcaaaagaataaatccaagagctataactgaaactcttctgacattatccgaagagtctgaaacagcaatatgaagaagtcgctgaatagcagaattattggaggtaccacaataagcaagggccaaagcaaaaacaccaccgtatcttaaaagagcattttggtgaactaaaagcttggcaatcacaggctccgctgcatcttccttagcataacagagtagtgcaatactgacagccaatcctcgaataattgtttcgtgttgagtctcctccgcataatgcaacatatcgtcaatagcctgttgatttccggatcccaacatgaccagacccatcgacaaagctgcagcttgtcctgacacagcagaatcggtgtaaagcactgttttgagctcttcgtaaacttcttcatcattagaccccattcctgccacaccgacggctagagctgctccatgtagaagaacatcaaaatcagagttgtcggcattgttggtaccggaaagaagatggcctcttaaataatccaaaacttcctttccatgacctgcatatataagtcccagtccaaacaaggaaccagacttcgtgtatggagatccgttattttcaggtagataaggttgtaataaagtgcgaccttgtagaagatttcccttatgaatgacaccaaaagcagcactggcggagaacttagaccagttcgtagctttcccaagccactcaagattgttacggaaaaaggaatcgtcagtggtaccagcatgtaagaatgcattggaaaaagtaacggcagagtgaaaaagagaatttcttgcatctaacgttgcctttgtcttatccaatatccctttatcggtgttgttattttgataaagaaaggttatgtctaagtcgcaagttggaacaccagaaagaactttcagtagttttgcaattggtttcgatgaagcatcaatcgaagaatcatttgtcaaaagctgagtggtcttgatcagtaattcctgtgatgccgaactgactagatcaaatgcagcttggtaagctattgggtaattttcagttgaaagaagcttcacaaacacttggtgggcaagattgtgatcattcagctgaacaatgatttttgtaattatgaaataatcagggttaggaagatttctcaatattagcacaattgaattcaacactttgaccttgaatgcaatgttttttacaactgtggtggcgcaagtcaaaacataattaataagttgactggcttcactatcatcagtatcttcttgagtaagctctgaaatttgggagtgtatgatcttctccacaatgtccagtctatagctttctaatgatatacccagagccaactttaattccttttcctgaacacacttctgtagcatcatttcaaagatagattccagttgtgagtcaataacaacttcaggatcaagaaatttgctctgagatatctcgatgtagagatcaatgcacttggagacaatggtttccacaaattcagacttttcatcaatgttaaaacttgacccagcacttagtgagtatttcaccgatgaatcataatctcctaggttgtagtaaactttggaggccagtagcgccgctaactgacgatctttgaaagattcatcctcatacagctcttcaatttgagatatttcattggcaatttcagcccagaactggtctactacctcattgagtgacgttaaagcatatcttttaacttcaggatcatcctccctcaaaagagctaaacagggagcggccgttgttaacattgtaaggagatgatatggatgagagatgttgaagtcgagctgagtgttgtcgccactggaaaggttacttcgcactttatcaaagccttacgtaatatattacataataagtctgaattcatattcgactcaaaggtgtacagaggttcaattattcttatctagtatagcagacgggtgacgattttgtaaggggtgtgctccagttgttcgtacaaagacttgatgtctgaagcatccacatcagaaatatcggccatcaagtaggcaatgtctcctctggagtcagagaactgcttttcaatgttatggttacccaaaatgttgttcacagttttcaacacaccaggcacgttctgatgaatgtaaagcactctaacagagttttcttggtcaagatctagagcacgtaaagcaacttctgggaagttgacagcacctgtagaagttccctcattaatgtactttgtgagagcagttcctacttcaattccaattgcagattgggcctcttcagtagaaccaccaatatgtggggtcagaataatgtttctcaaagaagttagctcagtagcccaagagttcaactcgttggtgaagtttggaccattcttacctggttcttgtggataaacatccaaagcagcacccgccagcttacctagtttcatcgcttcaaccaaggcaggaatgtccaccacggttcctcttgaagcattgatcaggtaagctccatccttcatagcagccagttgaggagagctgataaggttcttagtctccggattttcgggaacatgcaaagtgacaaaatcagcttgggcaaggaggtcattcaatgtacggacctgtttagcagaacccagagccatgatcatcaagacatcgtagtagataacgttcataccaaaggcttcagccagaacggacaactgggaaccaatgtgcccgtaacccacaattccaagcgttttacctctgatctcccaacatttgttggaaactttattccaggttccggtgtgcatctccaaagatctatctcctagttgcctggcaagagtaataatctcggcaataaccaattcagcaacggatctggagtttgaaaatggggaattgaacacagcaacacccgattttgccgcatattccaagtcgacttgattggtaccaatacagaaacacccgatgattatcaagtttttagcgtgtttcaaaaccttttcggttaacttagtttttgacctgataccaatggcatgaacatctttgattttttcaatcagctcatcctctggtaacgaagacttgtggaactccacttgatatccctgttcagcaaagatctctctggcggtttcgttaacattttctagcagcaaaattttaatatctccagtggagaatggtttcaatggtttagcgtgtttggcagcagagaaactacgctgtctgacctgggacaggtaggagtcattaggggaagcagaaacaactccaggggaagtggacaaaccgacagcattgaagccactgcttaactgcttaatatcttggggagaagccattgtttaagtttgtgtgcaggtatctagagatgacagacctctgtgaagtctatatagttatgctgttatctgtgaaagagtcactctgaaaaaaaaaaagacttactacatggtgaaacgtcacgtgactatcagtactctcccttgaataatttaggccaaaggccgatggatgttgagactccatgtgccaaataaaattcgcgcgtcagatgagcacggataaatcgtctgattccaaatccagaattcagggtaactctctgaaataaacacagtcgggtaacaccacgcaaactttctgaaaacaatttcgcgcgttccataaaattttcagtgcgtcgtggagtctaagaaaaaaaatcctcaagctttcttctcctcatacaaacttctaaacaagttatcaattatcatttacaatgggtgcctacaagtacttacaagagttgcaaagaaagaagcagtctgacgttatgcgtttcctgtaccgtattagatgttgggagtacagacaaaagaccgtcatccaccgtgctactaagccatccagacctgacaaggctagaagtttaggattcaaatccaagaagggttacgtcatctacagagttagagtcagaagaggtggaagaaagagacctgtgccaaagggtgctacttacggtaagccaaccaaccagggtgtaaaccaacttaagtaccagaaatctctgcgttctactgctgaggagcgtgttggtagaagaatttccaacatgagagttttgaactcttactgggttaaccaggactccacttacaagttctttgaagttatcttggtggacccatctcactccaacatcagaaccgatgccaagatcaactggatcgtcaaccctgtccacaagcacagagaggccagaggtcttacttccatcggaaagaagtccagaggtatcaacaagggacacttgttcaacaagaccagagctggtcgtttccacacctggaagaagcacaacactttgtctgtgtggagatacagaaaatagaatcattcgtgaaaccattttttgtacatttttgcagtttgcttcaacgaaatgtagtgtatactggttttaaagtgtaagtagaaaatgtattaccggtaactgtaagattggtgtagctacggagggaaagaaagactgttttgggtggtgtattgacctttctctgctaccactttatgagctgcaatgaggtgctgatacgattagtcctagctttaccaagatgatgcgaagtgacgaaacttgcagaaaagctagcttagaaagtactatggtttggaaggactcctaaaattattctaaacaaaaatatatctaaccaaataaccagtaccaaggcttcaagaatacgctgtcgaacttcgttgcgttttctgcctcaatctcagcaaagtcccgttcagcttcggcgataacaatatctaaaccagtgtaaatgtccacttcttcgattggaataaggacttgtgtaaacggaattctccccagtttgtgaaggtagtacttatggcccagccatagaaggaaaaaaggtgggagggtgatgtacgcagcaataaagttggaggtatcccaattgcctttgataaagactgcataaccgttagtcaagatgataatggacaaaaatattatggaatagtagctcatgaatggctggaagtatgtcttgtaaggcctttcttcaaattttccatgcaaaatcattgctcttctaaatctcaaatatgcccagcaacagctgatccacgagatgaatccagaaacggtagtcaagtttgtaaaccaagtgaatactttagctgatcctgaagaaacgttcaagtaggaaaggcatccaaataagaacaccactagaacacagtagtatggaacaccaaatcggttgattttcttaagcactgcaggagcctgcccacttctggctaatcccagcaaaattctagttgcactgaaataaaaagcatttcctgaagaccatgcggaggttaaaattgcggcattgataatatggggaagaactttgattccagcactctgaatagcaataacaaaaggagatgctgaagcatcggagctctctgttaacaaaagagggttgttgtatgcaacagtacagccgataaccaaggaacccaaaacgtaaaaagccagaattctgtaaacgaaggatgaagcgaccttaggaatattgtaacggggtctcttggcttcagaagcggcagtaatgatcaattctggtccagtaatgaaagtaaacccagacttaataactgcagtccaaaaacctaaaaagcgaccggtgcctcctgtggtgaggtgctcagcaaaagcaccagggttattccagtatctaaatccaagtctctcgtgattgggagcacctccaagcataataacggcacccaaaataataagaccgataatagtaacgatcttgaccaatgcaaaccaaaactcgatttctccgtagtacttattggggaaacaattaagcacagtgatgacacccagaaagatggtcatgaatacggcgatattgatagactcattccaatatcttatcaccaggccagcagctgtaacttcagtcgcaaccaagatggccattgtgtaaaagatgttgtaaccacaggcgaatgcaaaagactcgtcacagtaacgttgaatgaatccaataacggaaacacctttgataggcagatacactgccatctcactgagcacgttcataatcgtccacagaacagtagacatcaaaatatatgaaatcagcaaaggtgcaggaccactagtggcaagagaagcacctgttccgataaagataccggtaccgatacaaccacccagaccgatcaggacgatgtgtcttgacttcaagcctcgttggatatcatgctcctttatgcttccggagtcaccagattccggatctaagtaaaattccttctcagatgcccttctgctagcatcagacatctctatctcttccactgcataggaagaggtggttacttttccatcttttctgcctttgtccattgtgatttaccagagataagtatggaacaaaaaaggaagaatcttgatgtttttatatcttctgcggtacactaaacatggggggagcgtatcgacgatgtcatgcatttgtgtatgtaatactgaaagtaatatggctttgatcagtcagatcattaaaagccatttgacttatccggccagggaacgccgcacaggattttctttttttccagtttttcaacggtgagcattctaggtttcaagactttcttcaaaggcagttggcaacggcatgtcaagaagacttcgattttttttttcgacactccaccagtaaaggcatgccttcgttgatggactggattttgaacggtctgtattgagtctcagcttattgagcttctttggttagttccccaaatcctgctcggtcagtgttgcctctcctgcagacatatgtgacatagcagcgagtcgcactatgaatttcagagagctttaacagagaggtatacctaagcgagtttagatcattttatatgtctgcaagagtttgctttctgggatgaatagaaagccggcccatcgggcaatttcaggcaaaaaaagataagatacaaccgagggatactttaatgaaatcgcatggaaaagccgaagttcacacgatgtgttctgagtgctcaacgagagcgaactactcagtacatcgacgtcactgaaaatagcaggtgattgccgttacctgtttcaggcttacgccgcactgtggatacatttttttactcatctcatcttttaggcgctaaaaaatgtcttatctatattacaatctagcttctccaacaacaccgagataggaagcaatgaaagatgcgccaatattgagtgtaattctccgagcggcttctcacaatcactaaacacccgtatgataagggtctaatgcagaatgtgggtcgttgattgtggtaacgtgaaattattgctgcgatgtcaggggtgtctgctggattggcgtggtattaaagatcatacacgcaatagagaacgttcgaagaaagagctgttcagcactacaaactaacaaaagtttacgacaagtgtatgggctttttgttccttatataagcacattgtagtcttctaaccataaagaggctcttcaggtacaaaataagcatcagttcttggcattaacccctagtttttaatataatgttgtgatttattttatgcaaccgaagaggtgttcagctgaatattgtaatggcaaaagaatatatttttgttttcgttcatatttgcctaccagtgagacaattttgaatctcacagataattccagtggtttgtgttgtatatttttgcaagaatacaattcccaattataactatatataaatgttcctcgtccacacaacattttttttttcaggccaccgacccagttattttttgttaatggacattcgctatgcttctttccccccattcaaattgcaacctcccatttaagttaccttaaccacgtaatactccaaaatacaatggccgaacataaaagaacagctatcctttctgtttacgacaagactgggcttctagatttggtcaaaggtcttacgcagaatggcgtcagattacttgcctctggtggcacagcaaaactgattagggaaagtggtttcaatgttgaagatgtttccagcatcacccacgctccagagatgcttggtggaagggtaaagactttacatcctgctgttcacgctggtattttggctagaaacttggaaagtgatgagaaagatctggccgaacagaacattgaaaaagtggacttcgtcgtctgcaacctgtacccattcaagtctactatcagtaagattggtgttaccatcgatgaagccgttgaagaaatcgacattggtggtgtaaccttattgagagctgctgcaaaaaaccactctagagtcactatcttgtcagatcctaatgattactctaagttcttggaggagttgaaagaaaagggtgaggtgtcttccgaatctagaaacagatttgccctgaaggcatttgagcacactgctgattatgatgccactatttctgattactttagaaagcaatatagtgagaacatctcccagttgcccctaagatatggagcaaaccctcaccagaaacctgcccaggctttcgttacacaaggtgacttgccattcactgttttatccggctccccagggtacattaacctgctggatgctttgaactcatggccattagtcaaggagctgtctgcttctctgaacttgccagctgccgcctctttcaagcacgtttctcccgcaggtgctgccgtaggtctacccctctcagatgttgaaaaggaaatttacttcgttaaggatattgaaaacttgtctccattggccaatgcctacgccagagctagaggtgctgacagaatgtcatcttttggtgatttcattgctctatcaaatattgttgatcttccaactgctcaaatcatctccaaagaagtctctgatggtgttatcgctcctggctacaaaccagatgctcttgaactcttgaagaagaagaaggggggaaagtatgttgttctgcaaatagaccccaattacactcctggtaattcagagcagaggcaggtctacggtatcactttacagcaaaagagaaatgatgctataatcaactcctctactttcaaagagattgtttccaaaaacaaggatcttactgaaaaggctattattgacttgactgttgcaacgattgcactgaagtacactcaatccaactctgtttgttacaccaagaatggtatggttatcggcttgggtgctggtcagcagtcaagaattcattgcactagattagctggtgacaaggctgacaactggtggttccgtcaacaccccaaagttttgggtttcaaatgggcaaaaggtgttaagagacctgaaaaatcgaatgctattgatttgttcgttaccggtcagattccaaccactgaaccagagaagtctgaatatgagtccaagtttgctgagctaccagaacctttgactaaagaggagagagatgaatggttgtccaagttgaccaacgtttctctttcttctgatgccttctttccatttccagataacgtctatagagctgtcagatctggtgttaagtacattgctgccgcctctggttctgtcatggacagagcagtgtttgctgctgccgactctcacgatattgtctatgttgagaatcctatccgtcttttccaccattgattgaatgtcccaacaattacagtatttctttttacttacaatcgaattcaaataaaaactacaaaatatatagtagagctttctgtttaagccttggtagaccaggaagatgttgatggtgtataagtccatccccaggtgttgttgtttcctgtatcgttattgtcctggcgtcttggttgaatcaaaccttcagcaaactctggtaaatgttcagttagttcctcgacattcacttgaccagctgcagctgcaggacctgcaatgatagcaacaaagatggcaaataccaagaagtagagggtcaggtagtttctcaccattctctttctaagacgagcttgcttcaacgagtagattggtggtctgatttgacgactaggcttcaaccagaacaacatcattgagtgccacctgtcaatcagagggacacacagtagagggaactgacagaacaagagaatatgtcctaaaacgaagtcaccagcaaattcagacatctctataacttttgcagcaaactcacgggctggttgggtccaggccatccagcctagtccagaaccgtaccatttaccagtccagaatgaagtgttcgaatgatcattcttaaattctctagtcaacatggtcaaagtcattaacttgaaaatcagacgttgaatataaatcattgctgcgagacccatcagtgttttagtgaagttgaatccctctaacacccatagaccaatgaaagcaatgatgtgaatgacgacagcaataccgtgagctacaccagccatcacagcaccagtcttcttgcaacacagacccaacataggaccggcacaacaagctaaaccagcacagaatcctaacacggccagatcgaccacaattggagcaattgagacaatgacaatacgcaatacagagttcacaacagtagcattagcaacaccattctgagcgttcatgaatgtgtaagctgtaaagcaaccagcagtgtaaatagcggaaggaatgaaatcggcaacaagaatgttggaacgatgagctctggctgcatctccagcagccttttcagactcgtcgttaatggtcttcctcttgaaaccggtgattctagatctggaaagacgtacataaccgatccaggagttacggtgccatctggtgttaccacgagacaaccatcttatgaagtcacggtagtcaataaagtaatcttgccaagcaaattggtgggggttgaagatgaatggagagaacatcaaagccgacaatgatgcccagaaccacaataatgctggttgccagtgagcgacagtaccgaacagtaacagcagcatggacctagctcccatgtaaattgacgagtcagcaaaacgtgagtaaagcacagagaaggggatacgtgcggttgcaaagccacgaccagtggagatgtaacgagcaccaccaacggtcaaatcgttcacaagagatgacgaatagatctgagcaacaaaaacttcgaacattggagacaaagaaatgaaatgacgacagaatctctgagcagccttccacattcccctttcaatcaattcttggacagctagtggaatgaaagaaatgaagaaaacgatgaaaatggacaacgtataacgtctaatccagtcaatggtaggcatgaggttataacatccaacaggatacataatatccgtaatgggtatatttctgttgtactgacagataattgactcgtgggccaaagagttcaggttgactaaagtcaacataaacatctgaagcgacaactgaataaataaattgttaatatggaaaccaggatgggcgtagtagaatgaaaggaaacggtccagtggcaattgtgtacctaggtagtaatactctcgggaaagcatttgctcacccataccggcaccaatcttggttgtgaaattcaaaatcgagccaaaaccaagatctctacctttaccacactggtagtactcacaatgcttgattctaccaccacgacacatggcggtcataccagcataaatatcctcattcaaatgtagtcccttctgtgccttagaaacaccaccacgagtagtcatgtatatgttattcaaaaaatcgggatgtccataatgcagcttaccaccaatctgggccagagtacgagcaaacagggtaccaaaggtttgttccttacctgcagcaacgtcacccagaactccggagttaacagagaagatgtattctctggcacccacaatggctacagggtgtttaacaccgtcaaattcagatttcaaaccaggagtataagggttaacatggtcgatgttcagttcctcaaactcagccaaaacagatctaatcttcaaacattcttccaaatagttatcctggttcgcatcaatcaactgaatgtactcaccacgagtaaagatgatagaatgattttggttgtcagatttaccatcacccaaaattgggttaccagagagctgaactctaaatttaggtcttcttctaccattctccataatttcacaatgtccatcaatcaaagccgagtataacctaggctcctcgccctcgttaagaggaggttcttcgtccaggtaagcaatttgaaggtcagggtaagccctcagcaagaactcagcgttttctaattcctcaggtttgaacttagacaatctttgcatagccacaacaaatttgaattttcgtcgggccattctttcaagttccttttcaaggttttcggcattagatccaaacatctgtacaatttctggattctcaacacgatacaagagcttgatagcacgtgcatagttcatgaaaccagaaacagtacggtacaaagtttgcgatctcaaagaagcccaaattcttgttcttaaagtgtactctggcgcagcagacttgaaaccaatacaataaaatggcaagtcatcaatttgagatttcaggttgtttccattcttttcttggttgtcattgtcaaaaccagaagtctcttcagcaaggattttggtatctttgacaaagcagtcccattctattgggtgtagctgtttcaaatattccagtaaggtaacacgagaaaactgatcatcttcacgaataatttcacgcaaagacaaaagaatcttctcggagtagtgaggtgtgaaaacagtaaacgtgggcatgttatcaacaggaagaggttctggaattggagtggccaaagattgagcaaagaatgatattctacgttcagcttcagaatctcttgggaaaaattcagtgtcaaagttattgtcatcttgagaaacaaagaaagttggagctcttaatgtcctctttccttcaatttcagatggcacctgatggtacaatagcttttggacatgatcgatggcaaggaggtgctctctgtacatggaaatgacaatagcgttccaaacttgagaaatcaaaacctttggtttatacttgatttccatatcagtagtagccaaaacctttgagtatattctctttggcaatctggtaaaaatgttcctccaaggagtcaaaatggagatacccaagtaaaaggatcgtcccacagaaaaaacacagttacacaaaatgtaccacatgtaagtatccaaaaagaacaagaataaatctgtaacgtacatcaatcccaaaacgattctagcttgctcacgacataacgtgtctccaaaccacctttcaccaacacaacggttcattgtcatgatggataaatttctgattgggtctcttagagacaagatcaggaagaagtaggattcaagggtcttggcggtgaaaacaacaacccaaagaaggtaagacatccacatgtctagacctttcagttgagcaaatgaggcagtaaaagtctgcgaagccacatatcttctcgatctcttattcatgtaagaagtaaaaagaccacctagtggcatcaccgagaagaacacaattgtagcaacggcaacaaagaatacaacaatggaaacaatgtaggcagcctgagaataggtctccaaaccagcccaagcaaacacaaatacaaccggagctaagttacaggctaaaatcaaagtcaggaaaataagtcttctagacagatgctgagctccagcccattttcttggtacaaatagccattcacagatagttgcggcaatttgaatagcacaagcaactgtacctcccaaggctgctgcagcccaacgagaagaagctaagggttgattgttctgggtttgaatataatgtttggtgtataaagtgggtgaattgtaggcagcatacatccaaaaaagagaaacatggatgatccagatacgattgaaattggtaataaaatgcaaccaggaacgaatttccttgtaagtcttgaaaaaaacgttttcccaaaggacttctcccaatctgatatatctttcttcagaaggaacatcgactaaccgagaaccatcttcaaaaacaatcttagcgataccttctgggtaccagaaaagctgattaacatcatcgtagccgacaactttattgtgatctttttcacgtttcacataacgaccgttgtcaacttcgtatacttgcgatctgataaatctgtacaaaggtgtgataattcggttgaggtaatcgccttctggaacaggttcgacccgctgctgacatgcgtcagactcaagataatcggaagcacacttgtagatgaaacacaaacattcaggagtaaatctgacttggttagcttcaccccatagaagtaagtaaagtgcgatgtgtctaaccctgtcgagaggaacatatgcgttcattctagcattccatctataatcagcagcttccaaagagctgtcaccttccagttcggttaaggtgcgctcagtgtcatcggcgtgctcttcgacaacttttctggccttcttcgacttctttttggcttttctagcctttctggaaagctttccgaggttcatgtttctgaatccaacttcatcgtccaagtccaattgggcagcgaagtaccattttttgtagtttgcatgatcaccgccaatgtagtctgcatgtaaagacaaaagtgcctgagcaggagacattctggaagatctagagtccaataaaaccataaaatagtcgaacatgtttctcatagaatctctttgaaaaccgaacttattcgttaaatcaatgaagacatcctcaatctgttcaatggagacaggggcttgattgtcagcggtccaagcaggataggggtcggtaggcaaggctaccattccagactgatcgtatggacctgcaccatacacgggagtggacgtgttggaggatctcggatcaccataagaaatttgagaaggagtgtattgggccccatatccatcatatggagttccagcgccatttccaggtccatagctaaaatctgagaaagcctctgggtcctgagcagttctggggggttgttcgtagtagccttgatgaccaaccaagttgggatcagatgtgtactcttggtggtagccatcgaactgctggtcgtagctttgataatattcatgtggggggaggccgccttggttcaatccatgaggttgttgaccttggccttggtcatagtatccctgagattgaagggcttcttcggatggatgatagccctcagaagggtaaccttgattgtaatatttgtcgtcgttgtaggacatggcagctagtgagtgatatcacggacagtcaagtatcaaacaaacggagcaaatcggcaaatccttaggcgtttataaacaaaaagatcagtcaaaagtaaaatcaaaatgaaaactcaaaaagatctgcttgcaatggaattattcgaactgctacttaaagggcaaacttgtcgcttcaccaactaatgaaagaaagtgggagggagaaatatagacctcttctttgatacaataagatcagaaaacgaaagaaaaccttttgtctggtctggccggatgtttgtaaaaaagggaaggaaagttcatcaagcaacattagcaagacgcgaataggagcgcgaggcgtgttagaaaaaaaaggtcgtgtccgcaaaatatgttattttaaagtctgtgggaagaggcaggcccatttacgcagggaatgagtgaaaaaggctaatacacgatcgtgggaagtaattttagtgtgataaattgacactggatacataaacaacaggtgacgtgtcttttgcaattcaggctggaagaatgttcagaaaatacgtgaaattctgcccagcagtttgttggttgcaatgtaatctgttgtgttgcaggggacacacagccactgtctagatcgtgtcgcgcaggtcgtcttgcatgccgtctcgttatcaaggggaacactttttactgtgcgtgtgctctgcctagtgtggtattattattcttactaagtactgtttttgcatgctgcaactgaactatactcccactaaagtcccgcaaatcacctacgaaaagtgaacatttaccgagaaaaagtgtggatctggtctcatgtagtttcaggaggaatatgtgctctcaccaaaactttattctgaaaatgactggcttgttgcctctttcatcatacttcctgattcgtcagatcgaatagggatatccaaattgataaaggcagttttctcgaaagtgttccaaaaatagataggcaccacatattcactggaaccacattctgttccggttgttccatacgcatacaactagcgttggcgtacacgactttttcaactcctgctgtgttggcatggcaatgcagttcttaattatgtttttggcgtttttcttaataatattgctcggctattctgatggaggtacatgagattaaggaatttgctttaagcatcgccgagaatggataggataaacttcttggtgggttcgtgctcgattgtcaactcctcctctagctgatctctcaacggaaagaaactggcgaaatgatccctcaaaagtgacttcaacaacgagcataactgaacgtatccccatttcagttcgttaacctctcctaattcttcgtcttctgctggggcactgatgacatcggtgatccctagactctttataaggctattcatagatgtgatgaagtttttgaatatagaaaacaggaactctttttcttccccgtggctttcaaatagtcgatttaccagctctattgtgtaaaattgagagatcattggcaacgaactctcataactgaagacactgtcgactatactggaggcagtgataaacttttcgtgacacagtttttctatcaataggtaccctattcttggctcatgattccaaagaattaagacagaatcgattatccagctattcagcaatgatttgtcatctatcaaagtatcgaatactgcacggattttgtccttagatacgccaagggctcggttgaagatcgacaatgaacgtccacctgtaacacatgtagcttgaatcagcagcattattatgtatttatccgagttaatagaaaacgctgaatgctgttgcaactttgttttcaagtcagcgattatctgtgaaaactgttcaacagatacatcagactgatgcagattgtcgtaaacgtcaatgcaatcattcatgaaagggtgctcttcattaataaacaaaaatgaatcagttagttcaatgtcctcgtctttgaccttaatcgagccgttctcatatgtctcaacatctttagtaaatagggatgatagctccccaaatatgtcctttgtatcctgtgccattctgtccttagagtagatggaaaggtccagatagcgatgaaactcctcggggagcgtctttctaatggtagcaacagacgccatccgcacctctttgcctattaaatttctgatcaaaattgcattagggtgaaacttggaagctctaagtctttcctcgtcatttgcccaatcttcccatctccactcaaactcaaaattactgaactgaattgtaatccagtctaggtaaagcagtctgagagagtaatctaagaatttgttttgcttataaaggtactcaattaatgcaccaactgactttgtaatggccgaagtctgatttcctggagtacgagaaatttgttttagatctttattgcaacactccactaaaagcgttccatagtagacagcaggcgggaaatctagcttgggaaggtgcagcatcagatccaacacactttctgtgatgacatcttcaatcttccaagtactgacgtatccgtctttgatgttttgctggacttcatcaatcaatagggcaacattgctatctccctcactgttcagactggtggcagaatcaggatcgtttagaagatcgcacagtatgcttagcttttggggcgaagacagacttttgcaaaacaatttctctttataaaatttggaaaacagtaataattgggcagagacaacgaaacgattgtactccatggacacaaccaaatcctgaacttggtcccgcaataaaagggcaaggtaactttctaccggcggtttagtttgaaacttgttattgtttttcgttgaagactctggatgagcttcgaaaagtgtacgaggatgcttccagagctgttccacggagcccaccattgggtattcagaatactcagctatgttgaactgaggaatggaatgtttagcaattggggcctcggatttttcaatttctggcaaaacctttgagtaggtatcaataaaaggtagattctcccagttaccgctctgtaaggtctttacagctggaagaatcaaattcaccaatagctttggctcataaggcaaatcagaacttgagccgttcaaactctggaaaacgagtaataagtcattaggagcaattgtttcatctgaatacgcactagcttcctctatcagtttgttagcaatctctttgtactcttctgaaccctgatttgatgcaacaatgaatggaatggatgaggtgacaataaagtacagcaattgacccaaattagaatctttcacagtgagggaaagtttcaaaaactgagaaaaaatattgtaaactgaatccgtgcttatcattggtaacaatgacgccaaaaacctcaaataggctttgatcttagtgaacttaccaacattggaggagtccttgttagtcccgttcaaaagatcctggatctgctgatgtatgtattcaattaagaagagacccactttctcgtttttggagttggcaagcaggacaacgcccgaaaaatggaacaatttatgaggttgttcaagtacgaatgcctttgcaaaacgcaaaatggcgtctctaaatgtgtctgagccaatgtctgaagcaaatggtactgcagaatagatactatcgttggcataagcgtcagggttctcaccaatcttggacaattggatacacaaggattttacgactctcgattcgtcgttgacaacgcgagcccgtttgaatgactcttggagaggagcatgctcatcttgcccactgtcgtcttgctctcgctctcgtttaataccggacatgtgtttcttgggaacagactacttgcaggaggttgaatatttcaagagaagttgggaaacattttgaatagtgagtgggacacgaacgcaggcgttatagaggaatcaagtttgataaattccagccttagaatatcttaacagaccttttaaattatctatgacttccctcgttaccagtttgtgggagtcggtattcactccaggaaccactccagcattggtgctttcgacgcatctctcgtttctatgcttaagtgtgacgctgatctcgttgatctttataaacggttcaatccattttgtgaacttgttggtaattgcactgctattatggggaactgtcacctggttcattggtgaacttgaaagagaaaagagtaagttgaaaagcaatgaacagttacaagaggagtccaaggtagaccaatctacaaccgaaaagacaaaaacctcagctgagtcgaaggattctgagccaaaaaaggtaaaatgatacgcttctttacaattacacgtgttgggtacaatcctgatcctgaaaagaatgaattaactgattagatgacagctgggtagaccctccgtgtttctgtagtcaactgtttatgcttatgtaagtatctgggtgatcgcgcttattttatgttatccatgcattaactaagtactgcgtaaattgtcgtttaactgttttgatgtcatttgagcccaaagaacccgttcaacttcaacctcctagtgatcaaccaatcacattagaggagctatatcaatgtgatggtaagcatttggtctttagccctagtatccgttcccaactaatcaataaggtgttaaatctccatacatctacgtagcaatcaaaggcaccgtttttgatgttacacacaactccaaggcctacggagtaggtcagggctatcatgcattggtcggaagagatgctagtaaagcacttggaaagtcaagtctgaaacctgaagatttgaatccggcagaatgttgggattatagcgatctaaacgagaagcaattacaaactttagagaactggtttacgtttttctcgaaacgttacaacattgttgggaaagtagttgggcttccaggtcgatagtgttgccgttgcaaagattcccaaaagaaacttactcagttgtggtagatccgttagcctcttcgtgattatataagcagggttactttctccccttttggtgtgcgaaactccactgattcctgacctctgtaaagattaatgaatactctcctgtaccgttacaacaattaaatcaattgtcataacaatcaacgtaagcattcaagggccacttcttttagcttcaggtaaagttgtctcgaccgtgggcgtttataatttctattatataacattttcgcaaacattcgaagcgcagatatgtacatatttcatacatatcccgacaggcgaaatacataaataggacatccttacaccatacgttttgttaggaagtatccagagcaaaagaatcccatttctttttgaagcactctctctgggtgatttgaaaagggccaaaacaaatcgttaattgtcgtgggtatctttacagtggtagtctggtttaattttcaattcgttcattaagaatctcaacatggatgctgctatgtcaacaaccaatagaaggcctctttctcaagcagaaggggcgtccactattaaccacagcattccactacctgcccagagctctcggactagaaccttagaacaaagagctttcatagacgtcagggagactccatcgcagggctatccacctcattcgaattcgttccacactatgtctatggtagcttctccttactatgacggcagcctaagacaaccttatgtggagccttctacccggaccggctctatgaccagcactgcttccagattgttccgaagagggcacaaaacttcaaaatttgacgtcgaaacggagaaggaaggtgaagtatatgttgattcgaacgacagtgttacgtttgacgacctccagtatctcagggatcgaggacggtatggaacagatggttctgcccaacttgacacgacccctttgattccaacgttgtcgctgcgacccaaaggcccaggaggtgaacagaacaatacacaatataggaaacaactgactgctcacagaaaaatggcaatgtatcaggcttccaaagatcctcttttgcagaacagggcaatgagtttgcaaccgcaaggtatgaaccctcaaaatcaagtttattcacagacacctgttggttatcctgctcctggttcttttaacggttctaacttaacagactctaggggtatatcgtttcaaggaccagaacctcgatcaatgtcttttcaaactggtccctatcaacaagatccccgctacgtgtcgcaccagtcaagctcgtatcagcaagaccctaggtctatgtcgtttcaaggaggttcctaccagcaagatcccagatcaatgtcgtttcaaggaagtccctaccaacaagatccccggtctatgtctttccaaggaggttcttaccaacaggatcctcgttcgatgtcgttcaagggacctgctggtgatccaagaatggcttctttcagcggggctcatccttcgaggccaatatatgggcgcccaccacaatcacagcagcttcctcctagagcatattcgttagtgaacggaggaccctcaaatatgcgaccaaggcctccttttaatagctcagatagactttcaaattcaagttcggacagaatatcaaaaacccaaggacagccgtcacagaattctgtggagccctctaccctgtctaccgaaactgcacctccgccaaggcttcgaaaactcaatgcttatgactttgatgaagaagatgatgacaatgatgacaatgatgacaacgaagacaacaatcaagaggaaaatgaggatggagagagagaaaacgacatagaggagagggcaggagaagcagaagatgatctaaacgagaaacataatgaagaacaagacagtttaccatacgaagaaaaagatgctgagaccaagaacgaacaacctgataatgtatttgattacaggccctcttcttctgtgatagattcatcttcctccaataagaggtcttctcttgccggtgcaccaataaatcatacgcacctacgaacagtacccctcaacacttctaccgagcaaaatctcccgatatcgaatgtgaatcgtatttcaagagaaaatccgggaagatcccaaaataatggatttgttctttctggaaactcgttgattagttctttagacacatcaccagacagaagtaaacaagtcaacacgacgaatacacgcaatagccaacaactatatcatatggcacagcacaaccaaacaaacgatacaaatatgacatattttaccgcttccgaattcacttcccccgtgtatcgcaaatctgttgtgaaagaggcggacagtactatcgatgttacatctgcgggaactaatactgaaggtaacgactcaaccgtgctgccagaaacacctacaaaactgaatgctaacaaagcagatttgttttcattaagagcagacacaacggagaattcggttcctagaagacgagtaccacccccctcttcagtatcaccgacccagaaaaatgaaagaagaaaatccatttcttcatctaattcagcctcaggtcaccccaaaggtaaggctttattttccaaattaggattcaagaataaaaaagaatcaaattctccaaaattcttttctagattcaggtttaacagaaggtcttcaaaagatagtgataccaggtttaataatgatgatatatttgttgacgatccatcgtatgttggatcgggtcaaggaaaacctgctgtgcctaacaacaatgttggcgatttccagcaaccaaggcaatttgaaagtgatgataggtcgttgaatccttcccatgtctctcaaagcaccaattctccttctttcattcaagccaaagaagacgtactgaaaacatacaatgcaccagtcgttgaaaatgaagtacgctttgggaatgaacataaattcaacgtttttgaaccactggctgatacaaagacaagtgaaagtgattttaacgaacagatatcagatcataaaaatgagctatctccggtcaccacaaattcttctcctactgttaatgccaaggatccgctcaaagaaactcttagccaccttagtgttaatgaactttctaagtatgagttcacctctagtcaagttggaatgattcatgcaaacagtgaccttctagatgagttgcaaatcgtatctaaggagctggctgaatccattaatcgagagtatggcttgccattggatgcaactgaagctagggttattgagcaatccaagtatattgccgatctatccaagaagctcaacgtggagagaaagaaaagattcattgcagaagagcaagttttggcttgggaaaagggatcaaatccttcagctcttggtttgtcttacaagaatcaagagcacaccaatacaattgttgagaaagatcagttgattgagaagtacaaaacaaaattagatgagtatgaagcggatctcgctagatcccgtgaaaagattaaatcattgaaagagaagaatgatgaatacgctacagtcatcattcctgaattggaaaacaaaattcaagtcaatgagcgacaaaattatgatgatgctttgcaaagagatctagagaggttgaaactcgagaatgactacttgaaggaaacaatggataagctcaccaccagaaaggttttcacatagtagtcttcatttttatatagcatgacctaagtcccttagcctccttaaactctctgtaacagactttgtttctttccagtcatcgtacttggtgttgggggatatggacatgatatcattcatggaggttccactaataaccatatcttccgtttctcttgtcaaattgtcagatagatctgccacaacatcgtcaccatcatcgtcttgaacgttgtagtgagttatcgagtccatcattcgcaaaatggtcctgtaaccaagttctgcagtggagcttgaattcgatattatggaacaccacgtatgatgatcgttgataagatcaacatctgattcattctcgtcatagatggaatcagtatagtcggagatatatggcactggtgtcagcacttttgaaggagttaagttcagttcatcttccaacttaccgggctgaaagtgagagtcacggctgcgaagtaattgttcatcaaaagaacccagcaaaattcttcgaaagcattgattgcatctcagtaagcagacggttctattttgaaacctttgcttagatagttcccaactaaaaagagacactattatagattttatatcatcgtaacccgatgtgttggtcaatttgttgttaaaccgctgagttttattccaactcactaatatcttcaagtctttattatttagcccatgaatgaaacttttattactccaaaactttttgttatctctcagtacgtttacatttttgacaagtctgcctaggaagtatccaatatcgttcatagaaatgtggtagtcagataaactggagtgcttcacggtccacggacaatactttttatgagatccattttcaagaacagtcttgcacatcatactcaggtatcgatccaccaaagactgtcttaaaatcatgaacttttcgtaatcagtatcttcctcttcatcaaactgaaaaatgagattcccatatccaattgaagttccaacatcttcactgaattcattgtccaccgaagagtgaaactcattcaattgaatgcttaatctatgatggcatgaaacgcattccagcatatttttatccccagttcggcatctccagccatataaaccgcatttgaggggagtcaatgtagaatcctcaactgtccaattcaatattccatatgtttctattcgtgataaaagcttttctcgtgaatgtggattgtaagtgctgtttattgcaactctttttctcttggaatttgttaaatgctggcttggagaggtcggtgagatattgagaggtcgctttgaaccttcgttcagcttgacctccgactctgattcagataaggactgtgttcctatcgacgacagttgacagagtatattgctgagggatgacctagatttgtcatccatcgttagtttgctagtggtgaaaagatcagtctcattaaaactactatgcactactgatgggataatgttagatcgcgacatgatacatccatgcatattggattcattaatacatgaggtatacgcggtatatgtatacatatatagaagtctgctgtatatgtgttgactacaagttctccccaaaatccagaatctcaatgaaactttccttagtgtcagtttccatatcttttcgttgaacagctgcaacacatctccttctgttgaagcgaacttgccagacccctccagttacatcagttagaagctctctaacaaaattaccggattcagtattccagactttcaacattctttctgctccactaagtatcattctatcgttgtgctgaaagcaagttattgcaccaatatgaccctcaagttgacctcgagcctctccagtttcggggtcccaaatacgcaaagtagtatctgctgctgccgatactagggcgttatctgatagaccaagcaatcccactaaagcggtgtgttcattcatggtcttaagacattctcctgtctccaggtcccaaatttttatcgaaaagtcaactgagccggaaatacacctgttccttttgctatccaataccacgctgtatacacggccagtgtgtcccttcaaaatcttagtacattctcctgttcgtaggtcccaaacacgggcagtgttgtcgtaagaaccactgataactatattcccctgtccagtcacagatcggacagatgctatatgacctcgtaaaacagccacaaggaaaggattggaatccgaatcatctgtgtcaaaagtttcgtagtcatcagcatcgattgagaaatcctcagtttcttctaacgagaaactggattgaggtaacttccacacacgtaaagtatggtctctggaacctgtgacgattaaaggctctgtggggaacacaattggttctcctttatcgtttactccaacttttgtaggctccagaatttccaaacatcttacagtagaagtatggcctctgagaatatgcgtacaggttcccctttttatgtcccatatgcgaacggtcctatcagtagagccggtaactagagtgttaccgtaatacttcatagcccaaacaccaccttcatgccccttaagggtggatcgaagcttccccgtgggcgtatcataaatattgattgttttgtcctcagcggaagttataatcttgtcttcatcaaactgaagacaagttattatatacggaccatgcgcgctgacactaatacgtctgggttgaaattctggactgaaccatctttgattcaaagccaatgattttctgtaaatgttgcgatacaatgtcactatgattgattcccttgcggaaactagctctggaggagttaggtccaagttcagatttttcatttccttaatcagttcagcattcagctcatcctcgtctttaaagaacctgtctttgatgaggagcctcttccatgtaatactcgacctgttattgataagctgcgaccagtttcggcatacaaatgacgcgtttagcaagtctcgataggagaggaacgaaagtattcttgtagatatctctaatggaaggttgtttagcaaatcacgtttcaatgacttattcattatatggttcaatgaagataagttagcacgatccaacttggatagtaatctccaaatcagatccttctcgatggattggtcctgagataaaagtttcactaattcatatgtcagattcgtcaacttccttttggacgttggaagacgaaataagatctccttggtaagaaacgaggatgaaattaactcttcttcttcattattaaaggaagattgggaaggcgatgcgctcggagatggtaaaggcaagtccatctccaagtatgtggtttgtccaacaccattagcaccgcttaacgatgcagtagttgctgtagtagcaagaggatcggaaggaatggacgtgatttcagttgaatcggtatccgttgtgttagccgagtgaaatgaagtagcaataatattgtgggggtggttgtgggtattgtccccaacaacgctttcattagtggaggcgtaaacggattcagtcaaccttctcttgtttggtggagatttctgtaacacaagaggatttgtacagttatcttgcgtgttatcagagtctatgacttttgattctctttctaagctgagtgaactgagtggttctgttgaggcaccagagatatggccaaccggagtgcagaccaaatccatgttgtctccagtggggtgggacttatcatccttgttctcttccatgatacgttttcggtttgttttcacaccatctgatatgagaatacgtcgaagttggtgcatcatttccacagacagggactcgtcatcctggtcaccatccacggccgtctcggagagatggttggaaggcagtgccgaatccgtatgagagctcatgaaaaagctcggatccgcactttttaaagggtactttggaggttgcatcccgcttcctatatggtatttgttgaagttgaccaggaaacgaaagtaggtgagtttacgttacaaattaataagcttaagcgaaacatcgagattatgtaatctcggtatgaaaaagtgaataaaaacaatatgtctatagaatttacgattcagtggctaatgctgcttcaaaaatcaccacctccgaaatcaccacctccaaagtcgcctcctccataatcgttctgctgggcagcggcctcattgacatcctgatgataattattggccatcatgccacctaccatcatacctcccattgtaccaagagccatacccccaagcattggggccatacctcccatacggccttgtctttgctgctgctgcgcttgcattggctgtggaggatatggttgaccgtacataggctgcggatagtagggttggccgtacatcggttgttgagggtaaggttgtccatacattggctgttgggggtagaactgctcttgctgtggagcaaaattgcccttattgctcctattctgtccagagcttttcttaccgctgtcttttgggttggtactgctatagcttggtggaggtggtgaaccacttggtggagttgcttcctcttcgaagcgggttccgaccggcggctcccattgagattgtttagttgccaaatcgacgtaaaaccacgtgctgtacttttggtcaaacacagctttgtagccatcaggaactttggggcggttgttaggatcatttgccggatcaaccatgattagttgctgtagggaaggaaacttggtgagagagatcaaaagcagatttggaggctttgcgtgcccttccaattttattatgtcatccgattttgagtaaccagcgttatataagtaattggtccttcactaaagtgactctgattggtagacggactaaaagtggtaaagaccaacggtttggtaataaatatatataaggaaattgtgaaagaaatggtactaggatgatatagagttttgttgcacttcagagagtattacctgagtggattctttctcgctaaaatataaaccataaccacattatcagtgaatggcgctacaacaattaccaaatcgcctaaaaagttactatttcatatctaaacgttgtattatcatgtatatattaaatatcgtactgttttcgttacattatcctcattattttcattctatcattattcttcaaaccctttggtttccttgcagagatactcccatgcacgcatatcatcaaagtcatcaattaaaacgtctcccagttcattcctcaacacttcatggtaccggttcagccatcttctttcctctatattcagtaaatcttcgtcaattagtttcctgcaaaatggtacccgggtatagtagtcgaacttgaagaaagggtcatcgttgagattggtataattagaatcaactacggccatgtctgattcaattctgaatccatattcaccatctttgtagaaacctggctcattgctgatgaagttgcctggttgtaatggtgtttcgttaccaactattgttcctatacctactggtccctcgtgaacacatagataggatcctataccatggcttgttccatggtggtaatccagcccatacctccatagaggctgccttgcaattgcatctaacgtctttccatcagttcccttcgggaaatggctcaatgctagctgaatatgacctttcaacaccaaagtgtaccgttcttttagttccgcggaggggtttccaaaatgcaaagtcctggtaatatcagtagttccttccaagtaatgagccccagaatcacacaagaatacctctgacctgtcaatcaccttcgattctgcctccgtaggagcgtaatgaatgatagaagcgttgctacctgtgctagcaattgtagcaaagctttctccacgaaaattagccatttctgagcgatatttagacagcacctgcgtactttgatactcggtcagcttgtggtgcagaagatattcttcgagccaagcaaaaaatctaaccagtgctattccatctttccactgagccatcttatgattcttgagttccacagggttcttgatacacttcatattagtcaccatggattcaaatataacttcagatactgttggaggaatgttactggccaaagcaaaagagcaatttgagggcacaacgacagcaaatcccgattctaaaagttgaagatcatcccagaatgacccataaggttgcactctgcaacccagatccttcaggtgatcagaaactggtggagttaaagacgaaattttgggaatatagagacataacgaattctcaagcaccaccagataagatataaaaactggattaaaaggaatgtcccccgagccacgcaagtttaagatccaagcgatatcatctaatgctgtgacaaaaagtgcgctggcgttttttgttttcaactgctgtcttattctttggattttatcctcactagactcccctgtgtatctttggtccaatggaaaaatgttggacgtacttagtcttggacgatcagtccagatcctgtcaacgaggttgtcattggtgggttcaaactgtatgtttaagtcatggcacttatctaaaaaccattctccaagcttgcgagtaattaaacgtgggtccacactaattcggcggtaattgacatccaaggccaaggcttgttgtaaacaccaatcttgccacgtgatatacccatttgtgttaagtttaagcagtttccagttagaatctagctgcctttcggcctgtaagaagtagcgtccatctgtagacaagacggcctctccagtcaagctgacaacggcaacaccgctagaaccgtcgaaaccacttataaaacctcttcgcatatctttctctgatgtgtactcgctttggtgttggtcctcgctaggtacgatatatacaccaatattgagtcttttcatttcaaatctaagggcacggagcctttcggttgtgtcaacttttgcgtctattgtccaatatccagttgaaagtttttctgtcttgacgtcttgcaaggagtcatcagagtcattgtcataatactctagaagcttttcattttcttctgtggctctgctctttcgggaaaagcgaccgtgtaagaggtatgacagagcgcttagacatccagcaccagcatctggagagactgagtattggtataccatccagctgtatattaaaggcggttgatttgagattgaggaaagaagaggaagaagaattcaaaattgtgactaacaaggcgactgggatagcgcatacttcgggatcggcaaacagagcaaatacttcgtttacggaactgtaagcgcgtgcgcgatttccgttatctacgccaatgacgtaagaacgaattttattcgttttttttttttttcctcctgaaattatcgcttatgtaagatctatatatccatcatgttgaacactttggcaatcaagtagtcgttccatgaatctggatttagttcaccaaaggttgcgacttcgaaagcctttcttacaccagcaaagaaattaaaccaaagggcaaccagaagcactactcccaaaacaatgggaccagggacggcatcaaagtgattgcctgacctcttcttaatcaattccagtcgggtcatgtagatgtagtagccccacaatgctgagaagatcgacattgcaaaatacagataggccaacacagtggccactgtgggcatgtgcgacgatttaaccgttgaatagatcaaaaacgtcaaagtagtaagcatcgtcgtcacgtgcagccacctcaaaaatgttctctcgttagccagccagaccttggcttccactcggacagggcccaagtttttaagatactcggtaggcttattgacaccagcaggtagaattacttcctcgtcttcagattcataatctagtttactggagacattgcggttagcacttctgttgtggattcttgcagttgccagagagagcctgcgagcagacgatgaagatgattcattatcatcatcactttgttcctccaggtcaaatacatcatctctctcctcaatgatgttattcagttttggattgttgactccgcttgtcgggttgatcgatggagacaaaatcttttcatgaagttgcttcaaatttgactcagtggggacaatcggtgccgtattatcagtgtaatcagcacctttaggtggtctccttatgtcttgatccaaatctggcagccagaagggcaaaatgtctagattatcatcctccaagaagagcgaagaaataccttggatgaatttggagaagttaggaacttccttaaccagatgcgaattgaccaaatctctaacccacttgtaagtcttggaattaggattagagtatattctttcattcacccttatctccataatcgagtaagggaactttgcgtactcaccttcccttaggacgtcaaatgggttaacaaggtttggttgatccaaatcacgcctgtgccaagattttggatctctaatgggtctatctttgtcaaaagaatcctcacgaatataaagcatgtcactgtcaataacgacacggattttatcctcatcaccagggacttggaacactgttctagtgaataccgttctcaatacaggctctagacgctgttctctgatgaatttttgcaagcttataaacttttggcgttcatcctgtattgttaactgagggaggttacgtttggtaagtttggaggtaaacttattaacgttgaattccttagaggaagcatagtcagtggagtgatccagcgattcctcatcatcctcatcagattgaagtttaatgaaatcgtttatgtacttttctttcagtttcaatttgatatcatcatcgacaccagtctcattaaggaaagtccgcttttccacagtgacatctttgcccggtgtcagtttactggtccagcggattcggagggtcggtgtttccttcaaatttttcaatagcttgttattgtaaagttcaaaacctctgttgtcaaagtataatgtacttatcacaggatcactcaagtcgtcgtcatctcctgactcatcagtgaaaatcagagcaggaagatgtcgcagaatcgtggttttgatttccattaagttttctggatggacccagaatttcaagactttgaagttgtcgctgccggagtcacttgctgtgtgagagttagtacttatgaaactctggggagcattttgactaagggatctagacaacgactcagatgcgtagtcaattctaaaactgtccctcaaaaactggtacaagaatgacaatctgtacaagaaaggggaataatcttcggtgtggtaaggtagattcttaagacgaacgttcaaaagcgccttcacagagtatttcttgtgcaatctgtcgtgcttcttcacaatcttaaggaacccagtaaaattaagtcgtgcaaaatgatccagttcgttggccagagacacaacgtgctccaaatcttttctgaattccgaaaggtcaaactttgacttatcatccagatatctttcggtgatatgctccagctccccaatcttagaatcaagctcttcatatttttcagcttgaaacttgaacactttactcaaatttgcgtctagctcttcagcaaatttttcctcatctttttcattccagacctcatcatccttggtctcattgctgtcactgtagtgggaacctctaatgatgttctctttcaacagccgtttcagatgatcatatttaatgtagttgtccttccaaggaggataaatttcattcttcagcttaacgccaaacaacatcgtatgcttgatttgaggatgttaaccggtcactcttatatttatttgaagtgtccagaggaaataggttaatgtaccacgtgcagacttcattgatagattggctcgaatccggacaagttaggtaatcaataccaccccatttaccgtatttgaactgctaggttttgcaacccatcgatgaagcgatactagggatatagcacaacaggaggacgagagaatcggtcatagagtactatcgtagtttgtacatagatagagaagctgccgtaaggtgaagaatgaatggttttcagggaactttctcactattgtcttctggtagttgccctctgaaaggtagcagttaagcaccgagagaacagagccagactacttccttggtttcttcagtcagccattgaccgtaagtgaatgctttccaccccaatttctcgtttgcttcaaccttacaacaatcattctttcagccgtttacttacaatatctactaaatacgcgaatggtactaagtcttccttcttcagctccctagcgcgttagataatccaaacgacatctgcactctaatggcaagtagacccatcaaagttttacttataggagatcagggggtgggaaaaagcagcataagacgacagctatactacaaagtctttagtgagtcctacaaagctactataggcgcagactacttgacatccaaaatccatgtcaatgaatatgatgaagaggtgatattacagatatgggacactgccggccaggagagattcaatagcatcagccaaatttattatagaggcacggatatctgcataatagtctatgatatctgcaatagtgacagtttttacaatcttaatatctgggtgcaacaattcctgaataattgtcaagtaagcaggccaacaataatgatcgtgggaaacaaactggacaagtctgtcctcagacagatttctcttagacaagcccgggagtttagtgaagaaattcaagctgatcttgtggaagatgtttcacaagatgtcatagaagtttcagctcgagacttcacacaaattgaaaacctgtttcaaagggccgcattacttgctcttcagcgacaaaatagtgaaaatgtaccctcgttaacgtttgattcggtggatttttcaaccaatgaaagaaccaatgggtcccaatccttacacagtccgtgctcctgttagatttctctgacagaacatttattttgtaatacatagcgaagccaccagagatgacgtagaataccacgacattaccattaactactccttaattgacttggagttatgattaaagtaagatttttttctgtcttcatatagttgtttctagaagcttaagtaatgttatttcgagcgatgagatagcattcaagaaaaaacgatactttcagtttttttccaccattactaataatagtagaaacaatgaatagattaggatcaacagtgctgcgtgccaatcgtccagtctctaagcggttgtttagagagacagctagaaagttttattccactggaactgcttctagctattcaaacgcatggaaatacgttacagtctctggattggtatctgctattgccatcggatacaatatgcgacaaccttccgtcgctttagagaccgaagttgtggaagccgcagagatcccagagattagtccggttgttacagagactcctgtagttcccaaagggaagcaatcttctgaatctgactctactggtgagactgtgcccacacaacagagttcggaaactgaggcagaccatgatcaagccggtgcttataatccagaaactggtgaaatcaactgggattgcccatgcttaggtggaatggccgatggcccatgtggtgaggaattcaaggcagcattctcatgtttcatttattcagaggcggaaccaaagggcatagactgcattgaaaagttcaaaggtatgcaggaatgtttcagaaaatacccagaagtgtacagcgaagagcttagaaatgatgaagagtatggagaagtcccagctgacaccgccgctgaagtggaagccgaaaataaactggtggagcagatcaaggaagcacatgagaccgaaggttccgtttctattcaagctgagcatccaaatgaggccgctcaggaaaccccagaaattaaataattcttgtatgtccctgtatatagtcgagatataaagtgaatgtgaacgatccaatgattcaaaactagtcattgtagtctatttccaagtacctctaaagagataggaatgaaattcccatctggctctttcacgtaaagaacgtcttgtgatatgtagcaaacttcatgtttagattttccagccttttgtattctcagtaaattattgccaatcgattgggtgagaggggttatcaagtaccctttttgttcacaaaaatcttcaactatgttcttgtaggtagtatgaagtctatgctcaggtatgctattaacgtttactatcctcctcccactattaatcttcacaacaggaacaagtttaattaaggagtcatcagttggaatcttggggaagacatctcttttaatgttgatgaacggcgtttgaagtctgaaattgatcaaattgcaagctttttcaaaattttcatcaatggcgggatactgctttcgtttttgtgaaaaaaactgaagccaattaacaagccacctcataattgatttggaatcgtttcttaaaacttgttccatagtaaacaaccatcgaggaaagaaaactagttctaacatgttgttcatcacatgattgtggacgtctagataatccttggtatcaaatacttggcgtaataactggaaagactgatggctcccatcctgacttatagtgactctgttcaaacttttcattatcttcaagacacagtgagcgtcaattatcttttcggtttcttcttgtccccaaataggaccccaaatgtctacaatcttgttgggaagtggacctagttcccacctggtgtctaaccatacagaaaatttttctataacaatgttcaaacatccattcagtggagagacagatttaaaatagtcaaaccaatccagcagccaatattggggatccttgtcttgatcttcaacactccaaccattcaagccagcttccagctttggcaagacacagaccgtgaacaatgaagtaatccatggggacgcaagtacctgctcccattctgccaagacgctgattccaaggttgggctggtatatagaccatttattgaagaacaattgaagtctcggtttgatgtgcgagtacactaaagcctcaaacatggctgcatctctaaataattccttccatttcatgatcttactagtaatggtatttgtggaattaaagtcgacgggattaaactgtgccagtgcgtcttttaaatacttctctgttatttgaatcatgaccccttgtgtggcagagtgtatgcttttatcattattaatttctgtgtctgatagtagtgagagttgtttcaattgttctgtgtcgttcatctgcaaaatatgttggatcttttcaagactattctgatttgatagtaatatttttgttagggagttctcttcatttagttgatgttccttaaaataaagatcttgtttgatcttctcgagttttctcatttcctctaatattttcagtttaagctgccgcaaagttaacttctgttcctgaaagatgacgacatgatcatcttcttcgttctgtttcaggtccgaggtcttatcagcgatttgcttgagccattcagggacactcgtgagtttactcaaccgctctatgatggtaaacaagtcaattgttgaggaccgaacagttgtgtccttttctgcctttttaacgtcttctgccttcacaccggagcccttttcctttactcctcctactccaacaccttgtggacgttgaatggtttctattggagcgactataccttgtgaatctttccccaacccttgaccttcaacatatcccatctgtttcaatagttgagcgccgatgccataggttgcagtctttgggtcttgagcaagacctttattattacgttcatctttgtttactggctcatctgatgaatcgctatcccaactgtcatgtagacctacagaggccatggaagatgactgaacttcattgaagttctgacctcctgctctaacgaaattcataactgcctagagctgtcaggctatagctctcgttcggtttgaaggacgaatattaatcaagtcgctggtgatactttcagatagtagcagtctgaaagtttcagacgtccttacttttttaaggtcgcgcgatatcgggctcatctgtagtgatccatctctcttatcatctcttcacatcatccattcacctggaattctctatggtagtctatttcgtacaatggatcaattaaaggactggacagatgatgcattgtcttgcttgaaagaagcagagggtatctgtgggtctgcaaacagtgaattggtcaagataaatcaagtgctgagcaagagagataacctcctactgaagttgaccttcttatttgatgctagtagacagcaaatacgcttattggcaattttgaaggattcattggttaagatagtcaagaactacaaaactaaaaaccattcctggaggaccaaaatcacccgtgattgtgaactattaaggagtgtgctagacaccttgcataagatcgaactggaaccaagtttcagatcaacccagggcaataaggcgctgagcttgtatcattttgtaagcgatgacaagatagatgaattattcaatggtgttgatgatatattgagagagagtaccgatctctatggcagagacgagattgacaataatctagctgacatatcgagggagattgaagggtacggaaaggagctggaagttaggtatgccgaatttattttaaatgaagtcccagatacgccatcaaagggaaacaagaagaattctgccaaccacgataatataatcactaagttaataaccagcaataatgaattggagacggacatggcatcgcttctggaaagtttgacaaaccattttgatcaatgtaagaaaggtcaagatctattatcaaagccacattctgaagaccaaaagagggaattgcttcaagtactggagaacgattcattggagcttccgtatgttataaacatactaaaccaggactaccaatcattgaagactaattgttcgcatttacagagcattacaaacaaattcagcattttttataacaactttactgctcagttcatggtacgtcttaaactttttggagaagtaaagctccagcaaggtttaaatatcattactaaaaaggcccaaagggtcgaaatcttgttagagaaagcttttgaatatgaacaaagtgtggtcggtctgattgactattacacaaactttgtttcgtcatatcgaagtttgatcctggagattgagcgtcgtcgaaaaatcaatgatcaagtagaagcggcagtctcaagatttcgtaaagaattgcaatcgatagaagagaaggaaagaactaatagagaggattttttaatacagcatgctgattacttaccacaagatatcattagccctaatcttttggatggatcacaaggaattttgttcaaaatgttgcctacggttggcgttgagttcaaccgggagcctttgccaaagatctcgcgtcgtgggctagaggaagcacgcattgcaatactgggaaggaagtaacaggcgtaaagtggggtagttttttttagtctatagggtaaattaaaaggggtttatatacattttgtgttcataagtgacccatcactgatacgagcgtacgagttcctggaatagttcccgaacctcctccacggttttagttgtcacttttctgctatctcttgaccgcaaagaaatcacgttattttcaagctccttgtctccaacgagaatgatatagctgtagcttttgtttaaagcatctctagtacggtacccaacagtttcagcccttgagtcaatatcgatatcaaattggtggttcaccaagtcgtctaacgtttcgtaatcgtttgaacggccagataagagatcacgtacttcatttgcttttcccacatgggaggaatttataggaatgataactgcttggcgaggattcatccaaaagggccattttccttgataatggtcaatcaaaagagccataaacctctctatagaaccgaaaactgccctgtggatcattatgggaggcttgaagtcaccttcatggggtctatacttgagttcgaatcgatgtggtagttgaaaatccaactgtatagttccgatttgatgttcccttgagtaattatcccgtgacagaatatcaatcttgggtccgtaaaaggccccgtcaccttctctaatagaccagcttgaaggagcaacttgatctaagactgacttaagctgggtttcggcagaattccactcttccaaagttccaacataattatcaggacgagtcgataacatcaaggtataatctgatagaccaaaaactccgtatactagttttatcaaatgtagggttttcataatttcagcactaatctgttcctgcgtgcaaaaaatgtgcccatcatcctgatggaaacgtctcactcttgtcagtcccgttaaagctccactagcttcgttcctgtgcaacgaagaccagtcactataacgtattggtaattcgttgatgcttctatcaaatcttttataaattaaacagtggccaggacaattcattggttttaagccaaaggtttcttcatctttggcgtcgccatgggatacttcgtttccttccacacgatacatgtcctctttgtagttatcccaatgtccagaaatttcccaaagttttttcttgtaaattaaaggtgtgatgacctcatcaaaaccatgcttcttttgctgaattttcatgaattggaccagtttattgaaaagtctagttccatgaggtaaaaagaatactgaccctggagagttactgtcaatcatgtaaagctgctgtttaagagctatcgacatgttattggtcgcactggaggcaggagcttcattggagtagcattttatgaaattagaatacttgggtttgggtatccttgtgaatgacgttaggcagtttctaggtggtttgatcatgaactgaagtgaatatttcattcgttcccattaagtagtcgagaaaaatgttgattgattagtggagcagtgatatgattacatctggaaacagactatctttcaaagggttttgccttaattaatacaatcagtacatactggtgcaaaaaggttaagtcaggatagttgtagtgtatatagatgaaatcctagggtgtttctttacttcacctaaccaagtctctcaagttgacatccaacatcccaacgcgaatcgttctgaaatctgaaatatctgtctactaactaaaacatctaccgaccaactactatctctaatgagtgaaccattgattgctttgcggcaagcgatcaaagacaagaaacccgtaggagttaatgaaggtgaaactatcggcaatgctaaagtgctaaatattggtgaaaagcagtactcattagatgctcccacatccttcgtcataaatggcaaggaattcaatttaaaagtgatatatcaatgttgggtttttagggattcatcttctgctgactatattactgaatgtgaaaaggaaaatatcgatggtataagctttgttgaaagatcagagcttatttcgtggttgaagggggaaataactagcagcgccttcatcaaaggtgaaaaagttggaatcacggaagagaatggcaaaaatgaaggagaaactaaaagtaataacaaacggaagttatctgatgacccgttattaaaagagattgccagcaatgaaagggtgctaatcgaccacaacaaagttttgagaggattaaagccaaaagatttctcgtcagttgccaaagactgtgaattaagaatcttgaaagaaaaacctgcgaatgcgaaaagttcagactcaaatggaagatcaagtacctccgtgtcttcgtcttcaaaggatgctagaaacaaagaacctatcattgttctatctccagctgcctcttccctggtacgtatgtccaacgttaaagagttcttacaggaaggtaagttcctggatccttccaaggaacctgcatcttccagcaatttacttgccatacaaagaaagtcttccagattcaaaaccccaattaagttattagtggttgataatgtggagaagcttttcaccaagagtgagtattgggacagagttgtcgccattgttacgacgggcaaagattggcaattcaaaaactataaatacaaagaccctcagattctgttccagaaattcaacggattctacttcaagtacaaaggagatgccgtacctgcaagtgtcaaatcgtggaacgtcaaagttttggacattgacagagtcgagcgatttagtgacagacaagtagttgaacagttttgggatactgttgagaatactttagtggccaagagatataaatcttaggccaaaataaagaactggtgtatagtagaagaatattgtattcattacgccctcgaaggtggagacagggagacaggaaggcgacagcagagggcaacctactcctgagcttctagcgaatatcgcaagaaagattaatttccagaaaccctgccttcctcctctagttaagctttttgtgaagtaaattgttagtcggccaaattggccattcttttttagtcaaaatgatgattacaagagcaattatgcgaaggccgatgatgtttcggcccataactcatctacctataccaagattaatctatcaaatgaagggaaggtgctacactatcaagaatgagccaaagcctgagattcccaagtttaaggctaacttgccaccagataaaaatttgaaacagcaaataaaggcggatctcaagaaagagactataactacagaaccttccaaggttcacctccccaccaaagaggagctattgcgatcggctaggaattcccttgaaagattgaaggtgagattcaaatggcttctgatcagaagctaccggcccttcaatacggatgatttcagtgcttttttttcttggattgtggtaggtaatttggccctttttgtttttgcatcaacaacttttgtttcactggtattatacacaataaacacagtatttgctcaagaatttgtcgccagaatgctaggaaatttcattactaaaagtactaatttaactgtggtgtttgaaaatgctgttgttccaagttggagagacgggaagatatctttcaggaattgtttcgtaagcagacggcctcgaggcgtcattatttttgaaaagggttctcaggcagcagcagcggcagcagctgaaaagcaagctgcgaacaatggagagacttcacagaatgaaccaatagacgatgggaactatacccagtttgatctaacgattaaagaagtcaatatttcgttatcatttaaaaaatgggtcaatggtagaggtatcattgacgaggttgaagtgaaaggaatgcgaggcgtagtcgatcgttcacatgtttattggaaagagggagattccgcccttaactacaagaatgtttatcaacccggggattgggaaattgaaaactttcgaatggaagatgttctttttactttgaaacaaccactaggattccgagtttttgatgtttcgatctactctgccgatattccattattaagaaaaaattggttattttatgacttactgaactcaaataacgtcaacgggtcatatgatgggtcgttgtttgctatacacaacttacagaaaaaggatgattttgagggggttgtggataactcaccaatcccttcgactccaaattcatcttcgatttcctggagaagggttacaagatttagagtcgataacctgaatttggatcatttgaacgagggagttgaaggtccatttggatggattcacagcggttccgttgacatgattgctgatgttatgtctcctgaagagaatcagtttaatgtttcggaggtggtccaggccattgctcttagtatcaaaaaagaagcaaggcgggcaagcaaacgagactataaagaggaaccagacgaggaaacgattaagaacgacctaacaaagtactttgttttggacttccaattgaagttgaataatccaagggcttctgtacctcttttcaccgaggaactgtcctatgtcaacaacgctctgattcgacctattgtcgcgtacattaactcccgaaacacatttattccaatcaaatgtcgtgtggtaaagaaactttcggattttgatggctcttggactatctacgactcattacttatggatgatcttcaagctgaagtttatgatgcttttgttgattacgtcgccgatgaaaacgctagaagtgagagggctaaaaaggttggtttctggtccttacaactgttcctccacctaattctgtggagcgtgggaacaatagcatgagttaatgctctgtatatattttatgatatgaataatgaaatttaaaagtgaatggtgatcctcctgctaataactagtaagtagcctgatcatgtttacagtggaatatttcgtaatcctcctcgactggagaatttacccctaaattacatcacacatttaccatacccacatacttcagccacactatcaagcgtagtgctggattcatgaatcaggttgaccgaagaccatcgggattggctgaactgtccaccaaggatcagaaactcgatgtcagggctcatcagagaacctatgaaggcgcttacttgaggagcagcattggtgctctatcatttagcatcattgtgatcaagatcttcagtaaagagttcattgtaataggcataatattcaccatatacgggctacttcttttcctcgtcagcttgctacgtacgaggaacatggatctctactttttagcagatgataaagaaggaaagagcgtggttcctggaacacaggataacaattcacttgagaatgaggcagagataaccgaggaggacacttactttaaaaccagtggaaatattgttcttctgttaaccgctatcactagtgtgtgctatgtattactttttgtgttcctgcagagaatatagtatcgttccgggggatatatattgcctcgtgagcgttgttactgttgcaaaacaatatcttccaaaatggatgctgaatcatcgttgatatgtgtcactgttgtctgtggaaaggcggtggtggtactcagaacggacgatgcaaatgacgttcctggggaatgacacaccgagttcctggtaatattggctaattgatttatctttaaagagacttcgttggattctgctttgtccttcttcggactcacagatctcactggtgacaaagattgtcttggagtgtatggatttcgttctgcatacttttgaagcatggagtttcttccccaaaattctggtttaagtcccttactgggtgtatcatttccttcatcatcatcattatcatcatccaaagtattaatagattgcagtactttctccaacgagtcggtacttgtattcaaacttccattttcactctttggtgtgggagttgtttctgttgctgtggttcgtatagatgtatcagtctttgttctctcttgcaccgctggatctttgtctacctccacatcatgatcccccaattcaaaagtctgttcttgatagattgaggacccattgacagggttcaaatctgctgtcctgaatttctgctgttcattcaaccctttgtagagatctgagattcctcccaacattagcagggatacataatagaagaaaactcctagcacagcaatgaatataataagaccagcacagttgataaatccactatcaaatgtcaactgttccattatctcctgatacggttgacgtatttcaaggttgcgggtatcggtgtatgtcaattcaaccagggaggtattgtcctgtttctgtgctatctttattggggtattcacaggagcgtccaagagatttaaatgacgaactgcaaaaaacgaaatcaaaggtagaattaaatagtagattgtcagtgcaagtaaaggtgcccccattttggtctatattaaggtggatttgggtttgaactctcttaacttgagagcgtttcgatattgttttgattgcgatctgtcagatatttttcaagaaggattcgagccagtcacccgaggcttacctaactgtatggggtcaagtcagtcagtggggaaatgaaccggtgaagggctctagacctacaataagtttaaacaaaaattaaggcgaaggagcaacgaaacttaggccagtcgttactttttgcaagataaccattggaaatacccagtagctacattgaatcgtttgcaagatgataatttatgaatctacagatttgaattttgaaccagtcaatctgtttaaggaatggagaaatacgcttctcagtcaaggatgtggcccaaactgttgattaaaatacagtatacaaacgaatggctggcagtgctcggctcattctagctttttactggtgtcactggtgaacaattcaagtgaataggggccgttgcatttctgagtcctttggtatacttaaggccctgcgtcttttctgacctataattctagtaattcgatggagcgtagaggttaagttctgtgacttagttaagaggctaataatagcagagaaaatacaagagttctccatgccattaggtaagggaataaatagaagtgtgaagcttcaagttcagcgattttaaataataacaggatctagacaagaaccgaaattgttaggccaatgcaagctatacgtctcaaacacgaaacactgctcttccacaggaacgtttctcgttaactctaacaccaattagggaaacacttttagattagacttctactatcgtttccgcctcgccaaaaaatgttacatcagatgtgcggcgtcatgtctctctaatttgtgctttttcctttactcatagaggcaggtagacttaaaatatttgaaagcaattcccccagacgatacacattatctagcagcatcactcgattttcttcacatttctaaagcaaatatattctacgtttcgcccttttaattaggtacagactactaacttacagaatggaagaacatattgcgtgtactacacaacaaggaacatcttctgattcttccgatgcccatggttcaatagttctaagacaatctggaaaaaccactgatttgattcctggagaaatcaaacggaaatggacgttgaagttttacattcctgttttgtggggacactccaagccgatgaaggcatcagagcaaatgctgagggtcagttgaaagagttggaaaaaaattttgggttcttgggtgcatgcttggatatattgaacgaagaaggagtcagcacggatacgaaaagggcctgtgtaacatactttaagaatcgaattgtgaagaactggggtaactctcaggctatagatcatgatgaaaggccgataattagagaacgtctggttcaagggttaatcaacaacgaaagatttgttcagaatatgctgttcccggcccttagtacaatacttgcctatgattatcccaagtcttggccagagtttctacccctaacaatcaatctgctcaatgatacagccaatcagaatgcagtttttgcaggtattgtatgcctcagtgaaatatgtagaagttataggtggtctgagaatgcaagtcgaagttccagcctagatcccatcattatgaaaacgtttcctggaatactaactattgcaaattcattattggaagttgacacagataccgttctagtcggtgaaatgctaaagctcattttaaaatgttataagtttgccacctattatgaccttccagaaccactaaggacggagagtagtatatatggatggggcacactacatgttaggattattcaaaaacaacttcctgcctccgtaatggcaaaagatgaagatgaaagagttagaagtccgtatgtgaaggctcaaaaatggggatttaacaacctgacgcgagtgttcacaagatatgcatccaacaacctgtcccaaaagtttgattatcctgaatttaaaacagtgtttatcaaccattttgcccctgagctcatcaaaacatatttccagatcataggccaatggagggagggctccaaatggctctcccctgcgtgtctctacggcctagtcgagtttattgaatactgcataccccaaaaggatacttggaggcttatcaaaccatctgtcaatgatttgatagctcattttgcgtatcctcttttaattccttcggactcgttgttggagctttttgagagcgacccttacgagtatatccatatgatattaaatgtttatgactcgacgacgtctcctgctatggctgtggtgtctttgttgtacacactactgcaaaaacgctcaaagtcatgtttagagttagtcatgcaacttatctatgagaagctgacctctctggaggatgataactcactggagggtgcaaaacagagagagggcgcttttagattactgggcgcaattgctcataaactggtgaagaggaactgtgttttctatcctcagatagaacagtttttggcgacgtttgtttttccgtactttaattctccatacgggttcttgaatgcaagaacatgcgaagttgctactaaatttgacggcttggaatttcaaaataaagagaacttagctactttatatcgaggggtagtcaattgtttccagaatgaaactgatttacctgtacagctggagggagctttaggtattcaaacctttattgatgctcctgaatttaaagaggcacttgaaccaattattcttccaaccatgcaaaaattactcaacctttcaaacattatggagactgatacgatctctgctgtgattcaaaacttggttgagaattatgctgagcaattacaaccgttcggtctagaattgatggataaactgactgaacagttgtcaagactattagttgagatagaaacatctacagaacaagatgataatacagagaaagaaatggttgttctaggaactttgaacaccatcataactgttctactgtcgtttgaaaattcgaaggagactatcttacaattggaacaatcattttatccagcaatcgaatattgtctaaagaatggaatgcaagatttcttcactgaagttgcagagctgatcgaaaactcaacattcttaacgagatcaatttcgccgctaatgtggcaggttttcgagctagttatgaatacttttgagaatggaactggaaagttttatctttccgactttgtcccagctttgaaaaattatctgactttcggagccgaagtattcaagaagaatgctcattataacaatgctatgatgaaactcattatttcttcgtttgaagatgccctcgacaacaacgatttagatgaagagcagttgtcaattgcatgcaacctcgctttcacctttgtattatgtttgggagaggattctaagccattcctcccaacattgctaaaaaccaccattgccatgtctaatctcaaagtcagaacctatgaatgtaaggtgtttctcaatgatgttgtcttggcttgctttgttcatgatatccaaggaacactccagtctttgcttgagtcccaaacactataccctctgttaactcattggtttgacctgtcacagcatttgttcagagtatttgacctgaaactttcgttgatcgctgcgatgagcataatcaatctcccaagggactttttgatccagacaaagcttgattctctccttcctaactttggacttatgatttcttctctactcagaaagctacccgatgccattacgaacttgactaaacagagagaggaatacgatgaaactcttttggcatctgcgtcatcaaaagctgaagatgagtttttacaggaaccagaaggcgatgatgatgatgaccaccctgatgttctcaaggatgattatcttcaattcttgcaaactgctcaatctaaggatgatgtagatgaattcacgatggttgatgatccccttacaacgacacctcttgattcagtagatgtgtttggtatatttaaacaggtgtttacaggaatttccaataatgactctctaaagaaggatcttttcagccaaaagttatctagggaggatcaggaggtcattcaaagcgtattagaagtaactaaatagtgagcatttcatatagaattagcaaaacgctactacgcaaaacctcctaatctcttttttcttttcttagcttgctgcgattgtgaggacgcccgttgagagtttacttgagattgggtttgcgagtgtggtttttgcgttaactgggaaaatgataattgggagttagtgttcttatttttctgtttctgtgagagattgatggttggaatttgtgattgcactggcgtgaaggccttttttgggttaatcttctgctgtttagaagttttgagtgaattatcatactcattatcccaatcagagaccagatcttcccatgattctaggctcaggtctggaatggtatcttcagctcctatgtttcggacaagaatcatgtttagaccaacaaactgggttattttgttacaagtttcaacaaatggttgagatacttcttttgaggcttctggaggaagagtccacaagcacttgatgaaatgctggactgaggtcatggaatactgaaaacttggtccaaaaattggcttgagcattgaagtattcgatatgtcaaacaacaaatttgagttttcaaaatgaaagtagagctgattaatcatggagtctaactcctcaaaatcatcaatatactttggctgaggtataactttaccaagacacttcaagcgagagtcgttgttcgattttacaaatgagtccaaatactctcccaaagcataggcatagtcttggattatatgaacagaatttacgtccccaaaagaaggaagacaattctcaaaaatgcgattgacctctgacaaggaaagaggtgactttgatgtcctactgtttaattctgattggctcaggtacggtaagacctccaattgttcatcatcttccatcttcaaatcaggtgttggggaaaataatgcaaacgcaaattcgttgttcaggttgacataaaaaataatgaatatggtcaactgatgagatttattggagtcattgttctcctgtggaattttaagcacggagagtgatctcactgaatctgaggattccagcgttatgtattgtggatcattcagcagatggaattgatggcttgatttggtgaaaccgagctgcagtatttcaacgacagaatgacaacccgaataaagaaagcacatgaatcgaccatcaacttgatacagatgaagtttcaaggacatatcatggtctctgaggtagtgtttccaagaaaataaacgttcaaaggtgaatgagtcgaccactatcagttccttagttgtcaatacaaacagataaccctccgcatgttcaacgaatagtaactttgaccatgacgtcaactcaacaatacatgtcattgttttgaaattgtaatgatataaagatgaacgacaccagataaacaaagatttatcatcgacaaaaagtgattgtttgtagttggaaagttccattgggtcataaatagtacatcctcccttttcggtcaatatagaattagacaattcaaaacatttaagattcccatcattatccattattgagaattgtttgttattctttcggttgaatgcaaaatctgaaagatctccttcaaagtattcactgctatcaaaatggcatataatagatagatctttagtgttatggatttccatgagctggacagatcggactgttctaaccgataaaatgggaaagaccttcccatcagcatctttcaatcgtgcccaactgatctgcttaatcggggatatgaaatcgagagttgtcaaatttgtcaaaataggaagtttggtaaaatgttcaagttgagggtttgagcctaagctttccaccaaaactgcagcctcataggctatttgagagactataagcacactgctagaagagcctgacacgtgtgcaaccacttcatttctattagaagattcaaatcttgttggagccacaaggtctgatatcgttggatcaaatcgtgaggtggaattgaatactgctgactccgaatcgagattatagacaatagtatcaggtatataaatgtcattgtgtaattgatcaagcactttttttctgcccttgatgttgtatggtttggtggccatttgctttggtctaatggtcgatccgtcaatcttgtaaaggtgcagcttttgatccctcaaacagccaaaatcccaaagtttcgttttattggtaggatcatactgaattgcatcaacaccataagtaagctgaactcccgtttgtttatgtggaaaaaacatccaggtatatcccgatttctattggatacagcagttttgacttagatttacagactgatgagtatgtgcagatattttttttttcttagttaatcgttccagcgaatcactgatactttaatatgggaggaaatgaggttacaagatgggctctaactactatacacgaaaaccgttacgttaccaatgatcattgactctgttacttgatacaaaaatagaatattggtggcaagatcaatcagaatcaaactgttcagatctgtattacaatctgcatgtatatggagattaaagaccgagtataacaaactgctcagtgaaatgtactggaaaaaaaaacacatccaataatttgactgtgttggtagtaataaatacaaagtttcccagagctcttagttcttaacacccagtcaagttgaatattgtgctatcgatcactctttagtaatgtcttcgctgaaacgcaaatcccatccaatttgaggtcccaatttaggtaaaatctcagctacactctggacgtccttatcaccccttccagatacattaataactaaggactggtccgaagacatagtctttgcaatttgcaatgcgccgtagattgcatgactagactctagtgctggaatgatcccttccaattgagacaggattttgaatccctctaatgcttgggcatcagttacagcggaaaattgggctctaccatttgctttccaggcagccaattcaggaccaactccagggtagtccaaaccagctgaaacagagtgtgtatcatgaatttggccgtcgttatcttgtagtacataagtcataactccatgaaacacacctggcttacctgcagtcaaagtagccgaatggtaaggtgtatcaataccatctccaccggcttcaaatccataaagctttacagattcgtctttttcaaatggtgagaacatacctgtagagttggaccctccaccaacacaagcacaaacggcatcaggaagcttcccatcgttcagttccttgaactgttctttagtttcgcttccaataatactttgaaaagttctcactaatgttgggtatggatgaggtccaatagcggatcctacaacgtagtgagtggtttcaagatttgacacccagaatctgaaggcttcagaagtggcatcccgaagagtccttgttccttcctggacagccacaacagatgcacctaggattctcatcctgaaaacattgagggcttgacggcgaacgtcttctgctcccataaaaacagtgcatttcataccaaatttggcagcagcagtagcagttgcaacaccatgttgaccagcaccagtctcagcaataacacgattcttgcctagacgacgagcaagaattacttgagccaaagcattgttgattttatgagaccctgtatgattcaagtcttctctcttcaaccagatttgggctccaccagcgtactcagttagtctttcagcgcggtgaagggaagatggtcttccaatataggggtaaagagatttaaactctttccaaaattctggatcagccaccgcggcatcaaagcctttctctagttctgctaaacaagtgtgcaaagcttcaggtacatactgaccaccaaattgtccaaaatgagggttacatttgtgaacctcgttgaactgagtttcctcagttgcaatttcttgatatggaatctcgttgtcattgtcactcaaagaatcagtaatagtagtatcatctgtacgtccaagaatttctctgacgaacttctttgcagcatcagctcttaagctttcaggtgctgcgtcaataacgttgattaacttacttccgatgacaacaccatcagaagaagccccaacatccaaataatgctcgcgagtactgacaccaaatcctacagcaattgggcttgaccccgcaaagctttttactctcttcaccaattgaggcaatgtgtcagacatttttgtttgtgcacctgtggttcccattctagaaacgacatagatgaatgaatctgagatcttgctcagaacatccaatctctcatcggtggtagcgggagcaaccaaaggaatataacttagaccttgcttagcgcaataacctctaaatttaacagcttcttcaggaggcaggtcgcaaatgatgtaaccgtttgcacctgctattttggtggcctcaatcattttttgttctccataagccaaaattggattgtagtagcccattaagacgataggaacgctaacacctttagctctggcttgtttaacaatgtccaaacagatatctatattaacaccattctccaatgctttggtgttggcagcttgaatggtaggaccgtcagcaattgggtcactgaagggaattcccagctcaataatatccacgccaccagcttgcagtccttgcaaaatggggacagtgtcgttaatagtagggtaaccagcagtgacgaacgtgattaaagcactacggtctgtcaatagttagtaacagttcttgaattcattcgcctaaggtcaacttactttgctttttagccttttcaaaggcacgtttcaaatttgtagtcatgatgatgatagatttgttcgtgagtcaaatttcagatttagaaagaaatttttggagggagcctggaatcgcgatatctattactcatagaataataactgtcgggcttagcattatagagaggtaaagtaaaatgaaatacgaatggttaccagacaatgtggtttgtgaattactattcgtcggttggttttttttctgtctttttttagtagccaagttgttgttggtgtgtggggtatcattaacttgggtggacttcggtatcccaaatttttcagttgattacacgaccatgaacattttttttctttctctaaatatttttctagcacctttaagataaaccctatcttgcaactatagttcccagatggcttattctgttagcaaaacgttgtttgatcctgaaggtcgtttttttggctacagtgttgacaggaggagccgtaatgaaataattatttgtgaagtttcttcgggacaagttgtcagtcgtttccagctggatatgcaggatgagattctagcattcacttgggtaactcaaaaacaatcaaaagcttcagtcaagagggcaagtaaaagaacaaccaatggggaagttgtacaagccaatgggggtgctatccctttgaagaatttagcagtgatgctcaaaaatggtgccattctaatactatccccctatcacaatgacatcagcaataagattgttaatgaaagtgaaattaagtgcctcagtagctacagtgactcaaacggtatattttatggctatgataaagaattgaaagccataaagctatttaatgctacagagaacagaagtgtatccactttggagtttagcgtcgacaagaacatagatttgattcaagtcttgaagaacaacaccttattgctagcatctgcatccatctatctagtatctccaaatgattcgattgattacattcgtctccccgttccaagaggtcacggtacgaggatagtttcactggtccaatctataagaaatcccgatattattgttagtgctaggataaacgatacgacattgtgcgtccactcattacacaaaaagggcactgttactactgttgacactctgctgactgtgatcagtattcacaattttgagctcgatgataatgaataccttgcaaccttgaatgacaatggtgtaattcaaatatgtcagcttcccacgggaaagggccaaactatcacattttctcaaataagcacagattcgaaggttccattgacaggcttctatgttaaagatgggttcatcactgtcagttggttccaagatatgcacccccgatttgcaaagtttccctgcagagattctgactacattatcgaaaccgaagaaaactcaagtgaatctcaagaagaggatgatgacaaagatgaagacgaagtaacaaacattcttgaaagcgaaaaggaggaaataattgactctaataatattgtagaaaccgctgaagagttgtacgacttgatctccaacaacattgaagacgaatcaaaagttattagcatttgcgcttcaaataactccaacgtaggagaaacagtgaaaaatttgaataagtccaaagcttcccgtttgtttatcatcttggttcagtatttcacttctaacgtggtccattcttcaagtttgaaactctggataaaatggatcatagtaacacacggccgaatccttatagagtcccctgaaactgtgcaacttctacaacttttgtcatcgattctggatgaggagaaaaaagttcttcctacaatgctttctttgcaaggaaaattgaccttattaaaggcccaactaagtttgagaaatgagattgctagcatatccttagaggatgaggagaagaacgtcaattcgacaactgtatacactgtagcagacgagaacttgacctacgacaacggagaaaccgatgattttgccaacgttgaagaatgatagattaatatatgtatgtatatatagttggagactctgtattgtataaggtggagacgatagaacttaataatactaataataccttggaccatttcctgaaccgcgctattccatcagcttgcttttcaatttttttttttccctccattcgcagagaagtacatgattagaaaactttttctgttttaatttttttttctggaaatacgtttatcaacacagccgcaatgtccagtgaaaagttacacatttcatacaactttatccataagctgtgtcaagaaacagccgttaaaattagggaagatggtaaaccagatgtgattgtcgcaattggaggaggaggtttcatcccagcaagaatactcagaagcttcattaagctacctggtgaaaagaatattccaattcaagccattggtttgtccttgtacgaagatatggaaaatggagaggatgcaattggtaaagaggtcatccgtacgcagtggcttgatttcggagctctgagtcaacattttgattctttgataggtaagaacgtgctgatcattgatgaagtcgacgacaccagaactacattacattatgcagtcagtgaattgtacaaagacgtcaaagaaatggcagaaaaattgggacgtcaagatgaaatcaccaagttcaacatttttgtccttcacaacaagaacaagccaaagagagcagaaatagacttcaaaatgctaggtggtgggcagtattatgcagcaagagacgttccagatgcttggatcgcctatccatgggaagctgtagacatagacgaacatcaaaaacaagctgaaagacagggtttcgtgtagtgcgactgttgatcagactgtatctagatcattaattaattcttcattttgacgttagtttgaccatgtccttcacttgctgtttgcaaatatcttttaaatcttcaacatcagctcttagttcttctaccagttctgacttttctccaagaagaatcaaagcattttcgtactctgttttcgaatcctgtaactgctggttcagggtctcaatttcatgatgatatgccttagaattttcgtttagtttcatcagcttcacaatctcttgggtaagcccctttttctcttcagcgagatatttgttttcagttttcaacttggagacctgtaactccaatgatctcaattgagaagttagcatgtccattgcatgattcgtggggtgacctgagtcgtcaattgtgcgcacatcgctatcatttgtgaaactgttatcaagtatggatgcggtagatatcctgcggctagagctttcacctagttggaatgaattatgactactgttgttagtaggattaagacttgatgtaatgctggtggagctaatatcacctaatgatctctccctggaaagggaatctgaaggtattcctggatctgatgaaggaaagttttttacttctagttttcttatcaatcttttcttttccaagtcaaaagtgttgactttgttctccagagtttcgtttaacgctttgatctcagcattttttaagtttaattcctttttcaaaacgctgatgtctttcgaaagaacctgtacgtcattgattagcctagtattatcccttgataattccttgatttctgaggtgagtgctttcacttgcttaccagattgttgctccttggtttttgaagatgagatatcgctttccaatgatgaaattttgcgtatatagccatcttcaataagtttccagttctcttgggaatgagaaaactcctgttgtagttgctcataattttccaagttatcggatttctcaaactgtttggagttttcattggcaaccctcaatacctctatacgctcttcaagagatagaatttcttctttcaatttcttgatagccactccagcctctgctttggacgtgctaagcaaaagttcacattctcgaagttcagacaacgcttgatctctactggattgcaaatgtatgttcttttcacttaactcccttatctcttgattcgcattgtgtaacttattgtcaaggttcgtttccctcacctgcactttttttagctctttttctttttgttgaaattcattcttcagttgatcgtactttgaagcaaggtcctcctcttttatgaattctttctcaagagcgtccaatttctgagatctcgactccagctttctattaatttctgaagcattattcagttcattcgcaagagaattattttcctgcttaagccttttgactgtttgtaaaagtgatacttcgttcgaggatagcttcattccttcctccagtagctctttgacttgtagttcttttgcttcaagtttcttctgcaaattgttgataaccgaatccctattgttgacaaaagataagggtgtcgatgatggagttgctcccgtaactggtgttgagattggagtacgactaggaactggtgcattaattttcaaagcttcagaatcagttagatctgaagatggagactccgctccgtgaaaagaagcacccaaagcagaacctagcgtctctttctgttcccttttctttttggctttagtttgagcggcaagtttcaatctctcttgcaaagtcaatcgtttcggctttgaagtagtggcatgctccgctaccccttcactaatactttcttttccttcttcctttgattcttccttggattcgtctttggattcatcttttgattcctctgctgaattttccttccgtttctcaacatctccttctctagactctgtgctgtaattaggttcatctcttatttccgttttagattctataggttcctcagcatcaacttcagtgtgctccgggctgccaaaagaaggttgaattgagtcacccgcaaggccattcacacttgaactagctactaacggtgctgcttcaatttgtgaaatattgttaaattgagattcactctcagccccagactcactttccacgatgatcgcagttgtttggtcaacctcagaagctggtttttcagtttcttcattatttggaatgagtctatccactacatcgtcgagattttcaagttccttagagtttccgccgctcaattccaaagctacagacaattgagtttcgggatctggaacattatcaacttcagggttatcttccattgccaaactcactcaccacctaatcaaagagttgacgtttccataagtaccatgcctcgaaaaaacaaaagcgccatccgacatcgatacaaattaggtaaaacctttgatctactttatacagtttggctagatgatcgatatatgtacataattacatcccagatatgcagaaacaaaactatttgtttatagtcctacctctgctttatcttcaatggaggaatcactcaaaaacttcctcactaagttcttctttatacttctcttggaagttggatctttgttcagtttggcgagtatacggttaactttttcttcattagctttggtaccatcaaacagctcaacaagtttgtcatccctactgatcttcactcgcaagtcagtaattttctgtgccaggtatctaatgtccaggtcaacaatcggtttgtttggaggccatgtggtaacaccatatttttcctttaattgtgttattcttgtgacttcttcagcggtaagttcagatgaaccatggcacagcttttcgatgtccttcaaatcctgtactatgctgcttttctggttgattttatcctctcttcgttgaagaaagctattggtcttttctctctcttctttctgaatcttcaaggtagcttcttcttcgtatttcgcaaattgctgacccttattcttttttatttctgctacagcaaaatgctttctggaactcaagggtcttgtggcttcaattctgacaatatctccctctttacaaatgttaccctcatcatgaacaagatagtttttcctcttgaacaaagacttgtgaatctttgtgttatacgccatttgctctacgcgtactttgacagttttatccatcttaccttgtgaaaccacaaggcctataaagttctgcctggccatttgttcgatttttggatatgtctttgagtaaaattttgaagctcaactaacatgtccaattttcagtagagatacacgacctataattttcgcaggctctctgacgcttaaggaagcacggcaggtccaatttagagattgtgactcagatctctgaagcctctacatacaacatacaatttgcaatttttttgagctagtatcatggtttttgactacaagagactggttagacctaacatcttgagtttggagccttacagatgcgcccgtgacgattttaaggaaggaattctgcttgatgctaatgaaaatactcatggacctagtatatctgaccttagcacctcagaggatgacttgcaacttaacagatatcctgatcctcatcagttggagctaaagcaacaaatctgtaatattagaaatcaagaaacccccatcgaaggggagaaagttgaggtggagaacttatgcctgggtgtgggttctgacgaaagtattgacgccttgatgagatgttttttgaccccttcaaaagataaactattgatttgtacacctacttatgggatgtatggaatctgtgctacgattaatgacattgaaattgtgaaatgtcctttgaacttgcagagcttccagatacaaccggaagaaatcttgaaagttgttcaaaatgatcctactatcaagttactttatctcacttctcctggtaatccaacaggccaattaattgacttcagtctggtagagacaattttaaacgcgtgggaaggtggtatcgtcatactggatgaggcatatattgatttttcacccgtgggatcgtctagaagcaccctggtcaacaaatatccgaacttgatcgtacttcagactctttctaaagcatttggtctagcgggtataagacttggtatcacatttgccagcaaaccaatttccgcgttgctgaatgcgttaaagtacccttacaatatttccaatctgacttctaatattgctttgagagctacgttgcctgagaacgtccaagaaatgagaagcaaatgcaaagcaatctgcaatgaaagggagtttgtcatagattccctgacaaaactaccaaacgtcggccgcgtcattggcggcctagatgccaacttcattcttttgcaatttcttgatacaaatggaaaaccctctaatgaggttgccaagaagctttacactacattggccaccgagaataaggtagttattcgatacagaggaagtgaacttggatgcgaaggttgtttgagaattagtattggaaccagagaggaaaacaatactttgatagaccaaatgtcaaaagtactaccacaggttatcaaatcatctacatagataatcttcataatataaatatacagttttgtggtcacgatgtcttatctcatcgtctcatttctatttaaacagttgctcaaccaatgcattcagctttccgctataaaagtcaccatgttgaggtccgctaccttggacgttttcttcgtcgttcagatgcttcttgagcttatctaatgactccaaatcctttttgatacgataccttggatcaagtatatcagaaagaccaatttccacatcctctccagtgttggaaattgcggtgacactaattgcgcaagattctaaagccagaagctcacttggatgaccgctgtcatccttggggtccataggtgtgttgataggggccatttcaatgtcaaagttattactactctcgtcaaaactggccgaagggatcattaattgaaactcgcttctagtacttgattgttcaaattgcggatcgacacaattcacttgcgaacttgatccaaccattggaaaattcacattcaatatgacattatgaggtaagacacgaggtaatgagttttggtcatctagttggtcgtggcggttgaatttctcgtcaaatttcacattattctggtccacaaatcttgactttgtggtttgaaagtcatgatttccgaatggtgcatcacgtacgtagtcagagagtccatctattagttgtatcaccttctgcgaatacaataatgcagaatcatctggttggtctcttgaactgtggaatctggttgcaggaccagttgcatgcagactgatcactgggatctgtctaaaactcaaaaacttactcaattgaaaattggggttgaacagatgattcaaaggaccagcattgctttcttctgtgggacccacaattattaaatcaaaagaccaatcaacgtagaaagtaggtataatgtaatcgagagcaattagggatgtgcgtgctggacaatcatcaatatgccagatattgtgatcagactgctccctgtttatgtaatctgtatcgcgcaagaggcaccctgagatattgtcactgttcgaaccttcccgtacaagcccctgacaacttttagactccgtgagtggggccactaatagtacattgtggctagggtgactcttcaaacgatcgtataacgaccgcagattcgtcgtatcccatcgacctgtgcttgtgagcaatatgttcaaagcacaggcatgtgagaatagtagaaccagtacgccgagaagcattcttactggtcaaatttttagactgcgttttgttgatgttgattcaaaacgttattggcttcggtgtgggatgtctttagctgttttcaaggagtatgggggtatttatatccaaaatccacgtggtgggaaaaataaaggcacgttcgttatacatcgaataaattagatgcgagggaccaaaacccaatgcagaaatattcgcttaccacattagtcaccataccaaaacagccgacctgcgtttctttttttaggccatatgcagtaaacatatgcctatttaacgttctactctaatttgtggcggtttcccaagacgtcaattagctgctccaatttgcgacatttctggctggtttcacctattgtttctttcagcatggagagctccaaaagtgaagtctcaaattgttcaacatttgtagactggtcgggaattgacactgttcctttgtcttccgtatcatcctgatcgtctccatcttcgataacagtatcctgaatgattgaatttagctgatctggcatcgcatattgtttcactttttgtttggcaaggatcggatatgtcttgcgtagttggctgacttttacagtttgttcctctaactcattatacgttttccgtaaccgttggttcaatacgtcgtcaaaaggttcctgtttttccttcctgatgcttttaagagcctctttgatcgtagaagaatgcaaatcgtcaatgagcagattgtctttgtttagttcgaacaagtcgtcaacaaactcagacagaagttctcgaacttgctctttcaaggggtctcttttactttcggattcattggggagatggaggtccaattttttaaacgaagcttctagaaaccttttttggagaaacgccacatcctgaacttgcaagtgtattttttctttcattctcagatacttgtggtgttgacttccctcaagaaaggaaaacatttaaaaaaacccagtcgcgcggttcgtcgtcccagtttactagtaaaacagcgaacaaaagtaaagaattgagatgaacgggatagggcttcaaagggctctaatgagctacagtttcagcaaataagattgtaatggggtttccctgtttttttattgccaatggagtaacgcttgctacccttcaaaactgaccgttcaacctctagattacctaatacgatctgctattagtcttccaaccctagtgtactacccattaacagcatctaagtcggcagcacaatcgctctcggtcctttcttcaacgagccaaagacacataggatgacagagctagctccaaattttgctcccttttttggatttgccggatgtacagctgcaatggtattgagctgcgcaggcgctgctataggcacagctaagtctggtattggaattgccggtatcggtacttttaaacctgagctcattatgaaatctcttatccctgtcgtgatgagtggtattcttagtgtttacggcctcgtggttgccgtactgatcgctgggggtctctctccagatgataactattccctgttcaacggatttatgcatttggcctgtggattaagcgttggttttgcctgcctcgcaagtggatatgccattggtatagttggtgatgagggtgtgcgccaatttatgcatcaaccaagattatttgtcggcatagttttgattctaatttttgctgaggtcttggggctatacggaatgattattgctcttattttgaatacaaagggaagcggttagaattttctattatactgtcaattctattaaaacatacatttactttagtcggtgtccattttgtcagcaacaacgtcaacattaagattcacgtttccctgatcatcgatgtattgcagtctgttgtcttccagaaactgcactgatctgtcgctgtctaagaacagaatataacttttcttgatatcttcaataccaaccgtattggatcttctcttaatggcaatttgattggacacactaatcaaattagaagcatacctaatactggtttcggtaccaatctttgtaagtaatgctagagcgtcttctgtcaagtccacctcttcttccttgcttctaattgaaagaatctgctgaatgtccaatgatgagtaacattctgtgcggatgatgattgaacgatctaacaagtccattgggagaccatgtggtgacttgtatgaggtacctcttatcttagagatgcctctgttcgtagccataattacaatcggggaaaactcatcttccagggccctgttaagatatgagaaacattcaatatctagcatgtgtacttcgtcaataaatagcacacctggacaaatttcagcttttccttcttctttccattcagcaactttggtgttgatttgatctctgacttcagctctaatttcccccgtgtcaccagaaaacagggctagaaagccttgagaccttgaattgatcacatcaatttcatgtaaacttacggtatgtacaacctcctttctcacctgtaactctccctcgggacattgtacaaatttagtttctggtcccatggcatcataatcacgggctctagtgaatgatcttcccaacttactgatttttccgcttgctttatcaatagatataatgtcaccagctatgatcttttctctttgtaatgattcgatcatcttgtttcccagttcgtagattgtctccatatcagtagttttgatagtaagttttccctgtttgtgaccaccagtgacagatctatcaatttgaatttcgacaacttcaccttcgatcaattctgtttcttccttaatcttgattccaatggactttcggaacgcttgcgtaagagcttcggttttgctcagctcaagagagaaaatttcactgcccgcaatggaagtgaagggtacatcatcgcctagcgattgactcaatcccatagctatagccgtctttcctgtagaagggggccctgcaattaaagctgctctccctgcaatcttaccctgttgaatcatcttcaagataattcctgccgccctacgagcttttaactgaccaaccataccttgagagttggcacgtggttgcagattgtcatcaagacccaaaccgctaatgtgagagtgggcgctaatcaaagacagatcagatgataacgactctactgaagttgtgcttacgttcattgatgatgaagggttggtgtttctagaggcaagaaaaaacaaacgaaaagcgaaaagtgataaagtattcagcgatctttcgcgattacctcctaatatctctatcctagaaggcactaggtggaatccttggaggatatgatataccctcgcctaagaagcagtatcactagattcctctcaaaaaaaaggctcagtttgaactctttaccaagagcacatggaccttatcaccaattgtttatcatatatcccatgcctctcatttgacccgaccctcaagattaatggagtgaattacaaaatagagaggctattgggcgaaggcggattttcttatgtctatttagtcaagaactacaatggacagtatgctctcaagaaaataacatgtccatttggtaatgagaacctcaaagtggcattgcaagaagtttcaaactataaggagtttaattctcctttcatagtgagaagcattgattatagtgtagtctcggagaaagaaggatacaaaactgtgtatattttgctgcctttctttgagactggaattcaagatataatcaccgacaacgctctcaacgatacccaaatagacgaaaaggttgcaataagaatgtttatagatatttgccgtggtttacattcgatgcacaggcaccataggaatgcggcaagtgactccaatgcaattttactagatacagattctgatgctgaaaaccagtctctcattaacaatgattttggtacagaattgaatgagaccaccattttcgcacatggagatctgaaaccctctaacatcatgctttcaaaggatgagactcctgtcatatgtgatcttggctcatgtcaaaagatgcctatcaatattacatcatttcagcacgcaattagcatccaagaactggttgaggagcactgtactctaccctatagagctcctgaactctttgatattaagagcggggataccatcaccgagagtatcgacatttggtctcttggttgcaccctttatgctctcctgtacggattaaatccatttgagagggaggagcaaatcaatggcgccaacattaccctcgcaataaatgccggaaagtacacctatcctgatggcgattacactcagaaaatcaaaagcttgattgacatgtgtctagtagttgatcaaaaggaaagaccttcgattgaaactgttctagcaacagcattggaaaccaccagttgatccgaaattcacatgcttatgtcagcattaattatcttagtttctcgactgtatccgtggatcaattttattttcaggctggttgtctttagactgcttgaacaccagtgctttcatttctgagagcgccacaaagaaatatcaaaactagtttaaagctgctaaatggataggccctcttatcagcatgttccgtcgcctacaggctggaacgatcttcctccagctttaagctccaccaatcgtccgaaacaaaagcgaaaaagatatgtcacccctaaccatttagaccaagtcgacgtctctacagtgaaccagcatatagaacaaattgtcacaaagaaagatattcaagaccaagaagtactgaagagtctgcaatcgttgatcgagcgcttgggtcagctgacccctcatgaacttcaaattgtggataaactgtgcctagacgtcatagaaggaagagaaatatccaaaaaggaagttgaccagccgtggtacaaagaactgatagctgttgtggaatattccaacagatgatgatgaaaacgtagtgggaagttgaaccaagttaaggagattgtttttctacgttattggagttcccagacgatttgctgtggtgtgaataacagagcaaaatgcttctcatagccaagttttctatcttcgttgaagacgagcttgtgatccaaagttaatgtggtaccggcctttaccactgcagtcttattatgtatgtacaagtatattgatttcatttccgaaacatgtaacttttttctaatacctccttcgcctggttaattttcattgctaaatacggactccctcctttatctggatgatttatcagcatacattgcctatgtcgtttctttagtttctcatgcgttaaagtcacaatttctgactggggaatccccaatataagcagcgcctcactttcagttatgggattaaaaaatcctccaggatactgggcaaactttagtttcattacgtcgttttgagtgtgtggttttgataactgtatcccgttcaattgggctatcatagtgggggttaatttgacgtacctataataagctctcaacccacttctaaatgtcaaagctgccacggtaagtcccaagccagcgattattgggagaaccatagctggagtcggagatggctggtaataatattatgaagaaagtaaggtagtatcacttggtctcaacctctactctaagaatgcaaacaatcgatatagatagttcgcgagaaccttattattttcaggtaacgcactggacaggtacacttcatcaggtatttcacgggtttctctccaaatttaagcttgcttctcatgaaaacattgactctttgtgtggcaggaatttatgcatcgtttattctctggggctatttgcaagaacgcctgtcggagccctacaatgggcggcccttcaaagctccactgatcgttaatgctattcaatcgtttttcgccatgattgtaggctccatatatctcagtgctaaaactagaaaactcagcactccaatggacccaatttcgcaaaatcccaaaataatttaccaactggccctaattgcggtgctttcttcgggatcgtctgcagttgggatgaaatccttggagaatgtcgactacttgacatatcttcttgctaaatcatgcaaattgatccctgttatgatcgtctccgtcttggtatacagaaaacgatttcctgtgcacaaatattgtattgctttgtgtattagtgctggcgttatcttgttcacattaaagcccaagtcgctgagtaattctattgattcctccgctggaaactggagaggatatctttgtttgttgatatctttatttttagacggtttactcaactcctctcaagatcagcttttcaagactttcaaaatttcaggagcacagttgatggctgcacttaacatgttaacatttatcctcatttcatcgtacattgtgctattcacagatcagttgccatattttgtttcctttgtacaagtgtctcctcaattgcttcagaatgcaatattgtatggtattgcaggagccatcggacagatttttattttcttaactctagagaaatttgactctattgtcctcaccacggtcacggttacgagaaaaatgttcagcatggtactgagtgtgcttctatttggacactcattatccttacaacagcaggttggaattggactagtctttggcggtatttgctacgaaagctggctaaaaagcttcggctcccaagtcagcccaaaagcaaaactgtcgtagagagaaacttagatttttaatagattagagaattacataatttacatcaaatagcattaattctggtgggatgacagttgcaacaaagatttagcagctcccatggatgatggagtaaaaatgtccctggtggttgggctggagaaaagcttgttctctctctttagcttcacgggagtacaatacctgttgaaagatgatgattcaggcaattgaatagtggtgtcattacaaatgatggttgaattagagttggaattgcaggcgggcaactgtgacttctttgagatcggggtggaagaatttgcccgttctagactatcgttatgcatatctaagtcattgtggatgctaattttacagttggggttccttttgatctggtcgaatgttggtggtggtagatgagccgtaatctttgatattggaggcaatgtcacattggctgagttctgggactgtatgcgaggtagagcagatttcaaagagcttctcttggtgccagcaatgtccgctagttttcttctttttgaaggattagacatctcatccttaagggaatcatctctcttaaagccaacttgactactgttgatcaggtcgtcgacattcagtgataattggttggtttgaattttgaaaactgccagctgtagtcgggttttcaatctgtttatcttgtcattgacatcactagactcgtcttcaagttgtaacgcttttatgtgactcttgtctggaaaggtgagaccgttgcttttgagctgctgatcaggatggtcagcacccaatctatgaatgtttagctgtgtctctgatatagttcccagtactgctctacccattagttatgctatgttttgtcccttagtttactagaactgttgttattgtctacttcgtcagctatgtatgtattattttttgtcaacctcaatatttacgttttactcttttcgattctacgcggtacatgcaatgcgatgtctggcgcgtccagcgtttaagattatttagagccgattctagcttgctccgtgtttactggagctcagtagtttgacttccacaagtgccaccaggtaattcaattaactattacattcattcaccggttctttgttgtccagtcaaattccatcgttcaccacatagatattttatatgtttaccctttactcttctcgattcgtacactgatccgcattggtccttccctattgggagtcgcactgaacaccatcaacttttcgtggaacgggtctgcgttgccatggaactaatgttgtcaaaactatcaaaacgcttttatatttttaattgcctataaagagtgatgtatgtttacaactcacagatgtaaacattaaagatctagttcaagattatcaactatttccttcagattactaacaatcttttccttaatttggtctccctttccagcggccaccagtaacactagctcgtttaactctgcagatcccagaatgtctacatgttcagcagttttggcacctcctcgaatgtcaaaccgatcaggttcatgatcaatctcaacaatcttgaccttgctatttcctgggttgtaaacactattagcttgcttccatatgtggcacattgagtgagtcattagactgaccgtaccgtcaccatctgccataagaaccgaatcatagttcttttcaatagtgacgttcaatttggtcttagccggatcaacttcttctcggtagtagtaagctctttctgtaggatttccaaacccataaaagcaaaacactttcagatcaggtgcatttggaagtgatgcctcaaggggattggaccattttgtatgatctttattattttttttcagctgcttagcagaattggtgaacccataagagtaagccctcaacatcctgtcttggaaccaggcgggagtctgctccatcaaaaactgaatactatcagtcaccgttaagttcttttgggagtacttccccaccggctccttgaacctaatgaaattaccataagtgtcgtttcccaaatctccaattgacgtggcgtcatcaggagaactctcgagatttccccagattagatctccgcctttgggaatcatgctggctattccaccaaaagaacggatcatatcagcacgttctcttctagacagaaacttttctaagccctccacggcgagggcgtttaattgaactgtatccttcatttctccggataaaagagcaggtatagccttaggagtacccagcatacagccggatatgtccacaaaagaatctacatgatcattcacccagttagggcctccgtttccgtatccgtcagcttcaacccacttcataaaatagtaaatcacttgtgaccccattgaatgacctaccaaaaccgattttttcccactctgatgcttttgaagttcaacgaaaccttttaattttgaaaagtatgcatcccgtaattctaaatccagaaaagcaagtctccaatcataagcagcgctcaccatgttgtttggattatatccaataactgccaagttctgaaggattttattccaaatccagtaacctgctataaagaaatcagcagcttcaaacccctgagctgctctgaggcttattcctggagggtctaatcccgttgttgtatctagcataatatgtttcagccaacacgccttatccaaaaacattgtccgcaacatgtaaaatgatccccatagacgttttctaaaatgaccttcggaggggcagtcaggagttccttccaagccccaactttccagcccggtgctgatcacaccaggaacaagaacaatggaatgattagcttcaatcattgacttactcttcaattgcttacctactgcaaatgattcagagctcaatatcttagaattctgattgaactgagtactctcaacaatactttgaagggactttggtaagacatccttccaatcgtcaaaataggtggaaagagagtcaaagttgaccagttgatctatgtctggaatagggtactcagaactggtagctccaaagtacaaagcaacagcgattcctatgaaggctccaaaaataaaaattacattctttgactcatagaaacgacggacagtctcagcgctgtggatttttcgaagtgatggtcttctgtgcgttgacgcttttcttggtttagcgatgttgtcttcatccggaagcgtgtcgtttactgaagagtcatccaagtcaataaccgtgtccgaatcgccgatgtgcgattcaagtctggatctctcgtttcctcttttccgtagttgcataggtgaaaggctgacggctccagctggcgcgttttgatcaggagaatgtgaagtaatggatacaatcggataagatctaatgtttgcatccctcgaagatgtctagtgcgagaaacgcatgtgcatgctattttccacgtcaaatttcatctgtcatgagaattaagtggaggaaaaatcgtattacccttaactgaatatgtagactagttacgctcgtgctaagctatcaattgtgaacataatgttgatattttaccgacaaaaagaaaacaaaaaaacaattccagttgtttcattgtagtttttagctactcgtcgtcatcttcactatcattggcaacaataacggggatttcaaactcagagttagaatcggagtcatattcatttgaaatctgaactgtggcttccttatcgaccccactaaccgacacttccactcgagtttcttctctcttccaggaagagattttgactggttcttgttcaactaatgtgatgtcagtcaacccagtgtcaggttcttcattcttgctcatggattcaatagtatcgactccatttgaatcaacaacatctgttgctatatcactagttttttgtctcttcgacaaggaatcatcattatctaactcctcctcactatcttcatcctcaccatcatcaagataggaaatagtaaccccgtttgtccccgtgatgccattttcagatgtgtccctcctaggagagatcgggaagcgtgggttcataaatacactcaagaaattgtcgctgatgattgatgaaatgatcggtaagatgctatttcgatcatggccaggaaacaaaatggagttgtgaattaattcctgaagatttttgtccatttttacttcatttctgtgcttaacagtatctattatcacaaaccttaaaatctcagattgtttagacgacggaaggagacatgacttgagaactgtggcaaagaactggcggacaacagctagagttcgttttgaagcggtaatagtgaataaatgctggtgtgataacatatcagataggggaatgacctggccgcctttcttctttcgtttcaagaagctaccaccattgctattggactgatctaattttggtagccttgacttagtgatcaacaaagcaacatccaccaacttcaataaaggtgtgatattgacaacgttgtaagtaagggataaaagttctgatgcagccaatagaatttggtgaatatagtcaagctgagaccaaactctctcttcaatgatagtaatatgtccattctttcttatctctactggaactgacaactcatataccgaaagcaacgacgaaaaatgaggcagtaagtttccaccaaatattgatggaagttgcgtcaacagctctaaggcgcaagttttgttcttgatgatagagtattctacagtttttttcaaagaaacatctctgaattcccttttcatcggagaaaatctcaaatccaggctgagattcaactccagaaaagaaatgacgtatcccagtggtagtttcaccgctgttcccctggggtttgagatgaatgctttcaggagactaattaatagatgcagcctcctgctgatttgcaaaatgtccaaaggctctaaactgtcaatgtccaaactggggaacaaaggtttgtagttgcctttttcctcttcgttgtgtggtaaactcggtaacgaggctaaaagtttttgcaaatttgagtcttcattcaaatctaagaactctgaataaatctcaaacacttctttcatttcgatcaataagtgtagtagtttctgtctataaatttcttcggtgtttgttctttctagagcgtattgtatactaacaaagttggatacgaccaaagtttggagctcattgtccattttgtgtaatccttcatcgtcatcaagcagaattcttagctccttttggatcttggttgtaaaaggtctcaacgttgtagtattgttcataagaagcttctgtaacacaaaattagctggcttggggcaaagatacatcacgctaacaagcgattgaataattgacggaagccttggtgtcagtatttctctggtaagtgcaaccttatgccttattttgtccataataaaatctagagtggatatagctgattccaaacaggtcatctgtcgtacatcaatggttgatgtgatgtaacacttcgactcaataatcttggtcaaagcactaatatagttaccagcgtccgatgcaataatccttgggtgaaggcaaaggacgtggacaagttttgtgccaaaccaacggacttcagattgatttgatctaagataatttgcagcacgagaggtaacatgcgtcaagtcggcttttgaagcttcattaacggcgttctcatcagcaaggatggggagtatttccatcagatccgcctcaactgaattatccttcaaatgcggaatgacaacgtcgagtccaacaaatccttgatatcccatcctggaagtccaattgtatgatctaaagagattacttcattctagtttttttttttttttattggaatttttcagcccaaggctctctctatcagtgtaccgaccaatacgtatcagatacagataattttgagctcaggcaacatggaaatttacttgtctctagatagtcatgacagacaacaatgaatacaatgttactactaagacaattttcacatatattcccaatctgataggttattccagggtggtcacagccatcgtctcattatttttaatgaaacagcaccctatatatatgaccttcatatatggagtttcatgtctactggatgcgttcgacgggaccgctgctaggagatataaccaaacatcaaaatttggtgccgtacttgatatggttactgataggtgcaccactgcatctctaatagcatttttggtgattctgtatccgtcgtatgctattttatggcaatgtctcatttctttggatttggcatcacactacatgcacatgtatgcttctttggtagcaggaagtggatcacataagaatattgatgaaggcgaaaactttcttctcaaactttactacacttctaagaaggtgttatttacagtatgtgcattcaatgagttgttctacgtcgcactttatttagctgcttttgatttcaaccctcttccactggtgaatatgacttttggtagattattggctgttgtttcatttccaatatggcttttcaagcagttcaccaatgttatccagttagttggtgcggctacaaaactggcagagatagatgttacagataaggtcaacgaattgcgcaagaaagatggcaaatgattgtatatactttttagttggccgcttgaacaatgctgaaaggaggatactggagagccacaccagttgggggatttatattgaccattaactcagacattgatatttatgtagtatatactgggacctcagaactggttaacttattgcgcgaactcctcttctaagctagatcgcctattctatcggtagaagaaagtatatcaatgaactggcagtaacgttgaaagaatggttgaacaaaatgagagtgtgtccaaggttttattgcttccagctctctctacttcgaagatttctgtactgtgcctgatttcattgttctgttccaaaaaacttccgaaaccctctatcccacctttgttatcaataatagttcacgtcgtggacacttcagacacagcacacgatgactcaagactatcaattttaccaaccctagatgggctacttgatgatattggcgaggccataactcgacactatcaattgaatcccaatctggacttagttttgtgtgcaaaggatatcaaaaccgtaactactttactgcttgatttactggctggtatacagactgtggatgatctgcatcaattcatgaaagactctaaaaaccttttggttgaaaaatctagagatgtgcagaactcaccgattaagctactcactaccaccagttttctaggtaagtttgttcacaaccttattgttagctttgagtacctggacttttcgcaggtttctgatttctgggcatcattccaagagtataaactggattccaaacaaaaatggagaaacaaggcgaagttgaaagccgaagacaatgctgatcttgtctttcaagagaaattagtagagctgactggctttagccttgatggttttatgactatgacatcttttgctgaagaaggaaagcagaaaagaagttcagaacgaactttagtcatttcgcagctagacatttccaatctactggatagacaaatacatcttctcgaagcttatggaaccccaactccttcaagcttaagaaaagtgttaaatttgatggcgcaattagaaaatggaacattaccatctatgtactatgttcagtatcttgaacatctcaaaggcaatgaataccagggagcttttgattctttgcatcgctactttgactatatgatgtcaaataaacaacaagccttctatcattatgcactactatccttggctaccctccatgcatctttcggtagcgacaaagaagcccttagagctatcaatgaggctattttagtggcaagagagaacaaagacctgaattgcttgaattacctattaacgtggcttttaaattttctcaaagataaacctgatcttttcgataaggatgtcacatccaactccaaagatcaaatattacactttttgaaactgaagacaaaagaaaataagaaccacagtttgcattccatatcttatcagtttcaagctctaaaaactattttagaaggaggccctttgcaatctattttggaagatattacacgtgcttcatacatactaatgaacttggatttcaaaggtgaagacctaaccacctttgtccgcaattgccaactccagctatcttactggatgcgggttggggtgataccgttagcggaggtatacatttctatcgcactggatgcttgcaatgcaaaacacaatgtctttgatgagctttcgattttaatgagaaaagcttgtttattgttttttaaaggcgaggtagaagaggcattcaaaatactatcttcaaagcaacaccaagtgagtcaagatagttcagtgtttcgcacgtggaacctacgaactatggtgctaaagttaaacttatggcttaataaatcaagactacgctgttcaggaatattgctctctacaatgttggctcatctggatacagttaatgatactgaactaaagtatgaagttttatactacgacgctcttcatcaacatctccttggtaataacacagaagcgatttcaaaagtgtcttccttgcttcaggagcttacaaaaacaaattcacattttaacaactattggtttatcaagtataaactgctatatgcggatatatttgtcaaagcaacgaactcatcctcgcgttgcatgtctattctgctgaacgcaattcagcttgctcacagctcctctctcatacctttggtggtagaaggctcgttgattttagtgaatcttcttataagactagacccaaaagaaaattatgatgatgcattgatcttgcttcatcagctgaagcccatatgcttgcgattagaaattgcagaacttactgcgaacgtaggatttctcttatcgcaaacattattcataaaactaaaaacgcaggatgcgagactacaagatacaaaggaagagctaaatgaaatactgaatgaacttgagacaggaattatttattataggaaaattaacaaactacaaatgctactcaaatgtttcgaacttgaaaaagaactgtctatagagacagggcatgctgatctcttagcacatgctacggattctattcagaagattaagcaccggttaagggaggaaaatcaatatgggtttgtatgacacttaacccaaattcatttgcagtcatgtgattacttgtaaggcgaaaaagccttcaaagttctttcttcagttgcaaaattctgagtctactcaaccttgtgtagtagttagtagttacgactagcttcatttatagcaaaaaaggatctccatctttgtaaaattaccagtccaacgctttcagttgcacaagctcgtcattttccaggtgggtcaactttgtttctgctttcaaacgtttgtaatataagatacaattttgattctcacaactggaagctgttaaaaatttcaccgagttgaaattttgaaagttgggaagaaataaagcatgcccagaagagcaaaactcacataaattgaatatgttttgtaccttcttttctgcattgtgaattttagctcctagactagtaactacttccaatggagaattttggcattgccggcaaatttttgatttattgcctcttggaagattggtcccacagactaagcatcgtagtactgtaatgaaatggtggatcgttgacggcttagaagtgtttgactgcttgatgtaaggtgatattctttgaattactggcatctcagtgaaccaagacctgacattgacacccatcagttgaaatattctttctaaaggtggaataataaccttgtcaatatagtattgggcatccaactcaagaaattctgtatctttgcgggcaaggtattcttcaggtgataaacaacgatcttttaaccgttcttttgttctccccttaactactaaatatggtattctttctctgtattgcggtacagcattgggatcctcatcagctttcctggaagcaactagagcaccaggtggtatgtacttttctttgtaagttcctagccttacttctttagcaaagcaaaagtcttgtaatccaacattgttggttaagattttagttacctgggcttgaaaatactgtttgacttgagataaatcacttgaatcaaaaagaattctcagggatttctccacaattttctgttgggctggtataccatcccttctaacagtctcaatacctttagcgtcaaatttcggttcggtttgctctggcctctcgtaactatacccaacgtatctttttttactcaatagagtagaagggtggtataccttttcaaacttaagtttcaccggttgtggattctccgaggtaacggctgctgccatttcctccccaatcatgaaggcatctgcttttgacttccctggaagatatacaaataaggagtctgtgtcaccatatacgacccttgcgccccagttagtgtttgcttcaattagggagattgctctgttcaaagtctctcttgctgaagacacaatagcatcagcgatatctgcacaaggcattcttccagaaaatgttgctgatgcgtacccgtaggtcacatttgcaatcagtttaagtgctagctgcctgctgttatatgtctgtaatatcctagggtcattacctagtttctttatggcactttttacaagtattctggtgtccagaaggtctatcaacatttttccaatgacagatctacgaacattcgatttcacaaacatgagtccgttaggcgaaagagtaatatgatgcttcaacacctccagtataccagctggtagcttattctttgtcacacctatcatctgttccttaaaagcatcgtagccttgcattcttccaaggcatgtagtataacaataattatacgctataaccaaggaaggatataatgactgaaagtcaagaacaactatgggacttttataaaatgcagcctccggttccatgatcagaggtacgtacgtcaagggatcctgtttgaacacatcttttttgcttggggatatcatcagcaagttctcctgcttggtaagtcttacaagtagactctcaactttaaactgcgatcctctggaaagaacggaataaaaatctatgcctatcagctttgcctcttctgtgacttttgaaactatttggatttgagttattatttgcatctctagagctactcgctgggtaaaataattcaaaacaagactcttatattgaggcttatcagactcaaaccactcagacaatacaccatagttatagtgaggaattctcaagtgaagaatatgatatactaagttttccaaagtgtagttagttaaagtaatttcatgtgttagagcccgccacaaattcagaacatgcctaccagtaatcctgaaactcgaaccatgtgtatacccccagtgatctttggttttattattgaacttgtattgaaccctcgagaacttctcgcacaaatctagatcatagacatgtttgcaccgttcaatcatatatccccatgagctggaattgggctcaaatgctgtaataatatcggggtcgatgtattcaactagtgacacaaactcttgaacaatttcaagctcgctccccaagacagcaacaggctgtttgcaaagaagtcgaagttttctcattgattcctcggttacattttcttgccaaacaaatattccagaatctttaatttgtagatcaatgtttgaattttgggactcaaagctccaaaaaattgcctttatggcgtctgtttgagggttaggagttttgttttcctcggtggaaatatgacattcagcacacaatgagagtaagtggctttccaaagaaggtttttgatgtgaagtgttatgcatggagggataaacaaattggttattggaattcggagttactccaaacacctgggtaattagtttcatcgattttgtttgcctttcatgggagagccactccttcacgtatgaaaaacttctcggagtaaggttgaactcccattctggaccagaaacaatcccgttaataggctttcttttggtgaatgtgagacctaaacaactttcagaatatggctccagacatgataggtgattggaaagtaaagtgaactttctacctgcaaaaatgtatggatccctcaagtcgctcggatctgaataaaaaggatcgggatactcaattttcaacatcccttttgaagccaaactcttagagaaatcactaaaatttgttgaagggatttcgaagcttcctaatgagagtggccgattgtcagaattcattgccgaataattctgtgtgctggagtaaaaaaacgaatcccaatcttgagtcgaatctttctcaattgggagattcgatttttcaggagaagcctggatatcttctcctacattctcagattcatcttcattgcttagatgcggaagagtgatttcaaaccagtcgttaattagttcatctgtgcttgatatttgatcaccatcagattcatcttgagtctgctctatctgtgtcaggcaatcagactttgtaaaattttggctgcttaccaaaatgtccatcaaattatcattggtaaatggcaacaactcaaatttagacacatctggtttcgtgatattctctgatacgctgttaaaataagtaggaacactggccaacttggggttagaattgtcaccaaacacctctatattcagaggtctatttgagttgtaagcagctatggatgattcgatcgcaagctggaactgtaactcaagctcttcttgatcgacccaaagtgctggcttgagtactcgttcactatcttcgaacaaggttgcttgagttttttcttcaacgttgttgaccgatcgttgaaacttgatgtcttcaattatgccttttgtagaagacaaatacttttctgtctgggattcgacatctggttcaagattcagaagtcgatgtagatctctttcccgtaattggtctctattcaatatccaatcagcgtttatatccgcttcaaaaaaggagttagtaattcgttgaaagctacttgcagaaagaacgtttagtttgttttttctattgatgatccttgggtttagataatctttcaaacgcttgttgagtttatcctgattcagctgtgaattgccatcaattaaaggggatctccaataccattgtttgatcttcagccagtcacatggaaacaagttataatctgtgagaaactgcatggtatatggaatatgtgattcaaatggttgaatcttggatccaaatatttttccttcactcagaagtttcgaaagcttgggaacatacttcggatttaataagcaaatcttcacaaatgcggagtgcataacatgaaatccataaaatggcacccctttaactctataaatatcagctatgaatgtttgttgctgaggtataagttctggattctctgagataactgaattagtttccggaaactcttgatattcctggccatcaagcccgttgaactcctgttttccaaaactcattcgaagcttctcgtcaatttcatgtcgtaaattttcaagatcatctccctcccactgaatcagtaagtagggatacacattgtggatgtgaacacaacaagtgtggcctgtctcgagtttaccaaaaactcttagcactggggcttgtggtagaccaagtttttcttcaaactgtgacggtggatcagattgataagagtctacgcagatgatttgaacttctaagttcatagaatgccatttgaaaaagttttaagcaatgaattacctattacgtgcgaacttgctaactatagataatcagtccctctcgaaaaacctgatcggataagagagttagcaattcaaagacttatatttagagcatcaggagcattaccaaaccggaattgacttgtacagttcaattgaaggttactctagcaaatatatattgatcatggccaaacaattggtttacttgagatttccaatggatcgtcctaaggaatcatcgaaacaaaacgaacctatgttgacaggtaaatgggacaaagaaaaattggatcaattatatgacatcgtacatccgtacttattctctggcaggattgagtttaattggaagaagctagaacagcattttggggaatcagcagactcgatcaagcgtcaggtaatcctactgtcccatctggatcattatattggcgaaacaccttcaagaaagaatagtttagagacgaaccaagcttcatcattgaataagaccctacagcaattagagactctaaagttagaggacgctgcggaccgagagactttgataaataatctacaggccgcaaagctaactacaatcaacagtcatgatgagcctgataggtcagttgctccaagagccaaagagcctaaagatgacaatacaaacgcggttgagctcctgctacaccgatcaatatttttgagaaaacaaccttccgattataccggctcatcgtccatgatttactcccaatctgggggatttagtgatgaggatccagaattggtcaccgattcaaataatcatgactaatagagcttagtgaaagctcgtaggtaaggtttgggtgggcttggtgtgggaaatgaacatacaggtttatgatcaataggcgtcttgtttctcctatcttttgtagatgttacatgaacaattggcggtagtgattttaccagttttctgatgaggttacgaaatctacaacaacgcaggcgctctaaattcttccccacccccttcattacgctgagctgacgcagattctcatgttgaaaagttccaacctgatttctccatcccaattggcaagctttttcaaatctaccaactcaagattggtcgctgtcgatgcatcttggtatatgcctaacgtacctgacaatggatttttgaagtatcgtcaggtccgattaggagccaattctgttttcttcgacattgaccttgtcaaggatgattccagtcatttcccacatatgttaccaagtgttgaaaaattcaacaaagaggttagcgacttgggtatcactaaagaggatacactgctgttttatgaccagcagggaattttctcagcacccagagctctttggatgtttgagatattcgggcatgaccctgctaaattggctattcttaacacgtttccaaactactctcaaacgattggagagtcgacttttgcttcaaaggtgcaagacgatataccttacttgaacaccaaacccgttacgagcccaactccatttcagaaatcagactacaagtcttcagggattgatggatcgaagatcatttcttacgaagaattactctatctcgtcgaagccgatcaaatcgggacacattttactctgatcgatgctagaggttcttccagattcacaggtgaatctccggaaccaagacctggtttgagttcaggacatgtgcctaaagcaatatcattgccctttactgaactaatagcatccgatggctcgtatctctcccagtctgcattggtctcgcagtttgaatccaggaaaatcgatgactccaaaccaattattgttatgtgtggaacaggtgttactgcctgcgttctgagaacggggctgcagcgtgcaggactagggtcgaagggaattaaggtttacgatggtagttggactgaatgggctcaaagagcaccaaaaaaattcattgtgaaggatatctaaagttataaacatgtttgtgccaatagccacacacagagcaagttgaagtaatgatgtagagaatacaagctcctggaaccaaaaaccaaagaataaaatacaaaataaaccccgaaacagttgaatatccaaatatactccattcttggaagcatcttaccttgaacattagattgcaccaacaacatgatgggaagcactgctaggaagttgtggtgagatgaaaatggtgtgggccaattcacggaaaagttatgaatccatacaacaagaataggtacatttataggcaagatccacaacattagcatgagtaaagagacattgtagttttgtacattggcctttatcgaatcaggactactgtcttgaactggagtctctgatggactcgaaggacttgtcaagctttctgaagagtcgttagtttcctttctgagtgcgattctgactgacagtattgcttgtacgacggtacatatgataaaggcaaattggtaaggaacataaacaggtaccagacaaagtaatgcaacaaatccaatcgtccttttcttttgacttaaaaacaatccccctatccttctcctttgaaaaaaagtggattttcttaacatagatgacctgccaatgagagtaacactcatgagtaaagtgtgaatgaaaaaataaacaagagagatcagcgcaatcgaaatcactgtaaagcatggcgccaaccaccataaaattgattcttcgagtcctaataagtaaggattgatatgcattgagtcacttccggacaccaagttcatttgcttgacgttatattcattcaagggttctaggaatgcaattagtgattgaaaaaacccgtttgaacaacagatagataggacagatactgagaatagtaatggtagtaatgttgaataatgaactaacatagttagtccttccccaaaagctggaaagtatccctccttgtaatgcacattggattgcaataagaaaacaattaagacaatagcaaccggaaaactaattatcaacaacctataacgcaacaccaagagtttaagtgactgaaaccaggatatcgataaatagatatccattacttcttcgatagcaatagagtcactgaacaattggagcgacagatacgttctattgtctctttcaaatggaacataaggtatcataccactgtggaaaacaagagatatttgatcattttccttcaagttaactaaccatttggtttcttcgttgatgtgaaacttcaacagaggagtgaacagttcgtgctcactgctcttgtatctaatatcaagcttgtaggccaacaaactactatgcgctgatggaaccagtaagttcaaattaaatggtctattcttgggaagagtaaggtagtaacctctggtaatcaattcataaagactgcgctggccgagcgggattgtttgagcttgatcttgttgcatttcagcgacaacaaactcatcttctagcttctcaggcactcgcaccaaaacaaattggtaattggagagtgtatcagtgtggtattgaataagatggaaaggaggatactggccatcaattgatgagcttgcagttgtccttgtgtttttcaatgatctgggaattgagtgagagctcttactgacatcaatgcattccatttctactgaattggaaggctctagtggatttgtgtaatcaagaacggatgtctcttgtgttgctgaatacttcttggttgctgataagggattacagagcaagaccgagggatttttactactttcaatctgagattggctaaagggcgacgaacttaaaactgtgaaaattgagccatttttgggaatttcaaaaaggttgataactggtttgggagaaccgtaaagtcttatccttgaatctcttgcatccacgttgtcaagatcagtattcactttaaccctcatgggcaactcgttaacctgagaattgacaacggaagcttggttgagctgcaaggaattgaaatcctttgaaagtccatccaaaagatacgtttcaaatatggacatgcgcttttctaagttataggttttttgtggggaagatgaatctatagtctccaatagcactttagcaatgacttttcgtaactgatcacaccaaacaattgcaagatggtcaattggtgtccaaacacctggtattccagtagagaatacattaaagccgtgtgttcggggaataaggccctttagcgttgtataatctgcaggtaaagtggtgtctaacaatccgcccgtaactgatactaacgatacattctgtagccttgagtgagcaagttcatatagttccgaacctagagcattgtcatgcattaacccaatcctccaaaattcgtctgtatctttgtaaatacgattgagatttccatcaaaagtcgcaggagcagcagcatgaggagtcgctagagtcaagatggtatttattgattcagcaacataattaggcaaagacatcatgacgcgggcaactatgccacccatcgaatgtgccacaataatgacagaagtgggtgggtttttttgttcggaatacagagaaaggatgaacttgacagcctcattcaagaattccgcttgatccagaagcgttcgtccatgaaaagcagtgaggtcttcgttgaagtcggcggtgaaaaagtcaatcttcgaggagtttggatttacatccaattggtatcggtaatcctgtgcaccattcttgtaaaatctatcgtacaggagtgtgctttcagaggcgatggatctcacttgtcgatagcttccagcatttccaggaataaataatgcaggaactccgtccaaacttaaagtctcatcagagccctcttctggtatcttgtcctttccttgctctctatagagatacaaagagtacttggatgcaaacctcgagtgattttgattaaacgctttcactctggcgtatgagggaaacattgtaaccttgcgacagaagttactatcaatttcagcagcagactcgaaccagctaccacaaatttgcaaaatgataagcaggccgatacatatcactatcgacaatgaagtcttagggtatcgcatgcttctgccctcgtgttcgtccggttcgaacttttccttagattggacaaaggaagatgagggagagtcaacggattcatgcaaagatgcttgatttttcccggaaggcagttgttccatgacctcgcccttccgtttgtcttccgtttacaaaaggtagaccttgttggtggtgtattgatggtttcgatggaattgaaattcgtgccagatgctacatgatgctgttagatgatactcaaatttgagacgcgtaaagacccaagaataaaaaaaattaattaaacactttaacgcgtcttgcatgagaaaggggttgttagctgctctgtattcataacatcttactcctttgaattcaaacatgcattttatgaaagacgcccttcatactgttgcatcccgcaggaaccaacaaaatgggattaatagtcctttaggaaggctttctgcacattcttctaaacttttccctaagtaaatgagattctcctcccaaattcagctacgactgttatcaggttttacaaagggacctaatgctagaatgatcagactctgcatacgcttgaaaccatattactagggtaatcccctgcgagaatgaagttgacattctactgtaacatttttgaattagttcattcttctcagtagtatttgggtagttcatcatacaggaacaagtgcaagatataccttgaatccgaagcgaagggtaagaaaaaaagagatgttatattggataacatccctactccttctgagtcaagcggtccactcgacgccctatgtcgggttcccgtttgatcaacaatttccaactgttgcgcgtgtggacactcagtacacatttaccatcagcaacgaaacatacaggtcgcaagatagtacagtaacctactcagcagagcaactgcctgaatggcttagctttgatggggcatcactgactttcagcggctatcccgctgacagcgatgtcactagcgacttaaggataacgctaataggtactgactctactggttctatttccaacgaatacgaaatggttgtgagtggagaccctgctcctatagcaaatcctgatgagtccatttttggcaagctttcacaagaattcgaaactaatggctataacggaattgttttggctccaggcaaggagttcagcatccaattaggagagaacatcttcgaagcggctgaaggctcgtcttccaccagtcttacctattatggaaggtctgctaacaggacttcgttacccagttggtgctcgtttgattctgatacagtaacattctctggcacagcacctgtggtaaactccgacattgcaccaagtgagggtttcggattcatcctaattgggaccgatgtcccaggctttgccggtatttccagtaccttttatatactggttggagctcatcagttgtctacctcaatagatggtcagatcacacttcaagggaacatcagtgaaacacttgagtacacactagacagatcgaagatcttttatgatggggaaatgataatagatgatgagatctctaccacatctttgtccaatgcaccttcttggctatcaatagatgggttgactatcaaaggcactgtcccagatgagactaatgataatggagccgaattcaacgctacattggcagattcaataggtaactcagttacctttggatttattatagacttgaaaggatccctgtttacagtggactctctcccaagtttaaatgtaaccaaaggtgaattttttgactaccagctaactgacgatctcttgtctaggccagatgatacagaagtatcagcatcattctcgggaaatgaatggttgacatttcattcgaataatttgacgttcaatgggctagtacctgaacaattcacaacattgaatgttgaaattgaagccaatgatggcaactcgtcagagtcactagccctcgtgctaagaggaatttcactaagggtaacgtcttctgctactacatcaagccagtcttcaacttccagtcctacatccactggtacttcttcgatgacaaacatgtctgcaactccaactgagtcctcaaatggagattcaaattcttctggagctcaaagtacaggaatcaacaggaggagcctggcaataggtttgggtgttggtattccctgtttcttaattctgatagctctgatactattgtgctgctgttggagaaggcgtaagaataggtctgacaacgaaaacgggttagcaagtgagaaggcaattgccggtggaccgtatcctgatgataatacttctgatgcctccactaaaagagagaatgaggattctcccagaaggctcaacgcgctcaatgcattgaaacttgacgagaaagatttcaattccgacgatatgagtggtctcagtgatggtaccaatatagatgacaccgatgaaaatatataccatgatgcccaacaatttccctacgaggtgaaaaaatcttggagacataacgaagcggaagatcagttggctgacttggttgagaatccaacaagtgggaaaaactggaaagctagagactccatgaactctctggcaacagttgctaccaacgagctctacagtgtcaaagtggtagacgacaacaagaaaagagtctcccaaatgtcaaatttgaatctctacaaagaccaaaatcttgcaagcattcctagtcttaacaatagtgccaatgtccaaaaacttgatagtgaaggcaacttgaagtttgaagcatcacccttgcctgatccaactgtctcagcatccaacacagataattcattaaacgatactattcgattcaagccaacattccttgaaaacggagaagtacgctgggacaccaaacatgacaatactggtgacgcaaaactcatggactttaccagcggcggtaggacttccagctcggctggactagtgaacagtcaatcgcaaacaggatttatagtatcagatgatgaataattaccaactaatatctaatctaacagaaatcatctcaatagacaattgaattgtatactttaaataaaataaaaagaataattatgaaaaatcaagtattaatatggatagcttcctttcctgaatagttccattgaagagatgtcaatgtggttctaagcttttttagcttcatgtaaagccttggcatactctgctgtgtcaaaagctctccttcttccctcgatgtacaacatcatctcttcgtacgtttgaggaacgacagaacaatagcctggcttgtctcgtacaccttcagtgtctcttggaacgaagaaagagtaaatgaaagaaccgctttcaattgcttccacactatccaaatttcgaatctttgtatctaccttaacttggatgattgtacccggacgactaagaaattcggaagaatcgtgagatatctggttcgctggaggcaattcgtatgcctttagtaaagaggcaagtactggaatactatcaccttcaccctcctccttgatgtgttcagtgtaacagactcgagcattcatgaataaaacggctcctactggtactggagctttgaaagtggtagaatccaaggagacaaatcttgggggagcacaggaaaaggcaccagctgcacagtaagccagctcaaaagtttgcctcaaaaggtaacctccaaatatcatgtatgagtgtctgtttctatactgaggctgcatgaataaggtggaagacacttgggagtctttcataaagatgagctttgaggactgttcgggatctaacttggcaactgctttggaggcaatgtataaattatggatgagattcgattcctgttgagtagggggtactttgtccagagtttccagtttggcccgtaattttttctgagcattatgcgattctgctcgtctgaaatctagccattccctttcattagtgggtagtaagtgattgattggaaacgacttatgagtttcagggttacgtgccacaaatgtaaaatcagctttcaggaaaaccgcatcgtcactcaaattggtttccttaatctcagaggggtagtcaccagggaacgcgtaacctttcacagaaatctccatagaagagcgaccggtccaagtgacaacacccgtcaaaacaaagttgtagttttcaatatcgtctacctttttaacaatatagatacgatccacggatgcggtgacattaacaggctcagcgggcgcacagtgtctataagcgattcttcccgccagggcatctagatcctggaatagttggcccacgcgtagtcttcccgcagcattgatataggagtctcttaaccagacgtcgtctttaaagggcagagtaagataagagaaagattcggaccttgtcttttcgccaacggcagtcgtcttagttgactgataagcaaaagaactaattgtcttaccttcagacaattgtctcttcttttcatttagtgcatcaagccacgtcaacttattaggagcagactcactgggacggattcgtttttgaaagtctaaagagtccgctagaatggtagcagtcgcatcagcctgctcagcagcatccttagaacctggtccatctggtctatgaaagttaaccttggtagacttgtatctacaaggagtgacaattgaccttcttagaagagtagaccttatcatttgaagacgttgaacgatgagtaaagaagaagaacaaaatcgtaatctcaggaaatctgcagctatttaaactcatcgcttggcacaataagtcgctcccataagactcatctggtgtaggggttttttaaaatagacagcattatacgcttgtcagtgcgctattggttgaaactgaggggtccaagcgcatgaaaagatctattgatacttttcgggacgaacatgaggggaccaagatgcgtagttaccacattcgaagaaaatgttgagtttgtttacgtttagggatgattcccctcagtgccagtttatgtctatattgggaaataaagatgaataatcttgtgtgttggctaatcgctagatgagtgcatcacaacggaggccaactatccagtgcagcgaagataacgttgggtgaaggtccaaccgagacttgggtatctacaatgttggcacaatgaaaagataattatgtggtcttgttattttgaaggaggtaagtcaatttggataaacatatgcccttttctagtgttctcggtaaaatagaatctagactagcgctaccgaaataatgggttaggcaagacaaatccaaggctctccggtattctccgccctggctcctttcacagcatgtttccccatctccgcctccaatttttcagcccttatgtgcgcagtctacttttgccaaggatatgtggttgtttatttatcttgtgacaattatcctagccacggcggggcaagcaaacggttgactaatcgcttacccagcatctagtcgtttctcttatgtaagccagtagcaatttgtataggagaattactttagcgatttacgttagagatcggacttatcagttatctttagatggagaggcaacggcagattgctgaaaacagacagagagctctggagaagttaaaacaaagaggtcttgctcaagatattgttgatactcctgcaggtgctaccagagttaaagtgccagaaaagaaagttgtaaaaccgcactcattgaccaaggctcaacaagataagatagaagccaataggctaaaggctttggaactaagaaaaaagcatgaacagaaagcagctgcaaggccatccgaacctccaaagccagctacagtaagagatgctacgaaagcagttcccaggaacaggatacccagcataaagaaatcagattatattgaatatgatctagccgagatgaaagatacatatggaggatttttagatacagaccaggaaccagagaacgcaacagagaagagcctacaggactggttaattgagaatgagaataagattgtccacgaaccggcacctcccgtagatcgtgaagctgcacccaaatgcttcgaatgcggttccatcgaactggatcagcaactttggaccatattcaagtgccgagtatgtagacgttgcaaagaccaaaaaccagagaagtactcgttgttaacaaagacagaatgtaaggaagattaccttctcacagatcctgagttagctgatcacg

SEQ ID NO: 98 - DNA, 843995 bp, Pichia pastoris
aaaaagtggaatggaccggaagaattagacaatgaatgggcaaagcgagaagagcaaagaatcaaaaggagggataagaaatttgaaaccaagctgaaacaaatgaggaaacgaaccagagctgaggaatacacaaggaagcttagagagcagaaatatgggaagagtcatgtgcatcaatggtcaatgcctattgatgggggaaagtcgggtttagttagacgtcgttgtacggactgtgggttggaaacagaagagtatataatataaataggaaaagcataatcactagttttttgattagaaccgcaaaaaattttatattcattcaaaaaggtatacacataacacaaatatttaggtacttcactggaaatcaatttcaaaactccacaatcaatcggataataattttgtagagggtccaaagatttcacaagtgagattaattacgacaagaagatttctatttaataacaatacctaaatatataccccgcccaaaaatctgtttatatgtttggtctctattatctgatgcctctagaccttattgaaatataaaactacttccaatgcatgtaattaatatatacactttatgttcacctgacatatctgtccgatgctcgcttgaattatctgtatcagtagctataccaaatcaaccttcttctcaaacacccctgaaaaatatgctaattttgagagaaaaagacgtccaggaagtcctgaaagggctagatccaaagaaaattaaagagtttcaaacagagttagcctctagcttagctgactacaataagaacccaagtttgattccacaaaggatcgtcgcatcaacagacaatgcagttcatctctttatgccttctttaggtagaaatatagggctaaaagcactgactggctcatctcgtggcttcaaagggatagtaacactcttggatggagaagatggtactccaattggtattttgaacgcttcaacactcacagcgtttagaacagctttggctacgactttagctctttccaaaacatttcaaactgaggatgacttagatagactagtgttagccgtgtttggttctggacctcaggctttttggcatgtaaaactagcattgattctctatccgtcaattaaaactgttatcgtcgtgaatagatctcaagagactgggaccaagcttgtgagtgaccttaaagcagaatttcaaacagtggattatgagttacatctcttgaatgaacctgaagttgtttcaaaggcagtttatagatcttccatcatctttggttgcatcccatccagcgaacctgctgtcaagttgaaggatctcgatatgacctccaagactttcattggtctaattggcagttataaacctcatatgaaagaggttgatgacaagactattgattttcttgtcagctcaaactccaagatcttggttgattcgtatgaacataccaagcttgaagcaggtgaactgcaaagtgttgacacaaagcatctaatcgaattaggagaaatatgggaaaatgataagtttaacattgagtcggtcaacaataccccagttgtactgagcaaaattgtgggacttagtatcatggatgtctgtgttggagcagatattcttagccgggctcgtaagcttcgcattggaataaatattgacgacttttaagtttatagattaaaagtattattattgtacatgaatgattttgagttctatgatatattgtttgctcgatactagagtgtatcaagagacaaaagttcttgagaaggactggacgcctttcttttgattatttggatgtctcgttcccagttaaggcctttcagtagccatgatgcgacgtgattgcaatggaaacttttcaacctcgccctctcgtaatgatttacattgtatggatccccatgaagtttgagttgggttttttcaagttgcatgaaaaccaatggattgtgagaactgtcaaaatcatacctagcttgctttgaaaggttggtgggcgatacgtacatgaaaaaagtcttccagcgatcgtaatatgggatgcagctggagtatgtcccgttaagttctctaaccatcttaggatctacctccttcgtttcgtatgctttacattgaacaaacagctttactttcaaggatggattttgtcgcaatagtaaaggttttatatgcttcccccttttgttaccgatttggtactgcttctctaacttggctattgaagcctgttgctcaagggaatcttcaggcaagaactgttttaggtcccaaacacatctaatatctatacctttatcatttgcaccaccttgaagcagtagcctggatatgttgaaatgttcgtctaggaaggtcttggtcgataattcgtaaagagtgccttgaaacacggttgaaatgtttgacagatccttttgtttagcatagtccaagtacgaaacgacactatcgttctgttgcaaaagccgcctcgttgcagacttacttcgtgccagtggattatgaagacgtcccctttgaacaaaggagagcctagttatcatagatgacgcgtccaagttggattatagtagaatattatgtcaggtaaataggagccaaaaaaatcgaggtatccactgctatgcaaacgaggaacttaacccaaaattaatacacggatagaagaagcccaatgtcaggaaactcttcgaaggacaatgtgtcggacaactcagaaaggatacgggcattggacatacaagatgatgcccctcttccagaagaaaaacacaaaaaagaacaatcggcggcagctgtctctgtgttcgaagttgcttcagacctagaacagtctctaagtagcttggtggagcagtttgaaacttcaaacaagaagattggcaccagctttgatgatatttccaaaagattactaagtttggaaacgaaaatacggaactataagggtaaacctcaatgattattaaagatgataacgtttcgttttatatagaaaaaacaactatctagtcgttgtgttcaagtttgacatgctctatcttaccaacatttccatttccatgattggaaactccatccaatagatttttgaaggaatctggcctgtaacgaggaagatccttagcagtatactctgtggttgattcgttcctctggatagcttcccattccttcatatgaagatttacactttcacgggtaatgatccaatcttgtcggacttcttcaaatccacaagctccttccaaggtcaatactccatcttcgtcgtattcaacccctccatgagcactcaggtaatcttcaaattcctcataagtgcagtatttctttttttgtacccacattttccagtcatcatgccattcatggtctgccagttctgtgtttatcagtactttatctccatagtttctaagcagggtatcttcaatgtctttaacggtgtaggatcgagaaccttcgaatattgttctcctcaatgggagaatatctctagtaaggtaccaattaccgttcttgtcggccagagccagattcttagggttttctttcacaccatctctaacccagtcaggatatattccgtgcatagctgaaattgcactgaggtcgatgtaggtacccctcttaacgtccacaaaacgaccatcaatatggttaccacctcttgtcttcttcgtgaaccaaggagaaatagtcagtaaataggttccatatccatcgtgggggttctctattattagtgtgttgttatggtgatgagccattcttgccatctccgccatgggcattatggcatcgatgtccgaatcccaagggtggttatttccattgtaataccatccaattaagttaccataaaagaaccaaacaacataaccgtgctgtcttgcaaacaagaaaaacgccttattcatgtgatgcactgaagaatggatttctcttggtaagaccattccactgaaaaatgggaagtgtaagtgatgggactgtaatccagggtcgttttcaacgtaattcacaggaaaataaacacttgcatctgaaggcaatgtttgaatcccgtgttgcagtccttcctgatagaatatgtcttccagctttggttctttgatttgctctacctttgccagttcttctgtggcattgaacttgaaatcttcatctgaagcatcaagttcctcagggaagggaggatcccaagcaggcaaccctttggaatcatagatttcatccaacgcatcaacctcctctatgagattgagactactgaattcgttaagtccaccttgtttctgatggaaaatgctccagagaccctcattggatagtttttccttttcggttaccaagagttcaaaatagcccttgtttgacatatagacgatcttttgaggaatcgttctgtatttgtagacttccacgttactgtgaagaatatgtgcggtgtagggagaaaaatcttccaaatcattaacaagtattgcttggagctgctcgtaagaaattgcattttctccttgtctcttgttgtaattgtcgaaggcgtcccaaaaggttgatgcaattcccaaacttaaccagtcatcccagtggaaagaaacctccaggggcggaatatcattcaggtcggtaccttgtggaagctccgaatactgatcttgaaggcttcgaaggtatgcagctacaggcaaccttggatcaaagcgttcagttcttctattgagattcttagcaaagggcaagactgcttcctcatcaaaaagcttgactttatttgttaccctttgaagtagttgataattaacatcagactcaaccaaatgattgatgttatccaaactatgcaacaggtggttcaaaaaatacgcagtcagtagtagcatcatatacatgacatactccaccgtattgaaggtatttatcgaaccaaacaagttctttgacgtttctttgaacatggcgaacttttctgggtcgaagtcaagagtaaatgatttagcaatgaggagcaataagcgtgatgaagtcgtgtgatctctagctggaatgacaatttttttccaaccctacagtaatgccgcctcatattgttgtacagcaatggaattggtagaggttttgagaccagttaaatgtaaggatagggctaacgagagatttcatgcaaggcacacaacataaacaatttcaactaaaacgcggtaaatttcatacatacaagcaagattatgtgctatatagaactgcgtatgaaataagattactggctggcagcaagttctttatactgcaattatgcgtaccaaaaggagtgaggaggggcagagaggtaaatttgagggctctctcttgcctgactagtcggaatcactatgcatatgcagttgttccaaatcactcaattcgtgttctccttcagtgtccacatccccatcttcgcaacccgctacacaccattctacattggtcactcgttgaagtctttgtagaatagatgtcattggagtgaacaaaccaaactgtttgaactcaccgtcgtaagaatgaatcataccaactaccccaagccctgtagtagaagtctcctgtttaagaccgtggaaatcgaaaatgctcatcgtagcttcacctagcttttcagtgaatgactggtactccctaacatcttgtagcttggaaagaatccatgcgcctgagtctccagctgaggcaaaacccacaccattgttgtcaattgattcggcgttgctgtttcctccaagcttttgagagtaattagaggatcgaaccacaaatttggagctttgcaactttccttcgttccagtatactaacctgacgccgttcaggttaccagatgtatatttggtagtagatccgtacttgaacactttcagaccgcctgcacaggtggttccacctcctccagcccttttatccaaggtgtcaaggtcgatgacttttttcacatacaaattgctcatgatcaatgagggatcgtactcgttgtaggaaacatcgtctcctaagtgattggaaactctaagagttttgtctttagtgtcaagtttcacaatggccagatctgatagctctcctgattcctcatctataactcgttcagcccacgttacttttccaaaatcttttgagggtaaatttctcttgatcttgagttttcggtacttgttatcagagtctaaaggtaatttttgaaggaacaccaattgctggggagggaacagaacattgatatcttctaccacacggttataagcctggtattcttcactgtactcctggtatcgatttcgttcttggtatagggcttttcgatacaagttgattaaaactgccgacggaactgcaattctgctcgtgtctgaagcagacgttatatttgaggttgctttgccgctggtgtctagtaaaacatgagcacaagtgatggcaaaagtactattcaaatccgacagaagcttctcatttttagtgtctttgggaatcttggggtataaatatcctcccagcgtccctgaaagtccactagactcacatgtagatatactcatgctaatgggaggaagtaacgagttgctaatcctaaatggtgctttgaatttggtagctgcaggtttgattgcgttttgctgacacatgaaatgcatgtcctcggacataccatggaataagttgacgatcttgatgtgttccttgctcacttgaggaaagccatatataaatgttagtatggacaaactgggctctccaaatcctctcaagacgggggcaacaaaggctccctcttgatcagaaattccacttccctcactggcgagctgttccatgatcatgtttattttgtcctggttcggtaaaggctgagatgtacagccgataggaaacagacaaggagttagttgcttggagttggataatttcaacttgaccatcaattctagggattttgaaagaatcaaacttcgggaatgacgatagacttcatctctgagtatcacatctatcaacagaagaatacttttaacgaactttctgagccctagactttcgatggtgcaaaattgtcttggaggcaggaacttcagtctttcatttcttccaatttgggctattgtcgaatcaatatactcaataatcatcagcgacgcccgcgtacaattgatgatcgattgattgatttgtagaacgacgctcaggacattggatgccaatatacgcaattgtttctctatcgtttcgatgagttcatcagtggttaatgatcccgggacactagtagatgtagtcgcaatcctattggatgacagttgctgcgatgattgttgttctgctaaagattggtcgtaaagggaggaattgttggagaacggtaaagaggttacagacacttcctcctctattatgaaattagaatttattgcagatgataccatagaagaggttcggttcttcaaacgactactcttagcagagtgtgccatttcttcctcaccttcaatcctctcatcctgatcctccatttcttcttctattagaacccgtagaggtctccccaaacttgaaatacttgttccagttccaaaataccgcttgcggtctccggtgtttgaacttggattggacgaaatatttgtagaagcagagctgttgtatttactgaacagagaattaggattcgaattatagccatactgaaaactgctttttgtagtcgatgtcgttttggtatcgtcagctccagctgtttgctgagtcacttgaggccttagttcattagattctatcacattttcggccgtcgcgtcgctactggaggactcagcagcaaaagtttcatcagttgatgctgggttcagttcttgtaagtcttcttcgctcttttttctgctccaaggagttatcaatcgtctcatttgaggataagatagattagaacttgaccaaaataaaataatattaatgccatatcgttgaaattcgcggatatgcaaagaagcttttctatgtaagactgatgagagagtaccaaatatgctgaacagctacgttcatatttacgaggctcaatgtaatataccaaaattcatcggacttggtagtcaaagttgattttacatctaggtatggagtggcttgctacatttcttgagcggtcggccagtctaactaatcgagctagtccaacatctgaacaccatttgttcatcccatcatccattatttttgacaatgataatggtccagatctaccaggcctacaaaccttaaaccttcaggatgtcaatgcgccatttttcgacgagcagggtttcgtttatctttaagttgggatcaacgctgaacaatatcaaaccagaacctttcaaagtggtccaggtgactaaaccagtggggttatttacaaagcctgagattatcccacttgcacagttaaataaccacaagtcgccaagtaagacttccgagttttgggctgagtttaaatcactattcaataaagagaaaagagaagcaaagcgactagaactagaagaggaaatgagaaaaggggggttgtatgatatgcatacttatagagtcactaaaggcaaagtgtttctttctcccatctcgtattttaaagactcaaaatccctttacttccccaatttagtagtgactaatttgaaaaatgaaacatctcaattggctgatgtcttcaaaaataaggtaaccgttctgaaaatccatagtacgcaagaagggttcgacattaccaaagagtacttcagcatcaagaattcgactgacaactatctgacagaatctgggtatcaaatattgaatcaggagtttgataatgttcaaattgcagagctgaatcttatagaaaacggtttaaaaggtctgatctcaaagctctcccttggccatcttagaaaaataatcccggcctcaagacatgactcttacttttcagccaagagatcgttgttaccaatgaagttacgagaggatatatttttgagaaatttatatacagggtacgtttacgtggtcgaccaggagggcaagattaggtggctgggatgtggaaagcctactgaaaaggaccatgaaatgttatggaaggctgttaagggagtctcggctgaataaactagtcacacacagtatctattcatttctttctagagataaagggaagcacaaaatacaatgtccctttttatcttttcttgggcctcagacattttatcatgcaatgctgaatcaccaataattaatgcagcagatttcacctctctgcaaacttcatctaatctggtaataactctaacaattgtgccctcagcttcagatgagagtttcataatgtcactgaaagaagttccttttgcccattcgtagacgacgttaaccagattgaaacgttttgcttccaaaaatgactcttcttcagcactcaaggagacttgcttgtcttgaaatatctctaaaagatggctcacgatgtctctaatttttgcttttcccttttcaagtcggggagttaatgctggctcttcatcatcccgagttctaccttcataaacaaacgcactaagtaaagctacaatctcttctgggtcaaaatcagccaggaaattatccagcagtagttcggtcagagccagctcccatcctgagttaatttcacaggcaatccttcccttcagtacaacattcaagtgatcatcgacaaattcaagttcgtttagtacttttaatctttgttcgtaatctggtagtaaggtcatgttgtcgtctgaaacaagggacttcaaagttatcaacctcgatctcaagctatctaagtctttgatttgaatatagtgttctctcaacgaagggcactgaatgactggcgcattggcaatgatctttctatagtcttgtatctttttatagagatcattttgaggaatggtgagagatgcagaccaattgtactcttcaaacttcttgtaaaaatgaagcagttggagtatttgctcttcagctttctctattgattcaggctccattcgaatgattgatttcaacaaaacttgcaggacaaaccttgttacgtactgaactttgttgaagggaattgttgtaaatctgaaattacctttgaatttccatttcggaatcgtgttcttgataaaagatggtgactcggggatatatggaagtccagtgttgttctcctcacatctttctatgtcaaagacaagagccacgaacagagagtctgacatcttgatgtcatacaaaaaggcaggagccggaaaaccatcagcatccgtataaataaagagcatgcctcttctgaacctcttacggtgaagtggaatttccaaagaaagtcgaattaactcaccagtcagtttcgtgtaatcacatattgcagtcgaaaattcttttaatttggctggatcgcattcttgacatcccgcttggctgatctctgctatcttcttctgcagttctataatttctttctcattctctttcaagccgctttgggtagtattttcactgaatgaacgtttgatcatttcttccaccctcaaagcttcaattcttagaagatttaaaatcatgttatatgtcaacctgaattgagacacaagttttgtaggaacaccaagggtaatttgctggaatggtttggactccaagggttcattataagacataacaatgacagttccagtagtatccagaccacgtcgtccggctcttcctgacatttgcgtaaactcgccgggaagtaaatttctgaaccccgttccgtcatgcttccgtagttctgagaaaaccactgttctagttggaagatttaaccccattgcaaaagtttcagtggcaaatagcactttgattaaagtttttgcaaataaaatttcaatcacttccttcattattggcaataatccaccgtgatggacagcaatacctctacttaacatttcacgcatcttcataatttgaggaagctctctgtcttcttttttaagtcgagatactgctttgtcaatgaacatatgaatacgggatctttcggaaccagtacagaaattgacaccttgaagactatcagcgtactcttcacatctagctttggaaaacacaaagattaccgaaggaagaagatcatgggatcttaaatactgaacaagattagtccaagtctttttgtttgggccatctctttttgtaaatctggtacccacattggcactacctcctcttccacgagaggaaacagtagaactagaccctctaccgcctctagaagcacctctagcatttccacggccccctcggttaccggcctgggaacctgtgacctcctttttaggcttcactaaaacgtcactatgggcttgaaagttcttctccaaaaagttcctgttagaatcaacaactttaaaaagatcgctttttgcccacacaaaaatttccaaaggaataggtctttttggagtgcttataacgtaaacatctttctgcttagttcttccaacccatgaggcaaactccatggtgttaggcacagtagcagagagcatgacaattttgacatgttctggcagcataataataacttcttcccaaaccacccctctgtcaatgtcattaacataatgaacctcatcaaaaatgacaaattccacatcacggatcacgtctgctcctctgtacaacatggaccttaatatttcagttgtcataatcaagcagtttgcttcttggttgatctgaacgtcaccagtaatcaaaccgacatcaatatcttcaaaatcatgcttgaaatcacgaaatttttgattgctcagagctttgataggcgaagtataaattgcctttgtcatatttatattggccatggcaatcacatattctgcaacaactgttttcccagcagatgtgtgcgcagcaacgaaaactgaatcacctttctcaagatgatagattgcttcttgttgaaatgtgtcaagttcaaatggccaagtccgtgccatgtttggtaccagctcgtggaaattttctaatttgtgatccaaatccacaaggtgggcccattgccgagcggcttgcggccgttctgttttcggcctcttgctaaagctaatatcagaaggtaataaggcatcgatttcatcaccttcttggatggcatcttcctcaagtgtctcggggtctagtaattcgacatcgccggatggtatttgattctccaaagtttcctcattagactctggtaacttagataactcatcaaccaattctgtatcacccgccttctctaattggagacctctctcaaatcccaaggggatatcgaaaaggccctgatcatctctatgcaataggttgttgatagactctgtgtctttcactgctttgctaactaagccaccaggcaggaaaggcaaattagtagtttgtcctcgtatcgaagatccattttccgctggctttctatgaagactgaaagagttactactagttaggttatctcctgaaagatctaaggcctcttcatatccaacaatttttccctcgataccctttctcttgaattttattttggttctatccataaacggtggtatctttaccagtgcctgataaaacttgagcttctgatctgattcatctggtattattaggaattccttcaacaaatccggaggaatctggtcagatggagttaagtactgttttttaagatcgttaatttcctcttcttccgtaactgacggaaactgaaactttgtttgagtatcaggaggaagatcaaccttattcaaagatagatcatgtatctcctgtagtatatcatctatttccctcatgagtatctgtgtagagatgaggaattcaatgaatggtcaacatcgatcaagatagtttcgctagagttttaagagtttgagcgaagttcttttgaatacaatctaaaaaatgaagcaagtttgacgtacaaagtttttgaaacgaggcccaacgcagaattaaaaaaggatactgaagaatagtccaaatagtccttgtgatgcaatctgcataatttcctgccaactacatcagctccgtataaggcttttgcaaacagtcacgttatgtagcagcagagagggcccttcttatgacaaacccaccatcgtctccatagtagtctacaacaaacagtttgttctgatcatagtatcctgccaaaattcggaacaatattgctatataatgaacatttttgggcttgcttttgattttcacagaagtagtacacggtattaggccaaccattgacaacacccaagtcactccatttagcagcaaaacttgagagacgccgacataaccatccaacttatgtgagagcactaggatcaaactgaagatagaaacgaacaatggagttaacaataaagccaatgctaaatagggttggctactgtgtagaaactctcgttgtagttttttatcgaccaacgaatattcgtctatttgtgttttagaactgtcaataatatcttccaaagaggagttgcaataagagtaaatagaaaatctgggaaaaatttgcacatctttcaaaggaagaatatttgagttgttgaaattgtcaagttttttcaaagactccgtccatttccgtttcatagccccaccacaaattgaattagatagctgtgatcctgatgataaaggccttttctttgtattcagatccactatgtaagtgaagttcccacggtttgaaggttcttttattacgatctcagaatatgaaccttgagacacagtttcaacttgcaagaaagaatcatcttctagataaatgtccttgatactggaggtattattgcttgatctactactggaaatcacagtgtagtcatcatcgtctttctgattaatactcatgttcataagaagagtaacacaaatcgcgtttagtgacttcattatctggagtacctctttgcaaagtcttcgtagaaggcgatcatttctggggttatatttagactcagatcgtcaagtgacttttgaaagtgtctcaattccactttttcggcattagtgtcttccatgacagcggctaaaccagattcctgacataagagaacaacttcagcacctgaacatccctcagtcagctcagataaaagagttaatagcttgccccgctcgtcttcattaccccccagcccaaaattttttgtggaattgtccaaaatttgatatctggctgcagcatcagggggaggcacgtatatatgtctatctaacctcccaggacgaagcaatgctgggtcgatagcatctggtctattagtagccccaagaatcaccactcctttcagttcttcgactccatcaatctcattcaaaagggaagtcaaaacgttgttggaagctgtcgtattattgttgtcatctctcgtattggaaagggcatcgatctcatcaaaaaatattattgagggtgcagcagcccttgctttgcggaacacttccctgattgctctttcagactctccgacatatttgttgaatatctctggtcccttcactgcaaggaaattgagaccggactcagaagccagcgctttcgcagttaaagtttttgaacaccctggaggtccgtacagaagtaaaccttttggagcagaaactcccagtcgttgaaagctttcagcagctatcagaggtagttcaaccatttctttcagtttctgtttcacgacctcttgaccaccaatatctgtccaggaaatttttggggtctctagaaagatctctctcattgcactgggcctgatgtcaagcatagcattctccacatctgagagccctattttcaaagaatccaaattatgaaaatccagtccccttttgattgctttcattactgtttctctacaaagagccaccaaatctgcacccacatatccgtgagtctttgatgctatttctttgatgtcctgctcagaaatctcgtgcctgcgcattttcttaaattgtaaattcaaaatatcatatctagcggcaacgtcaggtatgcccacttcaacctcttgatcaaagcgtccaggtctccttaaagcttgatcaattgcgttaggtctgttggtggctccaactaagaccactcttccagcgttccccatcccatccatgagagtcagcaacgaagcaacaattctactttcagtctctcctgcatcatcactgtttcggctgggagcaagagcatctatttcatcgatgaaaattatggaaggttggtacaattctgcctccctaaacatgtcccgaatagtgctctcagtctcgcccaaatactttgaaataactgatggtccatttatagtcaatacatgagcattttcttcattggcaacggctcgtaagagcattgttttcccggtacccggaggaccatgtagtaggatacccctaggaggagttataccgaagttggtaaacaaatctggttggtgcaaaggcagagatacagatgtttttagtagttcgatttgtttttggagaccaccaatttgagaatagtcaactaatgcagaagggttgtatctggagaaaatatcatctgaaatacttatcttggttgatttactgtgaaaaagagatgctgcgatggaactgggagtactttggccgtctaaattcaaagcactaatattcggaagaagatcggtgtttatttcggttataaaaacattgatctccttgccatcggtatcagttacaccagaagggaaggaaaagcctggctgaagaagactgaactgatccaagattccaggtaagcttgactggagcgcttcctttagtgagtcagttaaattatgggctccaacagtgacagtttcagcatacttgggttgtttgctaatctttagtagcgatactctttcacccaacatcacgctacagagttttctaagcggtgtagtcatttgaattatatcgcttctgtcctcaagcaaatcctcaacatcttgctcctctacaataccgacaacacccgtagtggaccctggtctggttatttttacaaatgaacccacagccagaggtaagttctctatgacctctggatgtaagagaatggtagctaagtctttgatggaatagtcatctgccggccttaccatgaactcttttggcggtttatacttgacttcctttttggaagttggctctttctttttagcagacttagacgacattgtgtaatatttgcactggttgtccagtttgtagtaaatgaatttttttgggttgatgtgaaagagatgacttagcgattacggatattttttaatttactatctatttatttcctttaaacccagtcgaaaaaagctgaagctgagtatctattggataagcgctaagacaggagatgttcccattagctaacagatggagatcgctgaggggatataagcatcttgcactggataatgcttcatttgctttcaaaataaaaatgcgaaagattagacttccagatagacttagtaactatccacaaatagacatactgtcggatcaacacccccgggaaataatacgagggcatcaagaagaaacaaatgttatcgaaaagtataagttgaatctggaattcaggaaatttttggaacccagtttggagagtgtccgggggttcttaggggaaaagtattgtttaaacgatagtcagttgattgcaattatttttcctctttctaactttgatattcagctaagattgaaggatacacagcagcataatttggtaatggcttcagccagcatacaagaattcggtagaaagttgatgaaaaagcttacgatgaccaccattttgaagaaccactcattaacctcatgtagtgatgccatgggaagtctcgatttcggtgttttacaagaaagtattactaagtcattgactcatacagggcctctcattaaagaattcatggaacttcatgggattgaagcaagaacacagagatatcgaacaggaaagagatcgcatgtgcgtagtagtgttgcggcactgaacacaatgatagggatgatacattatcaatacggagaaatgcaaagcacagagtttgtggaaaatagaatactgaatggtgaaagaggaattttgaacttgttagcagaaaggatgatatccaacaagtgaccacgggcaaaattctccgccccgtgtagggacagaaagacgccttctggtgggagggacatataaagttaccctgggaattcgagagaaaaacattctcccttcttagccaaaagtgttgactgttcttacaaaagtcctctgctaaaatggctccgaggttgaatcagatgtttagtcttgctttagttgcaggtgttggtgtgtatactggggttaagtttttcgaaccaatggtgatcgaacaactagaaaaggatggaaatttaaggaaggatattgctgtccctaagtatgatagtgaaggggaacttgttggccctgacggactaactgattctcaaagatgggaagtggttagaaaagagaacaatctaccctctctagctgatataactaaaagggaagaaaagaacagtactaatcctgatgataagaaagcagcttgaatggacttctaacgggtgagatatccctttgaacattattacttgtatatacagactcaaaacgattaatgaaacggtaaaaactcaactgagtcactagtatttataggccattattctctttgtaccgctagatctaactcggctctatccatcatgttctgttctcgtttcagccaaagctaaaaaaaaaaaaaaaaaaaaattcaaaaacctgcatttgaattcacgtattgtatctaatggcaaagattaaacaaagatctaggattgctaaacttagaaacaaagctgcctaccaaaagaagaagggggatgaagcagaaggagcaagctcggtggaccaggttttcccattgatagagagattacaatcaagcactgacctacatgaaagagtgataacagtcagtacaatctctatactttgtaatgatacagctttacgcaagtcttttctaaaagaaaaactggttaagcttctgctagaggaatcgttgaaaggagctgacaatcaacttttttcgcaggtgtttatccttctgaaaattttgatcgaagaggaaggatatgatattggcgcctatgtctggagattaaatatttggaacatcatattaaaagcttttgaagctgcttatacagaaattaaatccaatgatcaatctcaaattaatcagtccaccgaagctgcacaactaatggaaatcgccttggatttggtgttaagtctattggacgctgataatgcagacaactcattctctggaaaggtatactcccaaatagttgaagataatctcactcagcatgtgaccaacttgttaaacatggatcatgctcctgcaaatgtttatcgggctggtcttggttatctcttcaatctgtgtaattacagtgctgagtttgttaagggcttgaagaaagatgaagaggttcagtttgccattctggagcacaaggccactgatgaattgagcaagctgtacttggaaggattgaagtttcatttctttgaaattgaaagaaaacagaatatcgaccaatttttggcaaatgcttacaaatatattttggagataatcacaccaattgatgttcagggacaattgacagcattaggatcgtcagggtcgagcatacattcatccgaagcacgtattcagttgctgtctatcgacgtcggcctcgatttgttggccacattggtggagtacaatgggacgcaggcagaattggatgaatatgaacgtatcgaagtgaacccagaattgcttgagttttatgaagatagtcttggaaagactgttttggagctatggaaattcagcaattttcaacatagagtttctagggtattgaacaacctcttttggctcatgcttacaaacaagacgccattgaatgaggtctggtatcagtcgcaggccaacttcttgagggaagaattagttcccaaactgttccatattgttgagtacggaaactttgatgacttcgaactctttgtggaggacaaactggattatttgaacctggcatgggttttactaaagtcacaaaaatcagtgggctacttttctttggatgatttgattggccttttttcccttccaaaattggcatcattatacgaattttccatgaaactactaataaacaattataaacaagattctgaattcttgcttagcccctatactatccaacagttttttacgtctctagtaggtatcaacacagaactagcattaaacatcagctcttctaactcatacatcgatgtcattgatattataagccaattccatatccagttgttgggtacgtctctcatgatattgaaccctaaggtgcgatttgaatccaaagtcattactgagcaatctaattattcggcaaagaaagtgaaagacaatttcggaacttcattagaaactatttgtatcgaaaccataaactctttctttgacatctttagtgatgccagcttcagttacgaccaaccaatatttgttctcaaaaatgtaggtctccaactgcaagacttcctcaagtcttatcgcacagtttacaagagcatcgataagaacaagtttaacggcctcaaaatcaaaagtgaagaaaccttaacaaatttggagagattcatccaatacaaaaaatctgagagtggataataaaagtggatagtttttagtaatattagtacatgtattattattggggaatgtattcatttggagtacttcaaggcctgctccttcaccttcttttcgtatgttggtctatcttttccaaacgctctccatgcaggttcttgtgcaggggagtctgggtttgggttgttaaggagttcttgtattcccaggacaatctgctttagggttatggcaggtctccagtcttcttcttcattcaatatagatagacaaattgtgcctgatggataaacgttagggtggtagaagccagcaggaaacttgattttgggtggctttgatggatagtcctctggaaatgttattgtgattgggtatactgcattttcccagatggtactggcctttccaggaatacctgctgtccaatacatcaaattcagtgatccatcaggcgattttgaaggttttgcaaaaaacccgaaagggtgatcttttctccattgttttctgaaagttagctacaaatgtttcacgaacccaaattgtgaaaatttacttacctttcttcttgaagtcgacttttgcacaagctactcatggtttgaaagtggcagagttgttgttgaggcgcgagttgaataattgtttttcgcaaatctcgtcgaccgaaggtggaagttactcagtctccgcctagctttttctcaatttgggagacggttttttttttttttttcagtgtcaggctcttattctcttactccagctttcgcgcatatcgtcttgtgcttttggtgataactctctttcttaaacacactttcactaagttgggcaaatttgacccagaattataaaaggctgcacaacgaactgtctccgaaatatgagtagcgaggacgaactagatgatctgctggatgagtttcaagatgagatgctcagcagggagcccgggtccgcaatggcagagaacacccaggaggcggcttcaagctccgacttgaaagatcttagtgaacaagagatagagcagaaaatacaagagaactttgagaatatgctaagcgaaatggctagtgtagatcctaaaacctcctctgaactgcagaatttcataaaagatcttgaaggatctgccactccatcatcaacgaaagacaagaaggatttcaaatcggtaatatcagaaactgtcaataagatcagagatggaggagataaaattgatgaacagattaaaagtgaacagccagacgaacttttatcgcagcttttaaagaatttggatatcggagatctgggagacttgcttaacgatgaaggtggagatggaaatgacaacataggcaagatgctagtggaaatgttagaccagctttcttcaaaaaagatattatacgagccaataaaggagctgtacgataagtatcctgcttggctggaagctcataaaactgatgaaaaaatctccaaggaagagttttctaattatcagaatcaatatagtattgtgacgctcatcgtggagaggtttgacaaacaaaactatgatgacaacaatactgaagacaaggaattcatctctacgaagttagaagagttgcaagagctgggcatgccgcccacagagcttgcgaatcaggatctaatgaagataccagggtttggcgatggcgatggcggggtgggaggtctagatcaattagatggattacaaggcctgcaggaccaggacctcccggaggatttgagcaaggaattggatgagacttgtaaacagcagtgaccagtaatcatcctgcttgtgcactgttgataggaaacagatcgtaaagccatgtaatcttcttccaacggttagcctatatcaagaaatcacgtgcaaactttctcatcaaccatgttcagccgttgaaatatgatatacttgaaaggtcatgatttcgcgcggggagtactgtaagcgaatcacattcaggtagatcctgattattctgacgttaacagtctggcatctgatgacttttttttcgttctccaccttggggtttgatttaagtttggccaaggtgtatatccgccggtcgtaccataattgccgccaaagcagctcctactaatctaacaaaccctcgtaggtgtcccgaaacacacttatctgtgactgaagcacacaatcgacgtagtcttatattcttattacacaaacactatttaagctacttttctttgagcctatcccgcctgtctgtttctctgttttttgtttttttactcggatttttttcagaagtctaaattttcgcgcctgcaccagaaaaaccctcagtgtttcttcgactccgtcattttcttcaccaaaaaactccagttcttacctgaatatcatcgttcaaccatggagtttgtcgcccgtcagtccatgaatgcctgtccctttgtcaggtcaacttctacccaccatttgaagaagttggcagcaaacagttctctagctgctactgctagtcattgtcccgtggttggccctgctctccaacagcagagatactactctcaaccttccaagccagcccaagcccaaacctccgacattgctactgggatcaagaaggatgtttctccgatccgtatggactctaatgaaaccgcctttgattacaatggaatgtatgagtctgatcttgcgaataaacgtaaagataactcgtatcgttatttcaataacatcaaccgtctagccaaggagtttcccaaggcacatcgccagaccgaagatgacaaggtgaccgtctggtgctctaacgactacttaggaatgggtaggcatcctgagattatcaaaaccatgaaggctaccatggacaagtacggttccggagcaggaggaactaggaacattgcaggtcataaccacgccgctatcaatttggaaagcgagttggcttgcttgaacaagaaggaagcggctctggtgttttcatcatgtttcatagctaacgatgcaatcatctcgttgttgggacaaaaaatcaaaaatttggtcattttctctgaccagtcgaatcatgcttccatgatattgggtgtgcgtaactccaaagcgaagaagcacatcttcaagcacaacaatttgaaggatctggagtcgcagttagctcagtaccccaagtcgactcctaaactgatcgccttcgagtcagtttactctatgtgtggatctgtggctcccattgagaagatttgcgatttggctaaaaggtacggtgccctcaccttcttggatgaagttcatgctgttggaatgtatggtcctcatggacagggtgtagctgagcatttggactttgatctgcatttacagtctggaatcgccagtcctagcgtggtggacaaacgcaccatattggatcgtgtcgacatgattactggtacttgcggaaagtcatttggtactgttggaggttacgttgctggtagtgccaacctaattgattggttaagatcctatgcgccaggtttcattttcactaccacacttcctcctgctatcatggctggtacagccacttctgttcgtattgttagggccgacattgaggcccgtatcaagcaacagcttaatactcgctacgtcaaagactcatttgaaaaccttggtattccagtcattccaaacccaagtcacattgttcctgttctagttggaaatgctgcagatgccaagaaggcatccgatatgttaatgaacaaacaccgtatttatgttcaagctattaactaccctactgtgcctgtcggtgaagaacgactaaggattactcctactccaggtcatggaaaggagatttgtgaccagctgatcagcgctgtcgacgatgtttttactgagcttaatttaccaagaatcaacaaatggcagtcccaaggtggtcattgcggtgttggtgatgctaattacgtaccagaacccaatctgtggactcaggaccagctcagcttgacaaaccaagacttgcactccaatgtgcacaacccagtgattgagcagatcgaaacctcatcaggagtcagattgtagtatggaaaactttgtattctctatgtacttaaacactggtttatttttttattgatcgttatattgaacagtttacactggaacatcttcagggtcgatgtccttaatccagtgttgaccaaagattgggatcttctcgaagaaagtcttttggaacaaaggccagttttcagtgaaagtgaagacggcaaacagaccggcacctccccagaaagccaaaattggaaaagtagttttaatttgggttggagtcaatccagcaattttcttgacggtggtatacttgggacctttaacgtactgaaatgttagaacatgtttgtaaaaatcaaatcatcactgcagaaacggtttgtgtgcctgcaccggagggttatcataatgccacttacgttgaccattttggaggtgtttgactaagttcaaatatgaatctctaagaaaactaataatcaatatggtgcgagcattgattggttggacagctagtttggagaagtacacgacttagatgaatctgcaataaggaatagtccaatctgattatgtaagctctcctttttggttttcatttccatcagctcaagcttatcatagctcaggtcccctccagcttatgatggaataggccattattttttgccctaaaaagtggaagtccacaagaagaaatacaaatactcaaaattcaaaagtcttcctttgagtggatgcaattttacgtagtttactgtatgacgtaactaatgaacccttccgacacaaagattgaggtgcctcacttaacgtcattcttctatacccacgagtgcaactgactaggtcttattttgttaattgcctcagtttctccgaaatgagtggcaatccttttctgttctctccttcaaattttgacttttctggtttggatcattatagatccactgataaagatcacttagctctagatgttctcgattatgacaaaaatcacttcttctccagaaactcccccagtttgaaatctcgtattcacttttatcgacataaattgaccactagaaagcaaattggacttttcagcggcagactgaagctttttgtgcttgctctctttgtgttgatcacattttctgcaatccacattccaatccctttctctttggatattctaggttcccatgtcaaatacctgcccttacgagagaaagtcgatccggaagaggcactccatctgcacggactggatctctcggtagcagagctaccttttttcaatgatgacatgatgtctgaatttaactacgatcctagactacccaccgctttgattttgaagttagtgttagatcatataagtgtgcgtaatggaacgtttgatgctaagtttaaggtcccctttaactggaaactttgggtggatttgcattcaaggttagttccatctaatagttggtataatcgatttcgattaccctcaggtcgtttcgaaacatgcgatgaatttaagaggtttttcggaatcactaagaatcactttggaacagaccttgataattgcgttgatatcgagtatgatactccggaaggttatccaaagttcaaagttttgcatgcggaagataaagctcttccttatgaagcacgtatcatttatggtgcttcttacctttaccacgaagcacagaatcctaaaaggttgatatttttaggattgggcaagtccaatgagtctttgatcttaccagttgaggcaaatgacagttccaacttaatgcaattcaaccacgaatatgcaagaagctttaacgatcaacctttcgtttctcttgaggaacttgtcaagaaggtttcactgaccttgaatttgaatagtgataaggtgctaccaatcaatgaactggacgttatcaaagacaccccgcgcttaatgaatcacaacaaccagggactgagcatagacaagagctcatttcaatgggatctggaaagggaattacagttgttagaacatagaaccagtcaagttaatgacgtggaaggccttgatgcgggtatttattcaacaattcaatgtgaaatgcgctctatgtacgatttttcaaaatacttccatgaatcaaaagtctctggtaaatatcttccttctggagagcactatgactggcgattttttaatggtttttacctttctcagcaggagaatctagctgtcctgcacaggttaggaagagcatggctacgcttttctcgtgctgctggtttacatacatggattgctcacgggacactgttgggttggtattggaatggtctgattctgccgtgggatcaggatcttgatgttcaaatgactgtacaatcattgtatctgttgggaaggaatttcaacagctctcttgtaactgatgttagtattgaagatggctacagctcagcattgggacattactatattgacgttggatcctccttctttgttagggataaactaaatggtaacaatgctatagatgcacgtttcgttgatactgagaccgggttgtatgttgatataactgcattggcttttacagatcacttaaaactaaaactcactaccaaagagaaagttgagctacagaaggttatggatccaaatgtaaaggaaaaattgcagtggatcaaaaataaatattcaacggccacgctaccgggtgtgatagaaacagataggaataaagtatctgatgcgctagagaagcaatttcatgatttcaagttcgacaattttgtcaacaaagagttgtttcactgtcgaaataaccatttctacaaatatggagaggttggccgattacggagcactatgtttgagggcgttcctgcccttataccatttgaatttgagtccatactgaaacgagaatatcctaaaggtctaactttgaagcatttctccaatcatttttgggatccagtgaaccgattgtgggtaccagaaaagaagaaaaaaattagacacatagagttttcacttacgaaggaagttacagaaagccacaagaaagaacttgcacagatccatgggaacgaaacgggtataacctccgacttcgcatattctcctttcagaatagatccctggctgtctcgatacaggaaaaaaatgactaggagccaataattatgcatatactgaaacaacagaaggaactacagtaaattcataaaaagcttaattcttactttcatctcggcactgtaaattaactcaagttggggcaacattgtgtgtatactcttactggcatcttttcatctgaagtcatcttctactactcttctcttctgtatgacgtaatcagctcggcagctgtggcatcgaacaaaaaaatgaacagccatccgtcatatctcatgactgactgagcaagaactaagtcaacaggaaacctaaaataagctttccatttcttttgcgctgaagccaaccactccccacacagttgatgagtggacgcaaaaccagctcctataccttgacagaagagtcgccggaatcaacctcaacaattcaggatatacgagaggaagaccaagttgctccagggccccagcaagaagcacctaaacagtcacatatccaaaaatggttaagcgatcatcctaaagtatacgcagttttatcttggatatggaaattttggttgaaacagtggtttctcatatgtttgggccctgcggttgctctagctcatgcatacccaaattttgccagacatgatggaaccattaggtcagagtatactatcaactacggagccgtagctatcatattcttcatctctggtcttactatgaaaaccaaagactttttgaagaactttggacactggagagcccatttcacagtgttaagctgctcgtttctacttacttcttctatcatttacggtatagcgtgcggtataagagctgctcatgattccaatatcgatgactggatgttagcaggacttattgttaccgcatgttgtccaaccactgtgagtagtaacgttgtcatgacagaacaagctcatggtaatgttttcttgagtatttgcgaagttattattggcaatgttttagggggtttcatcacacctgctctggtgcaaatgtatctgacaggtagctgggattttgccaatcctgcacttgatagttcggttaccgatgtttatcgaaacgtgatgcaacaggtaggttgtgctgtgtttgtgcctgtctttgtgggccaagtcctgcagaatctctttcctgcaaaagtcaaatggtgtgcagttaaattcagacttagcaaagttggcacattcatgttattgttaattatgtgggcctctttttcgacagcattctatcaagatgcatttacctcagtcccaagtgcatcgattatatttctttgttttttcaacttgggtatctatctatttttcactgtgatttgctacctctattctcggccaagatttctcctttcaattttccatgacgaaccgactcctcaacattcgaaatattaccgatggggctataagacctttagacctttttactacaatagacctgacacagtttctgttatgctttgtggagctgccaagactgctgctttgggtgtttctctggttacctctcaatatggagaggatagcccacatttaggacagttacttgttcctctagtcctgtatcaatctgaacaggttgctgccgctcaggtactagtgccatttatgaagagatggattcattctgaccccgagtacgttgataaagatggcaatatgccaaacaaatacccacaaggtaatgacgaagaagtatccaccagtggttccaagtaaacttttatactatacgacaatacattcaggagatcacttctcaaattctaatttattatatttaacacacttagaaaactacatcccagatgcccaaaggacctctttccaaataatcatccttgttcaagtaggttcctccaccattgttactattatgattgtggtggtggccaaacacttgtttagcaaaaatttgagctcccagaaaagagttatcttcatgtcctatgtccttccattccgtaaagtattcaggaaatttgacgagtttcacatgttgtggtacttgtacaagtttttcactgcgctggttactgctatcagcgtccgtctcatttctgaaaactgcatcagccttagatctcttgcttactttctgttttatggcttccgagctaatgggatattttgcaccatatgtgttcaagaggtataccagaaacgattccttaaggccttttatcttccaggtatttccactaagaattaaattgtcgtagcactcttgtcttttagtggaatcaatgatgttagatagacattcaaacacagtatcacctaaagcccttactaactcatcgcagccttgaaatcgttcctttcctattgttaattcggtgccatcgctggtcacaaagctattcgtttccagtacagagttaggtttgacttcagattgtttggatgttttctctttttttcccttaacgtcttccaaaatttcttttgtagatttctcactggtgacaatagcagcgatatctaagataccgtcatcctcagggttttttttggtatcgtcttctaagccaataccttctagtccaaaaaaggaatttttagcgtcttcctcggataacgattcaaagatagatgatcgttttaaattttcaatttgtgagtcattaagattaggtaatagttgtttgagacgcttgttaatggtggaagaaccagtcggcacagttctggaatagcctttgatgacctgaaaattgagaatgggtgatacgtcaaacttgtctccacctaaatcaattacacaacaattagggatggaaccatgagcaaaagctgatgcaagaggtagcggtatgatttgcaaagctgtcaactgtaaagtctcaaagacatatttcgtgatgtattcaatattcaagttgctccaacgaattgagctcaccaatagtaatgccacattattagtcaacatcagtggattagcgttaataagggatcttaaaataagtcttaataagaaattgaaagcggcaacatctacaatttctccattaactatagggtaaatagccaatgattcatctgacgacttggattgaaacttgtttggattggacgggtctcggtacactttggttggaatagaatacttggggggtgacaaagactcctccagtccaagtcgaaacaatgtgttgtacgatcctggctgtattatgaggaagttgtcttcgttataaggagccatcgttctactagcgtgaagcttttgttgtataaaggatgaagggctgaattatccaagtcgcgctctcaagcagatgttgggaggtattctgattcattctggggatggttaagttagcttggcctacaagataaattcattcaaaataatcatgctttgaaactaaattcacgagtaacaagtgaaccaagttgcctgcacctacgaggatgttgttttgaactcagtcatgaaccattgagtactgactccaagatcgtaactgctccgtccttggaagactgactccatacatttgatgaaattcagcccggttgtcatgcttataaaaaatctctacttaagatctctcatctgtacagacagagactttgttagcactcattgacgactctctgttttctgccgttctgcctttctgtttgaccaggactatgatccaaagaattcttgggttattccaaatacgtcatattgattattacccttttaggtaataatatggaaattgaaaaatgaaatggctggtacaacctatcctcctctttagatcacattctcttccagatcaacaattgagctataactcatggcgaggcttagtatagcaggtaacaggttgaatagattaggttctatttcgcctaaaacgcctagatcagcagtatccaattctgcctccgggtcagctagaacccacacaggaacaccaagaggtaataagactccaatacggaatgtaataacaagtagcacaggaattagtagaaatcaacccggagaccctctacccattgcaaagaaatacagatacaaacctggaacgttagctttaagagagattaaaagatatcaaaaatccacagacttgctcttgcgtaagctaccctttgctcgactagtgagggaaatagcccaggagaacttcattcaaggagaaatgtttcaatggcaaagcgtggccatcttagctttacaagaagcggccgaagccttcttggtaggcttactggaagatacaaatctgtgcgccctccacgcaaaaagagtcaccataatgcagaaagacatccaactagcaagaaggataagaggtgatgggatctaagtggggtgggccactgtgtaacaataatcattctggacgaatgtgacggagttttgaaaactgggtaaaaaatacatatattaggaaattaattcaatcgatatgaatcctcaagatttgttgacatctgatccttgcgagaatccgctgaatgttctcgtcaaatctggctcgggggccttggaagcagcaggcttctgggtgacaggtgtagatgcaggagcagccgcagtggtggttgcagttggacttgtagaagcaggttcaacaccagcttttggatgtctgttgaacttaggagctggcttcatgtaactttcaccattcatgaagtcgataaacttcttcttaaatggcttctttgtagtctgttttgcttttgaatcatcagccgtctgggcaggaggagcaacttgtgcggcctctggagctggcttcagggaaggctccaatgctgatttgggagaaattttggggatcgaccataactttttctttgacgttgacttagaagaggtcactgaagctttgggcgattcgggtttcttttgttcaacagactcctcaacgaaaggctccggctcaaacttgaacttggagtggtcgaatggggtctccacagaaactgtatccttgatatcctcctgtaaatgctctggaagaattgagttcacagctttatcctcttgcaggcccttgagctttgcatcttgaagttctgcgacagtgtcatcgtgttttttgataagctggtctcgttcagcctccaacttttgatgttgggccaataatgtagcattctgagcagtgagtgaggcaaactgtgtctcatgattcttcttgaaagcttcggtatctttcgcaacttgttcggccttcttcttggtagcctccaacttcgtccttgctgcattaatctgctcatccaggtcactcagcatggtttctgaattttccaaaacattattgtgcccttcagcacgagtgtgatgctcattataactagcttctaactcttcacgctctgcaattagttcattcaaaataccagtttctctttccaggcctgcgaccaagggagccacttcctcgtctcgttcagcttgaagtgaggttaattcttcgtctctggcctgttttctttgagctgcttcagtgctgatcttttcttctaggttggtcttctctaaaacaagagcctctctgatcttttgatcttcctgtacactttcatcaagttcattctgtttgccatccagctctcgttgcttgagagcaatgagatcaaactgcttggatttctccccttccttgtcagcatctaacttttctctacggacctgtttgtcgatttccttgttttgtttttcctcaagtttctgcttgcgaagctcctcttcatattgaagcttgcgttgcttttgttcaagcttcttttgcgcattctgttcatcttgttgacgttgcaatgcagctttactatcaatctgctgaactaccggaccaaccagctgttgggccataacattcaactcaactggatccatgaagagacctccaccaagatcaattttcccatcattcacacgtctcttttctgagttctgttgtgcaattgccaacgccttcagattattctccctattattgaataaattctctggggtggcgtcggtgtccaaacgcctcaacgttgattcagcgttagctaatgccttttgtaataccttcgcatctacaagtgtattcttggacaacgtttcacgttcacgtgcagcgtagtctagatcaacattaagctttccagaagctgaagcccctgaagctgcaaacgaactggagttcattgtgtctgagcgagtagctaaaccagctcgaggatctctgacattaggatgaagtctagtgttcagtgacttgcgagcagaatcttcagctgcagagtttatctttgaaatattcacgtcaccattggccgtgttgaacttcgaacccgtgactaatccagaccgtgaatttagcgcatccggattagttcgatagtcaatagcctttgtggccgactcgtttgaacgtgcagtaatagtagcgatattaagattggagaattgcttcttacctgatcttacatcgtcccaatcatattgatcacgaagggaggaacgtgctacggaagcagtatccttcttcaaaacatatgctgcagcatcttcactctcttcaaagtcagagaactcgttgctaacttctgaacgagctttatcgacagggaaacgggcgctaatagccgcatactctgcctcggttgaaatattctccctcttccaggccttgggggcagtgtctgtccttgcaataagagctgcggttgccgcatcctcagataattgtctctggtagggtttgacggataggtcggcagaagtggctagcagagctgccgagtcggatgctgaatggtcgacacctaacgaaaccgcacctggtttgttgtagacaccgtattttagttttgcccggtaaatagcttcttcgctcagtggctttccatctgtttgatagacagaagatctcgaggtattgattgaagccattgcgatgatttggtcaatcaaacactataaagcaaaggatagataaaagagaaccaagaaaatatagaattagacaggtcatcagaataatcactgcaccaccacaacagtaggggcagcaactatgagatgttgcctaatcaggccatagtgtaaagaaactcctaattaggaaagaacctcatccatacttttgaaactttgaaagcttcaagtcacgtgctacccagaatccaacatcaagcattcttttggtcctgcggctcgtgagtccaacaaagaaatgtgctatgttgagcgtcgcgcatatctattcatgactcagtcaggctggagggtgatgcaattgcgacttcggaagtaaaacgtcattattgttgtgtcgtacacacagactattcaaattccgaaaagattattgaaaaatatcacgtgaataccccagttgtgtaaaagcggtagtatctactacctcttcacgtgacttaattgcttcttgaatcaacataacggctgtaaatgtgatcatcaggaatgaaaatgaaaaaaaaaattctgacactaaacggaaggacgcgggaggcactaaactgaatctaacaagactacgaatagagctatttcaaacatgaaaaaagactgaatggccctataattcgcctgtatatgtaggtctctcctccacctttcagcagatcaaaaagataaaccataaacggccaaaatgtgcgcgagagaacaataggaatcgtacacaactaaattgagtaaatgtgggcctgggcttatttttcctcgcaatacatatatatatacactactttatattacctcatatataagaattcccccggtagcctgttccagcagtttgaattaatttcgattgtcaattggttgaatcagtttgattatttgggtttgtttgcgattaactagatgtctacaacaaaaccaatgcaggtgttagccccggaccttactgagacaccaaagacatattcgttaggtgtccatttggggaaaggcaaggacaaactccaggatccgacagaactctactcgatgatcctagatggaatggatcactcacagctcaattcttttattaacgatcagttgaacttgggatcattgcgcttgccggcgaatcctcctgctgcaagtggtgctaaacggggtgcaaatgtcagttctatcaacatggatgatttacaaacgtttgatttcaactttgattacgaacgggattcatcgccgctagaattgaacatggattctcaatctttgatgttttcctctccagagaaagctccctgtggctccttgccgtctcagcatcagcctcactctcaggtcgcagccgcacagggaactaccatcaatccaaggcagttatccacatcttctgccagtagctttgtatcttcggattttgatgttgattcactcctggcagacgagtacgctgagaaactagaatatggagccatatcatctgcctcatcttccatctgttcgaattctgttcttcctagccagggcgtaacttcgcaacatagctctcctatagaacagagacctcgtgtgggaaattccaaacgcttgagtgatttttggatgcaggacgaagctgtcactgccatttccacctggctcaaagctgaaataccttcctccttggctacgccggctcctacagtcacacaaataagtagtcccagccttagcaccccagagccaaggaagaaagaaacaaaacaaagaaagagggcaaagtccatagacacgaatgagcgatctgaacaagtagcagcttctaattcagatgatgaaaagcaattccgctgcacggattgcagtagacgcttccgcagatcagaacacctgaaacgacatcataggtctgttcattctaacgaaaggccgttccattgtgctcactgtgataaacggttctcaagaagcgacaacttgtcgcagcatctacgtactcaccgtaagcagtgaggaattgggaaggttttatattgggtttttgttacatagttttgggttggttttattacatttcttttacgttacactgtggtggtttgttggctgtatcaaacggagacttctccatgatctctgttctgtagtatcttgctcattttttctctcttaatactgcttgttggaagtcgtacattatatcgtaccgtctaccagtttgcccagtcgctctctcaatggaggttgtgattcgctctccatcaatgatagtagcgtattcagatgtgccagtttcgcatctatggagtttattgtttcactggagttttgagcttcttcttcgaaatcccctaaaagttgttgcgtctgcgtttccaacaagttgacctgcgaccgcaagttatctctcaattctctccgctcttgtatagtttgactttgaataagtttctcgggtgttaagtcctctagatttagagattcctctacagcaccagtattctttctcttttgcgcttgccatattaacttatctagttcatccaatttactctcaacatttctttctttgaatatcttatcaaactcagtcactgcgctggtctcccagaatgttatcatttgctccctggctacttgaaggtgccgtttacctacatcgtttgcgcttatctgaggatagcacatgtcaaatttcgtagagttcaattcttgagttgtgttagctagtgccttgtgaagaaccctctccaagattttgcttcggaacttgggaggattttggtcatcctctgtagtattcacttccctagggctcatttaatatcaacaaaattgtaatgtttatgtaatgcaacgttatgtaaatagtctccaccgccccaatatacctcttagggcttagtattttcattaattttttttttcttactaagaattattgaaccccatcacatctgttattcactatgaaattgttggttgccttagaggacacaggctcaataaaagaggttgaatgtttacgaggcacagatacatcagttcaaaccgcaaaacaacccataagtatcgtcaatcatgccgctgagtccagagctactcacatcctgaaattccttgtcacatctgactccaagtacgtggtggcagccagaaaaggaggtgctatcgttatctatgaaagagacacatttgaggaagtcaagaggtatactaatatgacagccaatgagtcttcagcttttgtatctttgatacaagattctactagtcttatctatgcatgttgtgagaacggagtggtttctgtgatagatttggaaaacttgaaccgtgaggataatgacacacagcacccaataaagttagaattggtagctccggttagttgcttcgtgctcaaccctaatcaaaagggtatatttgcatatggtggcaaagataatgaagtcaaggtgatttctatcaccaatggcaagttagaacagctatgggaatcgaaaaacgttccccttgaccaactacgtcttcctgtgcccgtatgggtttcaggaataaactttttggatactgattccgttaaaggacagagtggctatcatctattggttgttaccagatacggacacataagaatgtacaagacttggctgaaacgaagaccagtgaaaaccttccagcctactaccaagcccctgagaactatcactcacacttcgacaaactcgaatgcagtatcctcagattctgctggtttagttggcaagttttcccttaaggatggaaaaatggtgggaaagttccatggttcagtgggttttgttagggcattatacaattatagatactctgtaattgcaacgggtggtctcgatagatacgttagagtctatgacttggacacatgcagaatattggccaaagtttttgtcacctcccaaataacagatatagttatgttggaagatggtgagaaactaatggaagaaaaaatgataaggaaggaaaaagagaaggagcaggcagttaaagaagctgaagctttatgggaagagctggaaaaaaactcttccactcgaaaaaagaagaagttgtagaaacgttgtataatagtgaaatgaggttttctgaatatcaaagtagtccttggttcattttcttatcatgagctgcttttctgttatggttagcattttttgacttgtttacttctttgtccgcgtagcgcttcttgagtttcttagggttttgtttttggttctgtgccgtttgcgatttagacttagactttagtgcataatcgttggatgtttctcgctcttcaacttcgtcctcttttggttttcggtatgaagtcttctgcttgatgttgtttcctctacccaaattaaatatgaattcttcctctaacagttggaatcgttttcgttggtgggaaatcatacgggcccacccttcaatttgttcgtctgaccactttatgttagacttgagttcttctcgctgttttgttttccttgccgatttttgtagctgctctggtgatgttttcaataatgcaaatagatgaatttctaccttgtttaaccgagaatctaaagaggtattcaattcctcagcggtttcatcgctgatatcatcccgatccaatccggtattcttcgtatttttgccctttttggcaaagtctgttccagtcgtcctctcctgatcgtcataggtgtcatcaggttcatcttcatccgagtcataaagcatttttaatgcattctgtagtgtcctgtgccttaactgttcagcgacttcagaacgtgcaagcatagtatttttctttccctttaccaatactttctgctgtccatcgtagacagatcttttttcagtctgttgaatttcttttgggatgtcatccaaaactgacatgttctcgagtaacaagttaatcactgtttcaatattcgacccatgtctagttagcaggtagttagcctggtactcagtaacatcgggaaacaaatcagtgattgcgctcaattgctctggtgtatgaattactatatcggatccagcatatagcattattaatcgactcttcagattaggatttaacgcctgaaacttagcagataacaatactttcgtagtcaagggatatagtctaaacaaagcagccttactagtacatttcaatccagttgtaacgaggtcagcaatatgcgttgtggaacaggagaaaaatgaaacagttattaattgaaggcacaggtgtgcatgaacgccagttcctctgttgtacaggatttctagtgtctcgacccatttagcatcggtaaatgagtctgcaaacgctgtcgctttcactttgttctttggagtaatagttactttactatctccctgcttctgactttgtggaccaacttgccgaatataacccagtagcaaggatagaatctctaaatcatcattagcaaacttgcctgccgtaataatcttttccaaaaaaacatgcagtgtcttgagagttatcccttcgtctctagtgacatggttcttgtctgctgataagagcatttgttgaattatgggtagacttaagaagtttgagttgaccttggagtttgcataggctaacttcacatatatcttcgtaaaatcccataatgtttgccctgataaattaaagttaacaagtccataaactctcaaacaattaagaacaaccaacttcaagattttcctgttggaaataatgtcagggttcacacccccaagactaaaaatcttcgatgactcttcagctgtttccctcaaatagaccttgagaaaattttgaagctgctgaaaagatttggagcttaatctttgcgtggattcatcttctcgttttgataagagaaccgttactttctgtattagtgcaatgtaggtctgtaacagatggacccatatcacggggtccttatcggttagcgacgaacgtaatttgaagggtgggtaagctacaatggggatgtttaatacatttgaattaacttcttcactggaaggctggcaattttctactattaccggtgccatttactggttgactgaaatgactatatcgatagtctagataccctttgatagtgatgcaaggatgtagttttccacgagcgctcataaaatcctaatcgatcttacgtgtctctaacggttgattgattctgaatggtaataaatagatacgttcactttctaatatgcaacaattacccaaaataggactattggcagtatcaatggcattgatttgccacacatattctccattgcaacctatacagtcctcaattggtttcgcagttctgggatatttgttatcagactacctcatccctgccacggcgccctatttcatcaagattggtctatttggaaaggacttgagtaagaaagataaaccagtcattccggaaacgattggaattattcctgctgtagtctatctttttatcatgttctcatttatcccattcatgtttttcaagtttctagtcgtggatactagtggaggaggatctagggacacaggtgtcgatttggagacagctgactccaattattttccacacaacaaactatcttcatatctaagtggtatactttcgttggaaagcatggtattgttaggactgttagatgatctctttgatataagatggaggcacaagttctttcttcccgctattgcagctatacctttattgatcgtctattatgttgactttggtgttacacatatccttatccctactttcatcaagaacatctttggatttgaagccgtttccatagatttaggtgctctgtattatggatatatggcagccgtcgccatattttgtccgaactctataaacattcttgctggaatcaatggtcttgaggttgggcagagtgtggttttggcagttcttttactactgaatgatttctgctatctaattccagcgtctcttagatcaactcccgcatatgaaacacatctgatgtcaacgtgtattttagtgccctttctaggagtctcccttagccttttgaaattcaactggtaccccgctaaagtatttgtaggtgatactttctgttattttagtggtatggtctttgcatttgttggtatttcaggtcatttttcaaagacactgttactgttttttcttccccagattttcaactttgtttactccattccacaattgtttggccttgtagaatgcccaagacataggctgccccggttcaatgaagaagataacatgatgtatccttctcatgctgtgtttaaaaaacgattgcccaaacttatagaaaagggcatgctaattttggaagctttaggactattagaggttgttaaagaagaaatgaagactgacaataagaccgagataataatcaaagagtgttccaattttacccttatcaaccttgtactggtttggtttgggccaatgagagaagataggttgtgctttgtcattctactactgcaattcagcattggattgataagtctcgtggcaagacatacaattgcagcacttctatttggatacgataatcttagtattttcaatctcagcatactgagttccaactaatttacatttttatttatgaatctccaaaattcgactcgttggtgaagaatttcatctgccaatcggcccacttcatcggtcttgatttgctgacgggtcccctcaaagaattcatccagacgcttagatcctttgtatcgtttctcatattgcacagcttggaccaggaactcatatttgtcaatgtccttcacgattcgagattcaaagtttcgttgttcctcgtaatcaagccacagattgaccatctcctttgcaaaagcactattgtagggatctatcaagcttcctagatactttatggcggccaattctctttcgtatttttgctgtttggtaacagtggtgtcttttggggtgatatctccaaccaaagcttcagctatgtcgtggaccaacgaaatcttgatacattgtgataaatctataggttccttttgagctgtggataagtttgagttgtctttgaaattggcggtgttgagagacatagatatgattgacattctatacatatgatctgaaatagactctgcattgtcaatccccatattcaaccacccagttctcttctgtgtcttcagtagttcgacaacttgtataaatgcactaatgtacgtgtaagggcctacttcagcattctgaagaagatccttaacctcgctgggtacgtgatcctccgggttccaatcattggtggacatcggacagtataatgtaaaatgtaaacagtagaataggatatttactaagcgaaaatttgaccccaagaaaaaaattaagccaaagcagatatagagtgaaatatggttaattggtgaaatatcactcattcgttttcagatcatgagatgctcagaaagtacttcaaaaacagatatcttcaaagaaggtctacaatgcagtttagctatggaaattttttgtttaaatatacaaaagagagagtctcaaagtcgacatttaagcaactaattcaacaacaccaccaacagctctgatactttgctcagcctccttggaaacaaatctagccttgacgataattgggatgtttggcaaagaacccttaccaaggaccttaccataaccattggccaaagtgtcaataacgacggcagaagaagcagaagagttcttcaaagcatcttctctcttctcttcaggaatcaaagaccacaagttctggatgttaattactgggcgccagtaacgagcttgttgtaaacggaagtgtctcataccaacctttccgaagtaacctggatggtacttgtccatgttggttctgtggtggtgttgaccaccggccttaccacgaccaccgggatgctttctgtgcttaccaacacgacctttaccggcagagacattacctctgtgctttctggttgctgagaatctggtaggcattttgtgtgatctattaaaccttgttaaaaagggaggaaaaagggaatattcttatgaaaagtttgtatggcgttagcgaaagttagaggaggtgcgaccaaggaaaggaggagtgaatcgtttcttaattaatgcactaaatgcagtcatgtgatttcacaaagggctggtacgcgattgcactaccttatttcatctccccaaacttctttataggttccctttcccttggtctctggaatataaagatatgtataatatccgaataggaaacacatgaaggcaaatataaagtaaacgtatcctccgatatattcgtttacgatgggaaatagataaccgatggcaaaggtggctatccaattggcagccgtaccccaactttgagctattcctcttacttcctgttgactgatttcggaaactattaagaatggaattggaccaattgcgacagcaaacgacccaacatagaggaacgtagctaaaacagacaatactgcaactgaattgatgatgcccactgccatggctactgaggaaatacccatcaaagttgctgatgtaagcaacagtggtttcctgccccatctatccataaacagagaagctgtacccgtaactgttaaattaagcaaagatatcagacaattgatagccaatgcaccagttgggaagagactcactaggactttcactccgtagaagattatcgaattgattccacagaattgctgccctaccatgatgaaagtgacatttcttcgtgacctagaatacttggaagatgtcaggtacgatttgagcgacagattagcctgctctgggttttctgcaatatatctttctctactaagcttttccctctcccaggaagttatttcctcctgacatctattcaaatctccatttcgtaattgaaaaagaactgccaaagcttccctcgagtttgaggattcaattgctagccacttcggcgattcaagtgcaaagttggatgccacaaaattaactattgcaataacgaatgccgtaacgagaatgtatctccattgttcatcgttggtccatccaattgctaggagttgagtgagtaagatacctacattgataaaaatttgattcatgctgcccagcagtccgcgcaattcaacaggggagacttcattgatgtatagtgcggaaacaacaattccactaccagctccaattcctgacaagagtcttccacaaagaagctggccataagtattgctgagcgactccagcagagatccaacagcgaataccaaagaattggctgtgaacatcttctttctgcctatgttttcagacaattgacctgcgtatagtgatcccaataggcctcctatagtaaatatagaagtaacaataccaatttgattaacgtccagaggtatgcagcttttgtaaccatgtcttccaaaccacgactttgcgtaatcttcgtgtggtccagtaataggggttctacatgtgtagacagactctggggcatttagttccgacatatgatagccatattgaacggaactcaaacatgacattagaactgcaagtacaagtggaagcgagatagcaggagattggctcaaatagtttgaacccagcagctcggcagagtccgattcgtctagtggcatggaagcttggaggtatgtggagaggtggaggaatcgaagaaagggggcactatatcttgttgctggaagaacaatgcaacacgcggaatgtatggggatcgctctatatcaaaaaatctcaaaccctcctctcacccttccgttagtgggttatcaaattcagctgaagacactttgtacgtagctcctcactcctcatccatacaacactagaaacgtcttcaggattggaactgcaacctaaatgagtgaccaaacgcccaatcctaacgatatgaataatgctatcatcaatcaatggacacaagatgaactagatcacatgaatctatttgaagccttcaactttgacaaccatggacaaagatttggactacatcctatttatagattgcctttgctagcactcagtggctctctagttggaggagtctcagggatgatgtacgggtaccagcttggcggcctgaaatacctcgcaatgaatgctcatcgtatgccaacggatcgcaacggctggttttattatcacaagagaaaaaatttcgtttgtttgaaggactcatttgtcacaggtttcaggcaggcagctaaagttggtctcttggttggtactctgttctctctggaggcttatttcgactatgcaagaggtactatagattttgccaatactatgatggccacgacaatttctgggtggatatatgccaatgcgtaccaattgagttcctaccaggcaaaaagtttagtgaaaagaggtgctggggtgggtttgctcttgggattattacaagatgcttctaactatttaattggtaacgatgtgtggtatctgagagtgttttttggtataaatccgagattgagtcgtaaattaagctgagacctaattcattcgtccaaatctaatataggatagttaaggatcaccgcaactccagtcagctcatccaactgtttacctgaatcgtgcaagctggagagaatcgagacatctccaccttgagctttcactgtttcagctatctgaatgtatttctttctttgggaaatactatcagatctgaacaatgaatctgtcaacaaaaggtgacgaatagcacctccaatttccaaagccttatcgcattcatcaggcccataccatgccctaccgtcatccaagttcagaatcttgaaaaagtcatcaagaacgctgatttcttttgcatattttgtatcactcagttttttctggagctcagggttatggaacgcctcctccaacccttgtaaatagccggtagaagagtgagtcacaatgaattttgattttgcagccaacagttccttattattatccttcgccgctttttggaagagttttgtaataaggttatccgccacaaatcctggagaggctaatacaatagcttttaacttcacatagtctagattcctcaacattgtatcaacggtgctgtccaaaaattttgtgtaagccttatcgtatgcggaattatctccccgtcgtttcttgggtatggatttttcaactttggctctcaatactgtaagactttcagtaataaggcaaatatgagcaacaccttcttgaagcacaacagcgccaagttcagccttctcttctactgagcaggacttcgtaataatatcatacgccacttgatcccaatcagatttaaacaatgagaacttatggttatattggagctctgccgtatggtaagagtttaagggcacatcatcgttttgagttcgtgtacgcccctttatgcgcatgatttcatctatgggagagaaatctacatcctcaacctgtattctaaggttcacgatctttttctcttgctttgctttggatgactctttcccaggcttcttgacatatcgcactgtggtcagttgaacctcatcgtccttggcaatcagattatataccgcccaaagatcttccttatcttcaggtacaagaaccaccactccactagagtccttctcaaacgattgacttagcaatttcatcttggtattcaaaaggatgaggagtagatgagaataggtgataaatgcgcaggtaaaaattatagatgtcagatgtcgagtattgaccaaaagacaaaagagtatttaaacactaacttaactcacttgagcaccaacaagcgtactggcatggcataaagctccggaagagtgtaccagtttagcagctggttttccttcctcctggtaaagaacttcaaaagcctcgttcgttgtgaaacgaggttgaacagtctcaaagatcttcttctttggattcagctgtttctcgggagtaccgtcgaaaccttcgaagaaaatcttgtcaccagcagcggccccctcgggtggatttacgaattcaacacggtctatttcctttttggaggcacacaaaaccatagcggaggacttgattcctctcatgttaactggtttaagattggcaatgaccacaacataacgttgttgcatatcctcaataggaacatatttcactagtccagaacatacagttcttgggccttccggatcacccatgtcaattgttgacacatacaatgaatcagcgtctgggtgctttacagctttctggatgaatccaacacgaaagtcgaccatagatgggttgggaggaacttgcgaagcattggctttggcttcgagttccgccctggccttagcttttgcagccttctttgcttccttggcttctttagcggccttacgagcggcttcatcttgaggagggccagttggtttgccttcaggcttatcttgagccttggatttttggggtttctgtaactctgcatccccctttggttgctcctttttcttctctggtttagccttgatctcccttggtacttcagcagagtagttaacagtgaatggggttttgggctctaggagagtgtgctgaacaagatctgcccatctaattatatgtctataacgactcaagtcttcgatcgagctccagcttctcagcatagactcggtttgagagaaaacatcaacatctgcttcagatggagagttaccaacaatgtatgttctagttttcaagaactcgttcaactttgcaagattttcaggaagtctcaaagccaaagtagtccattgtgaagcaagagcagcttcttcggcactcaattttggaaatgcagagacatcaattctaagtttctggagtggttgttcaaggtctgacattggtattattgaagaaaggtcaggatgattcactgagactttttttttcgcttcagtttagagaggtgcctcccagcttttccttgcagatgtcccttcaaaacgtctcaccctcaaactgatttttcctcaccctgtctttccgtaaactataatcacccccgctcaccagaaaaactgaacatctggtagaatagtcttagagtaccagacatggtagacaaagctactacagagagaaaactgaaggctccattatctggtcgcaaaagagtacctaagaaaactgcacatgcttgtaattactgccatcaggctcatatgacttgtgatgactccaggccttgcaaaagatgcatacaacggaacttagctgattcttgtagggatgctccacgtaagaaaaagaaatatttaatggatatcccagacgaagtagcagacccttctgctcagcagttaactccggacgcagttatgggaccttccccttctacaatgaccctttcacaatcaaacgcattcatgtcatccgctgccgatctagaatattctatattgggaaatatcattcatcaggatagcggtcagttcgttggcactgatggcactgtcattagtcctagcatcagtacatcagatgacaattcccacattactcctttggcacactataatggcgcaatccagggacctgccgtatacacaaaatctcccttgaattttgaaggttcctacgctatgaccccaattcaaagacgcacagatattaatgaaatacagcctgatctactacggagtgaaccttcctctaatgacacttttggaccaaccttacatggagaagagccttcttgtgatagctccactaaccagtactttataggtccctcattttcgtcagatggcagggctcagactctgacatttccatacgttgttagtcagattgaaagaaccaaacgctacaatcctaaagaatttcgtcgaagaaacaaaaaatcagccatttcgttcagtgtcggtctaatgacagacgaatcctcagacaaaagagatgagtctattacggggttggtctatcacgaaccatctgagatttactccaaaataaaaagaccttactcgtatccacaatactaccacagtttaatcctatatctcagaaaacggtttgataaagaatcactagtcgccatgtccaaggcaatggccgaatatagaccgtcattcatagcaggaaccatgaacttgaaggaagatgatttgatatttacagaacagtgttttcaaagaacattactagagtacgataactacatttctatcagtggaactcctacggttgtttggaggaggacctcacaactggcctatgtggggagcgagttctgtgtcctcactggctggtccaaagaacaactactgggaaggtcaacgtttattgttgaaatactcgacgataaatcagtgcttgattattttgagcttttttctaagattgccttcggtgacttcagaggagctactatgacagaatgtaccctgttgacccctgatggcaaaaaaattcgaaccagttcgatatggactctaaagcgagacgtttttggcatacccatgatggtaatagcaaattttctccccatcttgacatgaacatattaaacactactttactgagccaaaatagacttgacaaactccacatagtctacattaccttcctccgtcacgttgacacccttcaaaagttcatcaacttcactgtcggtcagcttctctccaatggatgtcaagacgtatctcaactctcccactccaataaatcctgtgagatttttgtcaaatacctgcaaaccacgaatataatcctctggttgccctaatggcttgaacccatccggacggtcaataatcttaacgtatgtgtcgaaatccaactctgcgttgttaggcaaatattgttcctgtaggttggagatctcggccagggtggggttttgtccgactgcccttaaaagatctccaagggagtcagaggacaccttaccagttcctttcttatcgaataaggagaaggcatctttgtatgttttggtattttgtgactatacgctggttagaaaatattcatcagcaatgcaaaagcaattttccaatgtggaaacgtaccataatgtttgttatagagtttatatatcaaaattgacgacgtttagatgtgttatgttttcttgatctttgcccaaaacatgtaaacacgagaaatgcgcgaggcaaagcacatattacccggctttggcaaggatgtccgatgtattgcatcaatccactatcgtgcaggtttcttttcaagtggtaaatgaatgcaacaagaatagctgtggttaagtctaaacttccaccatgctgcgtgagggttttgccgcaagatacttcaataatagtactaggaacatacaaactggagcaaaatggctcacgacatggaagcattgaggtgtacaaacaggaggattcaatcaactacctgctaaattatcctactgaatctgctattttagatctcaagatcaacccattcaatgcaaacattttaataagtgctcattcaacaggagagatcattatatggaaaatagattcggaagacaaaacgaaattgacaaaagtgcaagagattcaagtgttcgatcaagatcctgagtgtcttgcaacatcgatagtcttttcaccggtaattgaaaacatagtgtctgtaacaggcacagatgggtcagttaagcttgtggaccttgaacgaggtgacataaccaatttttcaacgaagcacgattttgagtgctggatcacaaactttggaagccagaatgcgttagagaacgttatttttagtggtggtgacgacgcccaattgattgctcacgatttaagggagccgaacacaagtatatttgcgtcccgaaagcttcatgacgcaggagtcgtcagtattttaccttctactatctgcttgcaccagtcacacacaagcgaatggaagacgaataacccttatgaattgtggacgggatcatatgacgaccatataaaatccattgatttgagagttttacctccaaataaacttattgctggatatcctccccgagtaattgatgagctcaacttagggggtggagtctggagattaacgccctctccattaccgaatgacgatagagttttggtcaattgcatgtatgatggggcacgaatagtaaataaggacgatgctaaagaatttgaagtgctcaagacatttactggagatcacgaaagcatatgctatggtggagactggattgaaccctctcaggtaatcaccactagcttttacgacggaatagtgcaatcatgggtaccatagctataagatagaaaaaaaaaaaagcgtcactcagcaacttcttccacccattttttgagttcttcccaatctacttctttatctttgttgtcaattagttcaagatcacagtattggctaacgggtagttgttttttcaaagctaccactgttggaattttggttaccatatacgtgctcagcaattgatggtttgccgtttcatcagcttcaatatcaaccatgttgacagatttttcggtctccaacgaaacaatcctttgaagggccccagtcagtttatttgaggcagtttcaccacgatacacaaaattgagtaatagcggaggcttttggattagatagggatgtaattctgaaggatctctgactggcaggaagatacgattaccagatttggtgctagcgggtggataaaacaattgtgttctgactttcagccaaccccttgattgcccaaaccatagtgctccggcaagaaaaagaccacctccgatgatatatttatctctgggtgtgagagccatattagttgctgatagtaacagtatctctcgcttcacccacctgttttcatcccacctccaaacattatcattggaaaaagtgacaatcacatgactagtcacatggccggctcctgggtacattttatgccccactcttgcgcgatatgggtctaaccggcggcgttactaatatattactgaatcagttgtgaccaacaatagttactatatcattatcggttactttccatagttgttcacctttgatttcgagtttatttcagcctccatcaaatgtccgccgctcacgatatttcaaacgaggatgacatgtttgaccgcatgccaattatctcgcctgtattgtcagccaacgaaaattcagctcaatcaacccccaagcccatagatatcagacacgaagatgagcctgaattatccataaaatccgataaaccgtcagagactattcacaatgattttgaaaagcgacgactgttacctgatgagctaccagtagtcgagtgcattgccagagccagaataccaactactcaggggcccgagatctttttgcatttatactccaataacgtcgataataaggaacatctggctatagtttttggggaagacatcaggtctaagtctttgtttcgaagacgacccaatgaaactcaatcagatcgaatgactcgtggagcctacgtcggcaaactatatcctggaaggactatagcagatagagatgagagatcaggaaaggaaattacttgtgatgccaacggagaactgatttattcaaaagaagaaatagaacaagaaataaaggaccccactttggttaggatccattcagagtgttacacaggagaaactgcatggtctgcccgatgcgattgtggtgaacaattcgatgaagctggaaggcttatgggtaaattcggtaaaggatgtatcgtttacttgagacaagaaggacgaggtatcggactaggtgagaaactgaaggcctacaatttgcaagatttaggtgccgacactgtacaagcaaatcttttactaagacacccagcagacaaacgttctttttctttggcaacagctatactaattgacttaaatttgaccaacgttcgattattgacgaacaacccagacaagattatagcggtggaaggaaagaatcggcttgtaaaagtcattgaaagaattcccatggttccccttgcttggcagcataaggacagcggtatccaatcaacagaagttgacggatatttaaggactaaaatcgagaggatgggtcatttattacagaaacctattaatatatagattagtaagtagacttttctcctataaaaaatatgagtaatggtgaaatgatatttaaactttatacgctaatcttcttcatcctcactcaatctaatcgttcgacgtcctgatattatatattaaaagagagtcgaaagtagtcctggtgaaatctgaaaaaaaatatgctaaacttcttctataggagactgttgaaacttttaaatcattccatttaatcataataccgtggtgataatagcctatgatttttacgaactatgaacaaagcactaatatatactatatttaccaatagtatatttaactctgtttgctatcgtcatcactatctgcaagttccaagttgtctaactgattcagaaggccaatgcccttctccagatttatatcatcggtattagactcattgtccaagtgtacagacgaacctttcttagaactttcatcagaatttttggatacattgtcagtccctgggctaggagctgtatccttgaactggtaatcagaatcgtaaaagttgatgttaaggagctttccaacacgcttagtattcatatctttaagaagctcaagaacatcgggcttatccgttgcaacagcaccttctttgagcctgagatgacccgtttcatccttgtacacaccaactgattgagaaatgcaatgctctgggccaagtgataagacgacctcattatgttgggcgctacataaatccttaccgagaactcgttcagcaacggctgcaacctcttcgattctaaccagctttttcttatcaagacttggattttgtgcattcacaattgatttaattatgtttgttgaaacgatctcacttgagattactaagccgaatatagtctctaaagaaagatccagttgtttctcgttcatcattgtctgtaggttgctcacatcaccaagactgtaaacactcggaaatccttcaacttgacaacattcattgagtagtaccgagccgtctgttggagatacagcttctttaagggatgtagacaacaaaggatatgttattggctcattcttgcaacaccaaagagttatatcacttcggacatgtgactggtcttttgtaagcacatatcggcggatgcggcctttgtcatcaggaatttccacttctcgtaacgcccttgagtttaatctaacatcaatgcccatttccttaagtttctgcagagcttgcacttgcaattcggtggttggaagttctccatcgtcttccttgttgaatcgattacttagagaaggaatagcatgtcctgaatgtagcagggtcactgatttatctgggaatctggcttttacttctgttgctacttgacagcctattattcccccacctgcaatcgttacgtattgcgaatttgctatgcatgtaaacgcctgataaatctcctccatgaaagaagatttggtgaatccctcaggatttaaaggccagagtcttttcttaccaggaacataaacacaatagttgaatggaagatcaatttcgtcaccttccatatcgtcaataagcaaatggtgttcatagacttctaaaaccgtaccctgtataaagcgaacttcaatcctatcctgcagtaattggtcgattttcacagcttcattgtatgcgtcgtcagtatcgtaatcttccctcttgacggtgttggcctcagtggagtaaactgaatacggaagattcaaatcgtccagagaagcgtaagtcagagcagcaatctctacatttgttatagcccttggaatagcaaaagtattgatgaatcctcgtttcggatcaatcaaataaacctgaatccttcccagtttatagggctcacctgttttctgccagtgtaaaaagacctgcttgtactgcctgattatcgatttaagaacggctaaaccggcaaaggaagcaccgaccacagcaacagtgataacttctgaatcagacattgagattctaaggattgattgccggtgtttgctatcaaagagagcttattaactgcgaactcaaagtgggtccgtttgagatgtcagatgtagtggggagaaccaatgggcggttacaatccgattacgtcataaacttcgaccgcgtgcgttaggaaggttgagtacctaatcacatctatttacaaatctagcaaagtttctttccaaaatcctttccacttcctcataagatctatcagtaaatctagctagtaactgggctgactttttcaagtcctgataatgagcatttgcagaatcatatgagtcgatggctcggtctgtttcaattagaaccctatcaatagggattaccttcagtagttctctgtacttttgggcttgctcctcttcaactatagtgaataatggaaaggagaaataaatactattaggaaacttcttcagccattggtgtgtctgagaaatggggccgttataagagtgaagacatatcgccgagtcgtctcgtgcataaacttttagtacctggtccaacagagcgccatgagctttgacacaatgaacagatacaggaaccctttttctgtaggccaattccaggaagatgcctaagattttcttttgatggtcgatgtccactctaaatttagtcaaacctgtatttttttcatctgttgggtaatttgggtagcccgactgcggaattctaaacactttgtctagtcctatctcaccgagaatttcgaagtcagtagccagttcatccaaacttaggtctataggctctggcaacaaatccagcaaaatctgaaacgactttgtatctccattggctcctgatatggctgtcatgtaatgctccgctttgctcaaagttttatctactcgatataaatggctaaaccaagggtgaattccctggcttttcagtaatgtgcgcaaaggcctcactcgctgtattaactcccagtctctccaataagttgacattaaacaacaattgaagtttctagcttttaaaatacttactaatttttctacatctagacctgatgtcgcatggcaatgggcatcagatagctctcccatcccttagttgtagatctgtaagctcgtggggcatttagacatgctttgaatttcatgtacgccccaatgttctcgggtgatggcgcgcgaagcctttaagatagcaagatcacaagttgcatctccaactagattgcttaccttccattctttacggttttctctgtgatttacccaatgactgttatagtagcctctttatttctgccttatacggtagagtttcaggtcgacagtactgccattgaccccaatgcggatatactggtggaacatactgacccatctactgtagaatccaggagtaatatggctctgaaaagctcagaagattctctactagcttcaatgagctccgctaacttagttgaggacttcagtcagcagaactaccagcaacttaaatctttgccaaaagatgatggctcaccagagaatttttttcaagcaggccgcaggttccctaccgccaatgcccctttaatcgacgatgaaaccccggtgttgtatgagggcaccgaagcttccttgcaggcattgaagcctccgattcttagaaccagctcttcaatttctttgtttcaggatgaaccaagagctccatcgccagctcttggaaatcctcctcaattcctttccaaacaaaactcctacccatcatctcgaaacatccaactaacgactccaggttatgttcagccacgttcaaaggtcaattcactggctgataaatcgtcagtttccgagctgaagaagtacaaagaaactccggctttttcaagtctcaagtttagtcgttcgaatacaactagcacttccaaacttattaacaagataaaaaaggaggacctaaatgaatattttgaatcgacaatctctgattcttctacttcctctttagttccgtctactaagtttgcaccttttggtggtttttctacctcgcctgatgaattgctttgcaatgatgaggagttctttgcaaatgccccttggaaagtagttgagttttccaaaggtaatgggtctttgaggaatgcgattagaattgccagacaacagctgcaggtagttgatcaaatatcatgggtgggtactttgggcattccggtagatgacttaccactttctactagaaatagcgttacggagacacttgctaggggatttcactcgaatgtgatatatgtgaacgatgaaacatttaccggtcattacaacagctactgcaagcagatcttgtggccaaccttacattatgaagtgccagataaccccaagtcaaaggcgttcgaagatcactcctgggaatactacaagattgtaaatcaggcttttgcggacaaaattgtccaaaaatacaaggagggtgattatgtatggattcatgattatcatttaatgttggtccctcaaatggttagagaaaagttaccaaatgctaaaattggattttttctccatgtaacattcccttcctcagaaatatttcgttgttttgctcatcgtaaagaacttctcatcggaattttaggggccaactgcgttaccttacaaattgaagaatatgtaaggcacttttcgcaaacatgcaaccgccttctcttagcggattattcgaacgatggtatcaaatacaatggcagaattacaaagatcaatcattctgctattggaattgaggttgattctctgattcgaagagtttcaacgagtcgagtcacagactggagagataaagttaggaacagatggcatgacaagaacttgctggttaccagagataaattagataaattgagaggtgtaaaacaaaaactgcttgcatacgaaaagtttctttccaactatccttctttcattgacaatacaattttgattctaatttgtcttccatcagggaatgaagatgacgatttggaggtagatattttgtcaattgtcgaaagtatcaattcaaaaaatcacaatatttccaacgagaaattagttgtctacctgaatcaagatgtcgattttgatcaataccttgcactactttctgaggccgatgggttcatagtctcttcaatgagagaagggatgaatttgacgtcacacgaatttattgtggctaataatgaaaagcattcacctttaattctgtctgaattcactggttcagcctctatatttgccgatgatgccttactgataaatccatgggacatcaaccaagtttctcaatctttttaccatgccctcacgatgggaaaaagcgaaaagttacgaagatggacttcgatgtatcaaacagtattgaagcatgactctcagaactggatcaaaacatgtctggaaagcatagacaatgcttggaacaacgaaattaaacgatccaatgaatctatttcctatttctctcagccactgtttgacaaattttacagcagttccagaaatgggaagagactatttataatcaatctgggaaaactggcctctgtaattaccttggaaggtaccacaaatgccaaggtaattcctgtttcattgccccgaatttttgaagtcttaaccaaactatcaagtgacccaagcaatttgttatacgtaatgagctactttaaacggtcccagttgacaagaagatacaaaaactttcccgatattggcctgatagctgaaaacggaggctatgttaagttgcacaactccaatgaatggaactcgcttgtttctgatagcgcccaaaactggatgaaacctgtcattgacgttgttgagtcattttgtgtcagattgccagactgttcctacgagatagaggattgtacagtaagattacacactcaaaatgttacaggagttgaccaggagcacaaattggccatgattggggattttatctcccatgtgaacgatttattttccaatattaatatacatgcgactttagtcggtgacattgtggtcattcaagaggcagatttagtgaaaagagcactatcttttgttcttagtagacatgagactcacttcgaaaatcgtgtccacagtgaggcaatttctgatgaaagcagctccagtgttaagttgatgatggtgattggtggatgtacccaagttgacgaggaaatgttccgctattctaaggaaatgtacaatgaaggcaaatgtggaagctatctctctgtcaaagttggcagaagtagatcatctgacgcacaaacctgcatcgaaggggtgaatgaattatttaatatcttaagtaattttgaaatctaatttggactgtcatttgtttctttgtcacctttaggctttcaaccttttgaattccgagctttgatttctaccattaaaagatttgttaacaaggcgttttagttcccttaactctttatagtcttcgtcctgcaaagagctgaatctatcatctatattttcaaactcattgaacgagagggagtaagactctcgagttaccatccagagtttttctttggcccttttatgcctttctcggtccgcttccattcgggcaagaatctgttgctcacttaaggtatataaccttaacttcgggtctgcatctacctctgccaaactttcctggctcagctcagtattatcttctgatgcataacgttccgaatgcagtagtgctttctgctgtaacaaaaacttccaacttctttttaatggatcagtagtgtcctcatctaacgtttcattgaggttgaactttttttcgtactctttggtgtccttaagttgcaactcatgtgatatgtgagccagaatatgaaaactggaatgaaggttaacaaatgctttggagctactatttacaggtacgactttttccaaaattacgggtaaatcctgagccaaattctccacaaatggacgtccctctatcgcagatcctgatgcaatcaaggaatccacaaactgaaagatgtttattctcacattcaagtccacagcatccagtacctccagtataacagagtgaaaatcctcctgcaagtgtcgatttttgatagcgtacatggtgcagtttgttactgattgctgggatggcattagaatcttcagcatatccgagaaatggatccgagcttcaaaagcatccatagtagtctcgattgtagaaaaaggaatgttgtatacatggtaagcagaactgataaaggcgcgattgtatagctattacctaatcgttgcaaattggcttttcttctcttctttgctcgagaaattttcatctttttaagtcactattacatacatttaaatcatgggtaaatcaaacggcaaaggtggtaaaaatagaagaagaggaaagaacgataatcacggtcagaagcgagagctgatctacaaagaggaaggtcaggagtatgcacagattaccaaaatgctcggaaatggtagagttgaagcaacctgttttgacggaatcaagagaatgggtcacattagaggaaagcttagaaagaaggtatggatgtcccaaggtgacattattttggtgtctttgagagatttccaagatgatcagtgtgatgttgttcataaatataatgctgacgaggctagaacgttgaaatccaacggcgaattgcctgaatctgccaagatcaatgagaccgatacctttggtatggaagacaacgacgacgtcaactttgagtttggtgctgagagtgaagaggaagaggagcaagagcttgatattgacgatatttaaagaaatacagcgaggaaatgtatgtatagtattctgtttattctctttgctctataatatacaagttactacctatcatctagttcaaagctatcgaaacgtctcaggccaacagactcttcgttgtctaactggctcaagctctcagtccgatttcttggttgttgcatagaatgtcttacctgtagtccaccaaccccattgtcgaaaggaaaatctcccagtccatcctcagctgaagaaaacagcttttctgtctgtttggactttctagaaatattcagaagataaactccgctgaaaatgataaggaacccacacaaaagagaaataatgttcactgaagacgtggtattgaaccctttgaataaaatgaatgaggcacataatgtagccgtggtaaaggtgacataataaagagggtttacaattgaagtctcgaactgatccagtgctttgttgaagtagttcatctgtgtcataatgcacaccaccactaccagaatgaaaaaataagttgatgggtgagtaaactgattattacctccaaatgtgagcttcaaagctattccaaaagctttaatagacataacagacacagagccaactacggaacatatggagatgtaaaccatggggttcttgtgtccatatttagggactatcttgtagatagtaaccaaggtatacgaagttaccaaaaaacaataaaacaaaaatcctggctgcgtagcatattccaaaatttcatctactgtgttaatctccttatcctctggggcatgcagaacgatgattactgatcccaagaggcagattgcacaacccatcttacccaaagtccccagttcctctctcaggaacatggcagctaataccgcaccaataataaccgatagtgctcccaaaggagtcacaaggatggcaggtgcaaaggtatatgcagcaaaattagcgacttcacccaaagccatggtagctatacctgcccaccataatggattcttcaggtactcgtgtccctgcacaacgttagatccttgctttttagacgtgtcatttagtcccatttttgtaataataaacgaggttccaatcgcaagcgaagagctgatagctaaagcaagcccaatatatttatcgtccaccatatttctaagaaccgtgtgacgtacctgtataggctgtgttggtgttgtgacgatacttgacctagttacactttaaaccaattctcgaatttgggtttctgaaaaaaaaaattactgaagtacgtctgacctaaattcagggagagatggtctactttccaccagatctagaagctttatctgctgcagaatggtataatttactaatatctacgaagccaaacgatataatcaggccgtataaagattcagagtcttcatttatcgaagtcagttttccttgtctaatcaagcagtttaaagattctactggaataaatgagaataggatcaagagctgtgatagtttgggtgtatggatcctacgtgccactcaagtatcggatgaccaaataaagttacgtttagatgggcttctgaatattgaagtggctaactacttgttttattatattcttgatttttggactgaatccagcggtcctttaggaaactctttacgagagttatttttgaaactgttgatattcttcaagaaatcaaaaactgcagcacagcgcacacgactatttgagtcgtggactctgtatattttagatcaaagttacaccttgagagtggtgtacttcatactggagcatttgtccaaagagatagacgctacatacattatacgccgaaagccagagtttttcagtcaaacaatacccttgatgaacaacagcacattgaccaatccagctggtaaggctattcaaacaattttgaaacaattgtatatatcgatggacaagaatgatgcagaatggttaaagttgtggcaagaaccagtaatctcctccttattagatgaacgcctgagaaaaaatgttcaaatttatttgctgccatatttgttcaagatttcttctaatgcttatcagatatttatcagatcttttatcgacaattcctcgtctgatatatcctgtgttctgggatgtttacgaattggccaagaacttggattgatagaggagccgtttcacgggtctgatgctctcatagacctgagcatcataaaagctctcctggctggagagtctgatcagttgagaattggagcgttagcaattataacagcttccaataagaactcaaaacctattcatccgtatgtttttgagatagttataaatcatttgtcttctttttctcttttggaagatatggaaaccagagacgagatttttgctatactcaaacagttcatttcacgggctcgggattctgcgtatggtttaaacagggattgtaataaactgcaaaagaaggacagtgatgttacgaaaaggttgttggaagacaagcaagttcaacttcagcagtatctttccttcttcaaatctctggtgcaatttttaaaaaccgaaataaggcccgcagtatctcaccatagaaaggattttgcatataaggtataccatggattgttaagagcgggcttagataatactttagatccacagcattttgataaactccatttagagtttccttttcgaatcgatttatacgacaaagatttcttacgttttctggttgataatatcactgacgatttcgaagatatcagaaagcgatcggtagaactactattgatgtcaccccattctctgagagatagtttttcacctaatgatttaaaatttattcgcaatagggcttttgctatgctaaaagatattaagagtcgtaggtgtgatggaggtgctcgtgtattatcctaccttttcttgggtcattcatccaacaatagagggatggctactgagttactgaatgacttgaacttacaactgaagactgctatacagaaagcagagactgatctggtccgagccgtctctgaagaaagcactcacggatactttgaagcttttcgtttattgtttgagtgccttgatttttccttgtttgaccccaatttcattcaaagtctagttgacgaccttttgagccactcgcacaggatttgggctattgtgaaagacgtcttatcacacgattccccagaaggtaatttgcctggagacttcaaggattcacaccaatctcagtttgaggcctcatatggatctgccacacaacttcttcttagttattcgtggagatctgtcaaagaatcttctaacttactccgcgtgctgttagagaaagttccaaattcgtttttgcaagatgaaaaagtagttgcttgcggtgatctgattctctctcagttggcaattgttcgacatcctggagcattttcttcggtctatcctacattcatcacatgttgcaatcgatgcaatagatcaggaagttcactttcttgtcagcctagaaagtggctggagaataatatttccctgatacagtcaaaatctcagtttataactaggagatccggaggactaccattcctgattactgccgtccttaccagcgagattgatgacgaaaggccactacttcaatacacgttcaacagccttattgaaatcgcccaatctccaatcgtcgtaaatgaatctgagagaattgatcttcctcaagtaaatgcatttaactgcattcgttcaatttacttggaatcccaactagcaactattgccctgccgtatattaatgatgctcttgagctgtctctatctaaatttgccgatcctacatgggcagttcgaaattgtgctgtgatgctatttgccacattgcaaggaaggttatttggttcaaagaaggttcaagggtttttgcctacggtggccgagagaacttttttttccaagtataggggtgttagagacattcttttgatgaatcttaacattgtagctagttctaaagaaaccgaaaagcaagagatggtgtttccaattcttactattatttctaggttacaagtacgtcaaggatataatggcttagaagagcttaagccttttgttttacattttttggctagcaatgattggcaagtacgagagatggccgccgaggcataccccgcatttgtccttgctgatgatctattctctgagagttgtaggctcttggatggttgtcttctctctaaccagaatcaactatttggcttcctaactgctataaaggtgctattgaccaagggtgtcattcgaatgaatactacagaagtatcatttcctcctcgcttggtgcaaaaagtatgtgcaaaggctatttatcttgtgaggcataatccttgtgctgttacaaccaaactagctgtccaactgctacaaattgtgtcgaaagactacgaacagatatccttcgacgttattgaaagtttatctagctggtatataatccaggaaactagcacaattggttctttgaatggtgccaagcagctattggcatctcatatcctcaggtatctactaaatttccatttagttttggatgatcgagagagcctcagggaccttttattgttaagcattaactcaaatttcgacgaaacgtgcctaactgctttgaagtttgctgaagaaaacgtatcaaaattagatgaagatgttacaggcccattggtccaagttctttggggactaatcaatagcagtttatggagccatgttaaggcgacagcattaattttgttagaaaaacttctcgtgaccttttcatttgaagataaagacattagcaatcggattcacgtcttatttccatttatagaggatcataacagcgaagacatcaaatgttcagcattaatttcattagcgccatatgttgccagatgggtttcattgcctgaagtatatgaaaggaatcaggacataaatttcatccgctggttcaatgccgtgcgttcactttcatgtgaagagatgccttttccagttcgtcaagctgcttttaattcaatggcctcgtttttgaaagtggttgaagataaatcctcccagttttttttctcgtgtatttctgttagcctacttcaggttgtgggatgatgatgaagagttgagaattgtcgctgctaagtttttctcttatattctcaacatagactatgctgtcccggacaagatgaccaaggaggtcatcaggcattttgacaatcatttatctcagcataccgacattctatatcaaattgtccttaactttgacctgggtcaaaaaaggttaaagcggtatatcgacaataatacgttgttgttcacggtggagaaacataatttttaccaagatgatattttacttaaaagacagttaaatcaactgctgttgaaaaatataagcagaatcaccgaaacggaacgctgtcagctatatgaaagaatcaaggacagtgaaaatgagttacgattcttcgtggatcgggaagattcttacctggggtggttgaaggaagaggacttatttgtcagtctctgtattattattcaagacttagatatgttcggaatttgttggaaagacttgagaaaaggccttgagcttaagcaattacatcctttagtttctagtattttattacagatctagtgtttgtcaatgtttacttcactaagcagcattatagtgtcagtcagatttgatctaatctccagttgctgagcatcgtttgctactgtgttatccaatccgatccacttcataggaatatgtttaggtagcaattcacaccattcaatatacgaatccacagatttatgatctggaagagcgaggcatttgacattctttgtagtaatcagatgaaattcatcgtcaaatgaaaaacttctgaagagatgactagttaacgttgatacaatttttctgtcttcttcgttttccaattgagccccgtacactatttctgtgatgatatatttgatggcatcccatggaatttgatccgggtttatatttgtcctttctttcgaaacggatccaatccatttatctatgacaaataaggccgaaaccaaatcggttctaccgaagtcatactttttggaaaacccaagcggtgcgtagcgcattctttcctgtataacataatgaagccaaccagctaacattaatacatgagttttttcgaaaggtagaggagatttcatacaatataattgtccattaaaaattgttcgcaaataacttgacagatcaggaagttcagcaatcatcacaagtttggccatctttagaagaggaacagggatctttgagttctcattgcaggtcataaaaatcttcttggttaatgtgtttgattcgaaaacttcgataattgccgtcaatatactgggagacatttgtacgttctcgagtaagagccaactatcatccaatatagataactcttttttggccatcatcactgattcttctacacccattgaaactatcttcaagtccacatttgattctgctgctaagaactgaacattagtagtcacgtcagcatggcctgttgtacataaaatgaccagattatcagctgagcttgttgcaatatcactaaaagaatagggaacaatgccatcaaataaaatctgggttatagcatctgaaaaactcaatttgagtgtagccttttctgtgagtagactgcaagctaataaaggtttctctaactgatcctggtcccctagttctacagaatcttccagccaatttgactgggattcttcacttttgacatccatccccgtagagagtaatttaacaaattcggtggcattaataacgggtgcacttgatagtggttccaaaacttgctcaacaaaacgatggctcggaccaaaataagaagataagagcatcaaaatgaaaacgttctcgtgagaatccttgattgatacccttgatctcttgaatacttcttggtagagttttttgattattgatgccagggagttagtatcttggctaatctgcaaaacatgtatacaaatgttcatcatatagtctaccgatacctgataaagcccattaagcttggaaagtgcttgtagaacccgaaatatttttgaacaatgatgagcaaaacttgtatacttattcttcaattcgtctatggtagtaatgacgttttctgtatctttaatcttctcactaagttgcttagactcttgcttcaaactttctaatgttttcagaagctcactattttctagcaagtttccttccgattctgaaagtttgtcgagcagttcatcttctagtgaccttaattgtatctggtagtcactgttaattttaatcacttctattctttgatcatccacaacagggtaccttatttttaggacgttattcaaaacttgagaaacaacagagttctcagtaatagtgaaattaagaattgtggttcgactggcaacgtatgaaggtattattacgcttggatcttttgaaattagaatcagcttgaatttaggagagaaatcaattttatgctccccaatcttgatcaattttcttccacctattctttcaaaactatttcccaatattggacgtataatggggtcatagtgctcagcgtcttgtagaataatagtgcttccaaaacgcagggcattttcaagctgtctcacaaaagatctgtcttgaaaactagttactattggaggctgatccgaaatacaattggtcaacacattttgtattttaccagaaggatcaataataaatggaaatttggaactctgtgacaagatgatcatgttttctatggatatattgtcgcgtggaagaccaaatgcttcccaagacactaaatctccgaacaccccaagatgattaacaatagtatgagaatttctgaaagaaatattcagcagttccaaaacagtcttccactttcttatcagtgccctcctagtttcttccccatagaaaccacaataagcgataaaggcagctgaaatcaaacagtcaccaacaagggttttgcgtctatcaaaaaattcacttttagacatggaccatctatcacgctcggccgcaaggctctctaaaagtgagacactcctgagtaaagtattttcaacagtttccatttgctgcttgatattttctatctctctgatcagaccagcatattgcagcttgtaaccgtttatacttccctccaattcttcaatcatttcatttagggctataagccgggctcttgcatcagaagcttcttcctcaagaaataacatttcatctctcagtggtgacaccttttcaatgacttgcgaatacttcagctgagcttgcacccatagtaataacggtccgcaagccttacttgctcgattcactgactcaaagttgaagttcggatgattgaagtaagtgtcctccatgtacgaagaaagttctggtgttatttgttcatcgccattaaagtgaacaatgctggcaataaaatcgtcttttcgaataactgatagaacttccctccagttagcaacctcaaaccccaacaatacagctacagcttctaaagttaattttattgcttctggagggttcagcatggacctaagctcggtcaaatgttgcttcttaatattcttcaccccttgctgagcttcgactattgctggttctgcaattgcaagatcttgagcgacaatctcttgcctttctctaatgcgtttctcttgtatctcaagagatttctgaatctggattgatacttcctgttttttttcagcttcattctgttcgaaaagcatcgtatctaaagttttatttgcttcagcatttttcgcctttaactcatctccttttagagataattgttctttcagtagttcaacttctaaaactgactcctttattttgtcaagccccatattgcggtggttttgcttatcttgcattttttccccttgctcgtttactaacttgacgaaagttcccaaaaaagcctgataatgacctgcagtaatttcggaaaactcgacagacgaatgaatcttagcaaaagcctcatttatattgttacggaatatatcaccaggactttcagaaccttcataattggttagatcaagattctctagttgagccgcacaaacctgttttagcgtcgacactgaccagtcaccaagccaatttacaacacatcggttaaaaagtgctggcgaagataccaaatctggttttgtagtatcatttgggtcattgatggttatgacaatatgtaatctttgagcaacaatcttagaaaaccaagaaaaaatctcatcatgagtttcaagcaacggttcagcttcctggcataaactgatgagtaagttcaaatcatcgccttcaaataatcctggaatttcggcatttgctaataaattattcattctttcaataaaggacgtgtcggatatatcattttcgtcgatcagcaatacaatctgattttctttgatagtatcgactagtatcttccgaagctgttcctcgaagttaaggatcgtatatcctttccatgtgctaagctgcacaaatttatactgattcatccaacaaacaaactttgttaagctcgacttgccagttgcacttgggccaactaagattaaatgcccttgaacttgattaagtgcacgttcgatgcgaagaatgtggtctagcaagtcatcatgcaacaccatggaagattcagtttcctcttctgagtaaaccatcaacctttgactcaaaaaggatagtaactcagaactgtcaacactttcatatgaccctgaaatccatcgagtgtagagcattggctgccggaatattttctccttgtttatgttcaagaagtgactactagcaacttcggctatcatttgaaaacaccaaaatttttcatccttgtttgtcaaacgatcacagaagagtcgaatggcctcgtggacccaaattcttaaaaactgatccagctccaaattcacactacctgctacagcctcatatatccctttagaccacctagttagttcacgcgggctataaacatagtgtttcctttgtgacggagtaaatttcttccgggagcattcgtaaatttcaatcatagactcagccagcggatcacaaaaccctttgaggttaggagttgcccttaatacagagtcaatatatgatctgtagatcattagtaaagaatctctgcctgggtagtcgactagaaatacagcaaacttgccaacaattcgggggcttaacttatttcgaccagggtctgtcgaaggattacaggcagcaacaaactgaatattttctaaagtaacccaatttcctttataccagaagccagaatactcaaaaatttgtcttagtagttcgattaatggctggacaccataatggtcaggcatgggcaagttaatttcgtcacagaaaacgacaacgttcttactttcaatatcgggactcagaattagtctatttcctcgttgcttgtaggtagcatactgttctaaggttttaatgagtgtcgatggtaaagtctccttcgaaaaattcattgccacaaatataactcggcttgatttccgcaacacggaacagatactcattgtctttcctgatcctggtggtcccactaaaagtatcggtcgattgatactcagcaaccctgaaattagcttctcattgcgaatggtgtccacagtgtttacctgagaattaggttgagatatatcgatgcaagggctgacactgatttcactttcataatttctccactgcccatctggcaactcacatacattattaataatgggtcccaaaaatggtgcgtcttctaaaaacattgggctgcccaatagtagtttctcaagctttgcagatacatcatcggtggaatcgcccgcaaaagaccagatcaacgctacaagaagcgatcttcgaataaacttagtaaaactgaaattcgttaacgaggaatttaccctcaaataatccagtaagcggttaagctgttgccgaaggagggcaaagagtgtagttaaaactcttgaatggctgaaattctccacgtggaaatcatattgaacagattctattaatgaattcaacaggtttcctctgagatgcttcctaagttccgttgcaaacatttccaaagtagccgaaataagagcaggttgagtattctccatcaaattatttgttgcgttctgcgtggtagggtccactaatcggcaaatttcatactcaacgacgtcatggacactaaacagagattggccaaaccatactatcccacaacgactgattgttgctgaagtggcattgttcagtgattcaacctcaaaaatgactcggcagttgtttggaaaaaaaagtctttctccgcttggaagggttaatactttgttatcgtctaaaactgaattcaaactttcaatccaaaccggatcaattgcaccgtcaaacacaaaccaaacacgcttgcgagattctcctcgtaaattaaggtttacttgccgaagaagtgaagtgaaaactccatctgtccattcccgtgtagttatgtctaatgaccctatcaactcctctttcttgagaaccttggcgttgattatatgacatatgttatcagctccattttcatcttccttcatggcttgcaacaaaagcctccttgccgtcgtttttccagaacctgagggcccaaccagaattacaccattgttcactgtctgtatatcatgcatctgagtcaacttcttcagccatttgctccctgtattaaacccgttatctttggcaagatcatgaatcttcttggcaagattgttaggttcttgagtagattctgaatagtatttgaacttttttatagaagtattaaaccatttttcgtcctcttcgacaagcttaggtagaattatcttttccaagctatctagtaccaatttaaattcagcttcctcagtaaaagcatctgatgatggcgttgaaattctccgcctacgggctccacaattagccagcaaccctttgaaagctcgcaaaccaaaatcataatgaatttggtcggtacaaaattgcttcatctgttcaaaaaaaggggttatggccgaagttatgctttgtgcatttcgaaagccttgcgtagtcaactgaacctggacaatcatatgtaagtctggctgaagtaagttgatgactctgtatttatccttcagattttcaggcattatagatctcccagaatagtctgggttgcttgtaatgaatatacttgaagccttgttaatagctgtgaaggaattgagtatctccacttccactgctgatgatgactgcaaggcaaactggatctttgcaatttcagtcgaaagtgcacttaaagtgcttgtatccagtctattaaactcatcaaaacaagcccaggctccaaccctacagattccaagaagaattctgttaacagcttgaaaatcaaaaagctcatcgcaattgaatactaagaccattcgtcccaagttattacccagtgccttaaccgtttcagtcttacccgttccagctggtccaactaaagatgtgctaagtttttgatcaaggctttgagtcattgaaatgaaagctttgtgagtcaatggggtatacacaagtcttggtggaattccaagatattcatatccatactggaaacaagcaagtccttgtttaacaataatttgggtggttgtcgttgacaaggagtcaaaataaaatctctgttgtaacgaccattcaggggaactcaacgaaatttcttgctgcgtccattcagatataaagttcgcttgatgtaatagttcaataataatagattccagttttcgtctcaaaatatgatttatctcacctaataccaacttggatacagttctcagtatttttgagtaatttttttctgcctccacaggtggtaaaaagttaagctctattacgttggtccacaacaattgtagtccaacaatgattgcttggccaggaaatgactcgagtaggtgcagcagcaaggaatcattgcaaggatcactaatgcatttattccaggtagacaatgcttcggtaatatacgaagacaatgaacatttgatttcctcctctagcaactgtagaaaactcactagttccgctccttgggcaagaacaggactgttcaaataaaacacctcttgttcaggcgatttcaaaccaattactttggtatcttgctgaattaaagttgaaactcctggaaatagcttctggatgtgttttgatacaataagaaggttgttagactgtccaataagttcaatcaggtcatcatcgcccaaaaagtagaatctgctataaatatcacgttgaccttccaaaaacttgcttagagatcttttgatcacttgaagtgctttctgtaaagtgttcagcttgttcgcaagtcccttttcttcacgaatctgaagaaccaaaaatcctaagttttgacctaaactagtaaattccaatgatacattacgaaatcttgaatattctaagggtaataatctttggatatcaacactttcatcaaaaattccattcaaatacacccattgtttctggacatcgacccaagtatctaagatcctataaagctcatttagcttatcttcccaagtgattacctcatgccgaaacgttttataatgggtagagtggtggatcgaggccagtaagttgatgtcatcactacattgttgaaataaacgatcccatcccttgatgatcttgtattttcccttgtaaagaatagtctcaaagaataaactctggtaagtactgtcgagctttgaaagagaatcttcgattgatccctctccatttgcctgctctaccaaagcctgaatgggccccctagatgaacataaatcgagatcccaaagagtgccaatagtcagttcttccagagcgattggactccgctcaagcagttcaaaaagctgattccaatgtcgtagtttaatattagggttcttaagttcatttaggattactacggcctcagtcaatctcttaatttcattgaggacttcttcaaatgcaagatactgacgaattgcaacaggagtagactttccttttaaagatatttcctcaagcgcttgttgaagggtaacaatttttagattcagccatttctccctgcgaatatgttcaatatctacatttatggtctctatagttctccaaaccgattctaaatcgttaaactcaattcggcaatcctgaagatcgaatgcaggacgaagaggaatttttaataaggaaatggctgcatttactctctgagcctcttcttccaaatccgtgaataatttttgaaagattttgagtgattctaacgcatccattggtttcatttttccagatattggcttctccaaattccacttgttcttcgtgtactctattttttcagatagtgtcgatgcctcggactctaaatcttctgcaatattgttatgtaatttttctaaagaagtgagccttgaggtaagaagatctgacacagacataaaatctgagaatagttggtggtgagacagtgattgatttttttgattcgttctgctcctctgtaaaattttttggccagattcataaagctgaacatgtctattccaagagggaatattctcttgaacttcggtgatgtcaacaatcagtcgaattgtgctcttcatgtttctagggtcaatggatctggattccagcttcgcccttgcttcacttagggatgatcttagagataggcctgtctcctctaataactctgcaaacctcagaagaatatcactctgccattgatcatacttggaagtgacccgatcatatacttgctcacaatttataaacaatggaccttgtctgtaggttggttgatctatagtaagtcttgcagaattgaactctagaacaaaggttgaccataattcaatttcattgttcaactgagacacaacgtcctgcaagtttaaatgccacaaagattcgcactcgtaccacgtattgaagtatgtgattgctagatgataacttctctctagcgattctagacacagtacaatatcttcataaagtaaatcgcttacgaacgaaaacttattgatttcagattttgaacccgatattagcatttcttgctcttgtactacctcaataagttggcccagttcttgaacgcatatagtcttaaaatactgaagtgggggcacaattgatacctgccgtttctcaatctcaactatgtgttttgacttgatagtacactcagatgtttggttggtaaagtgatctcgccacctttcaagctcatgggcagctttctttctcaaagcctctaaaagctcattattcaaaaaactagcaaaatttgacatcacctcgttgttataatgaatggaaagatcattaacaatcttttgaaatagagataatgctcccttgattgaaatcaaagaaaaagggcattcctttaacttcacaaatagctcatgcaatttcgttttgaatataataagactttcaagctgtcggtatgcttggtagatatcatcctgtgtcttaataattagatcaaaaacttgtatttctataggtttggattccgtctgtacgagatatttcaaatcttgagctttcagcacaatgtcccaagtagtgtccaatatatgagatatttgttgaactatttgctcaatcgccggtcggagaaggatctgaaacatttcatactggtcaactgttttcattatactggcaaatagcaagagtgataatgagaggcctgtaactattggaagaatttgtttgatctttttatttgcacgtattagattctggggtacatcgaatcccatgttaatgagagattcgatatcctttgagaactgaaagtttttatcttcaaaatttacaaaaacttgaaggtgatcggtagttatgtttttaacaattctcaaaacgggtttattatgtaataaatcttcatcaagacctttatatctctcgagccattgtgagtatatctcctgcgtattgagccttgatttaagattgaagatatcagcttgtagtttttgaccatcagggtactggttccagtcattgcctaatacaagttcaagttttgccactaatttctcaagcttgtttattaaatgaatggaatttaacattgcatggctcattcgggttactcctcggagttgcaaaagactctcaagagacgaatcatgagataattgtaaagatacttgagtgacttcatccttaaaaaactttagcagctgtaaacgatgatcttgaactgcatacacgacagacgcgcgggagaggagaaaactaaagctttggtatgcttgaatcatttggctaaaagttgatgcgaggtccatcctgtctctgaatatcccaatcaattgtgcttcaatctgttcctttctggcggtgtaaattgcttctgcggctgaaaaggaagctttaccttcagaggatgtgtcgatgcagtttaagttcttcatcggctcatatgccaactccagagctctaaaaagatcactgctattcaccattgtttgtacactggttatatgatgaataatattatagaggtcatgatgagatgatctaaatctttttacatattgaagttgctcctccatttcatctgtttgtaggttgactttaatgagcaaatatttctctgacctcttgcgaacaacgagcctagctagctcaataaacaattgcagctgctcatgtaaattaacaaaaaatctttcaatggatgcggtcttttggataaattcatcaaatggtaaaaacatgagatggtactgttcgattattagttgcagcttctttttaatatctttggaaaaagtttcaatccatatcaaagctcttggaacgggatattctgtagattttaattttctcaaactgtagaaaacatctgatacggactcttggagtttctgtatatcggtagccgtaataaaactttgcattggaatctctttcaaaaacggggtatactgtgaggcaatggaaagagcttggctgattccggtatcaggaataaaactgacagtagcagaaaaccgtttagcttttttcaagacttctaatgaaacggtcacctcagggctttccagctgagttttaaggagaatcaaaacgtgttcaagtgtaatccaaaatctaacttcatcttcactggatccgtcatccggctcatgagaaagatgagttatctgttgtgctaatcttatccaattgttgactatgctgtgtatttcgttgatgtactctggattttcaatcaacgctgagtttatgaagtcaacaggaggtcgagattcgcctgtggaaacactttgagcaagtgcctcccgtactgtcgcatgagtaaattttaaaagctcaggaactttgatttcttgttgaaactgctctaatgccaatgttagttcggctatttttcttttcgtggttgtgaatgatggactcaagttgtgtgtttgttgattttctctagtgaatgcttcaaagaaagtgcccacagtttgactaaccagatcttttaaatagcctactaatgatttttcaacaaattccgttattgggacattgataatctgtaaatcacgttcacttttaatagggccggtatctttcagtagtgcaagaattgaggaaacatgtgttaatctcggaactgtgttaagtagaattctaaaagtgagagtagtttcatcttgttcagagatcatcttatacacaaacaaagcaccttttgaaggtgtcttaatgaatgatctaaaggagtttgatgcctcagctgattggaattgatctatggattctttcgatgcaccttggacaaatctagatagtccaaaaacaaattcattcaaccgttcaacggttatactccccgttggaacttcctgtttattgatgtgatcaatatcaatatttgtcattgcttgcgcaaaaacaggtaggtatatgcgtatatgcctttgtttataagaagctagaacatagaagctgatctggaaatcgtgggcgcgctactgattaactcgttaatcataagcattatagaaacctatctacctactaaactacagtttagtgatccttaacaactaaatctggcttcgttccagggtcatcaaagagactcttgggtcctcctgtagaatgtctgtcagaagtatcaaagtatactccgctgagaatacagaacgacagaagtggaaggcgcttcatacacccttggacgtagtcatccatgaagtggctgataacctttgccaattgcgggaagaggctctgattaaattcacagttgtagccatcttgatgcatgaaatatgagtatccatggaagtcccaagtgctcaatgttggagggaaacttagtaaatccaaatccgaagcattgtgcatcacgtcactgggtgtaaacatccgcctagccaaagagttggcagctgctgcaaaaaatcttggagaaataacatcttttaaaagtccactagacgtgtcaagatagaagtgtttcattatgtactcatcaaaaagagagagatacttggaacaaaattcacagttacacccattccacaaaagatctgaagttatagtttcataacatgcacaggatgcaaaaaatgatggcgagatcaaaactcggagagtcctcagcttaggtaaaacatcttggtacagattttttctccttatgaagtttccctctaaaccgttttcaaggttgccgtcagggggaggactgtgacgaatagacaaatactctacatcgggagttgcaggtaatttgagaatcagtctgccaactgaaatatcccaattttcaacgaaatcatggcgtttttgctcagttttctcaatgaatgcgagtttgcgtaggttagttaattttcctttttcacacagttcatcagaaaatgaaggcaagcacgaacagtttggaatatcacagcccaaaactagttccaagttgaccaatgcactcaaatcacagtaatcatatatgaatgatagtataagatccctcaaggttgcgttgtaatcgttgaatccgtggtagtaaatgattttaagggttttgaactgaaacttttttgattttggtggcttaagatcattgattacgaagtgtaggaaagttaaggttgagatttcgtctgatgacaagtacaaagattcaagaccatacaatcgaagcagagccgtcttggtttccaaacacgcatttttctcgatcttatatgtatcaagaagattgacatgtaaatgtttcaaactggttggcaattcttgcaattgcaaaagatggttgatagcacaagttttcagcttcttgaggtgcgggagctctcgatcagacagatgaaggtctctattcttgttaaaaacttgaaaactctgaagattcaagcagtttccctttattaattcgatcaatttctcattgatttgggcagtgtcgtcactattggaatcttcaaagatagccactttttcaatgtaaatcaatagttcaggattgattgttaaactctgaagcagcacggcttgtctggctttgaagatctgattatgaagttctttctttgccaatacattacttgagcttccaattagagtccaataggcagcactttcaagatgacaattagggagtaccacagatttcttaaaccatagatttcgatacagattcctaatcgctatcacataaagtctgtaatttaccagagccagattgacaacatcctgctgtgggagatacgctgcaatagcattccaaactgcatcaggaaactctttaggtaaatcactcgtaagtgacattgtcatgagatactaggtagcgttcattatcaattatcattagactagtccttgtcgcgacaaatgctatacgaagaaactcccaaccctaaaaaatatcagtcgactttctttcagtgaaggtataaagagtgccttactctgagtcgctgaatccgttccatacatcaaactcccgttccatgtattccaagcttgaaagttcagaagaactatcatcaggaatagcacggctagagcaatgaacagattgagtcactggctcattgtcactgtcctcgtctctgctgtctgtatctgtatcttcatcttcatcactgatttcaaccaccgctcttctactacttccgtagttgtggccaaaatcttcatcacttgatccctccgattccgaatcaacccctctttcatcttgtgcctcttcgtttaagatagcgtgtaaatctctgtgatcaacaaagtcgtcaaaatctgactctgattcgtcttcatctaggatactgtcctcctcaacaatagaaactgcatcgccctcggaatcgtcttccaaactttcatcgcctgcgctttgtcggtttattagttctcggccacaattcaagcacaaagagccatgaacctcccaatgacactcagaacaacgagtaacaccgtcgtcagtatcatagacggcatagcctttgttttgaaatattgatccaaacaaagaagctttgtttttagaatctttctcaaagagctccgtctgttgagcatgaattgttttaacggtgtcagcaacctctggaaatatttctaagcacgtttctatgaactgactgaggatatttctgagcgaatgatttggtatgggttccgcttggactgtggttcggcatattggacaggttcttggccttttcctaagccattcgtaaatacatccatagcaaaagctatgtccgcacgatgtgacaaatggtatgatcattaaatcctggcatatcgtacaagttaaatgttcaacagtcttgcatgtaagtttgctaaggatctcatactctctcgaaccttgaaagagcttcttgaggtcaaattcttctggttctttcattatgtttgcgtaatatgtatgtcatagcgaagaggtaggaaaaaaaagtaagccactatctaagtgcgataccagattaaagatgaacagcaccatagtcaatgtattgcttacacttggcgcatgcaaacatgcaaagaaaacataatcaacggcggctaagggcaaagaaaacaagaataaaggatgaaggttcgatcgcaaagagaatgtatctaacagcttccgggaacggagaagacataaagtctgatagtcgggctggcattcagccaaaaattgatagttttgaagtaatctagcctccttgagtcatgtccacaaaaacgtaccatacatctggcactatttcactgtcttggaactgagtaatatgctgtattcaacatgctaaatattgcgtatattatttcttatctttaataccgaagcatgcacggccagtgtaaaacaatgtagcagcaacagagactcccagcaatccaaagtatgggatcaggtagtatttggatcttgggtgggcagcataaatgggtttattggtggattggtaaaacttttgtaattcaatgatcttttcagtggctgtaggcattttctatcaggttagcatagactttaataagagagtagaccagctggaacttacagttattgtattgtgtagaaggttgtgttaaagaaaaaaatgtctttcgattctggaacttactgaacgaccaataagcgcatctgaattttgtaattagcaaacatccgaacatcgctggaaagtgaggataaacacacgtatggagcgaggagagcatttgatcctacgtacgtgaaatggattcggtatctcttcgtagttcatcgataccctaaacataagcgttttacagctacaaagaaggattgaattgctaaatatattggccactgatgctaataaggatacaaggaattgatctactacgtaatctgagaacaatgttcacatacatgaccttcgtagtgaggagcgaaaagaatgagtgggcaacttttaaactgatttgtttatacagctgccggcagattttgcttctcacgatattcaattgaacagtctgtgtgtttggtactgtcgttctgctcggaaaaaaaagtctctataccgaactggccttaacgcatcatcgaaaagctggagttcctgaccaacgagatgaagatgaaattaagcgcaaacatacgtcttagctccttgacgaaaatgtaaattctacttacctaagagtatacaagacgagcatcgagcttaatcaacattctcataagctactttgtctcacttctttaacgtaagtatggaaccaattccctgcttttatatcccttcaaggttggtgtttgctaaggacgacaaaaaacattgataaacttgtatgtttttggtgaaattctagttcgactcgtaatttattctagaattgaagcctaattttctctctttatcttcctggttatgctcaaaatgttactgtatattatacaagtccaaaaataactatctaattctcttctaaattatcgtccgtcagccaagccttcgatagttggacagcgggaaacgtctcaactaatgctgattgtattgccgtagcatacttttgcggtatatcattctcgtccacgctaacttctttgtatcgtacggacaacttgtaacatctatcgagctttcttgttaactccagggaagatatttcgacttggtttaaatcttcatttaccgattcaacgctgattctgtctctattcgttatcactctgagtagcctaaccatgaccaaggctgaataaacacagataaaatgtacctggtccgatagaaatgcaaaatacgatgaattatcaactgagttaatggaatccaaaaccttttctgtatggtacagcattgaacgcatagagacgctgtcagcaacatcgagtattcggtctattaccgaactatcttgtatgctaggataaataacatctgttgtttcactctgcaacttcttaaaattccaatgaaacaagacgagaaagtacccataatgataacctaactctacaaattgattagcaggttgttcaaaaagataactccattgctcgagccatttgactaactccccacgagctacttgtaaagatttctctttggatgctgactgactgttcaaaaactcgcagacaattagttgtaatgagcattcggccaccatacgaccatcaaaattggtagactcagggaggtccagcactttcctaccagaatgaagattcaacgagttaataatcgagattctgcctgacagaacactattgaccaaatgagccagacataaatggttccatagacgatagacagttaatctttgaaactcttcggaaattccttcaggtcgatcagagattagatttccagctctctctttggtaatgaactgttgtaatgcaacgcctgaaagaaaccatccatctactgaaaatgtttcatcagaaagtgtcaacgcatagacgctgagtattactaaagcttgcataaattccaaacattggggcattatcatcaggttctggttgagctccttcatcagtgattgacgcaaatatttttctgcgtgctttcttatgtagggatcactatacttcaaagataaggagcaggcaactataagcagtaaagggcatttggacataatccgatccaacagcagttcggttgatatgtgatgagcaaatgacacccatctaccatatctctccctaaaagtcgacagtagctcaatcgcttgaggttttgtcaaaattcctgctataaaaaactcggatccagagttcctgacatggtctcgaggcaacgccaagtttgataatggtataggaagattatctattgcaacacactgagtgaatgatgcaaacggtgaagtgataaatgtggaatgtgcagctcccaaactaggtatgtcggttaaatccagtttcgacccaaatggattcaaggtgacttcattgtaatcagtataggttgttatttcgtcaaaattcttttcttgttcagcatagccagtaggcctgatttgatctaatcctggctcatagttaccttgtctcgcttgctgatgttgtttatgttcaaacttggactcaactccaaattcagcttgcacttcatttgtgtcgaccaacgaaactgcagccggttcagaaaggctgaaaccctctcttctcaatagtcctaagatctggctaactccagcttctaaagtcttcaattttctgtctatattcaagttcatttttgctatcggtgacagcttgaacacttggctttctggttgaatggtttgcttgatatcaaacgaaccgttttggtccaaattgggtaagcatccaattatattctcctttgaattatcaggatctgtcgcccgtttgagcaaatcttcttcaaaggaacagacttggctcatcgaggcacatcgaaggcatgcgatagaatctgaagaaggaaaacaacgagtcttctgtctccgacaggatgagcaagcctttgaagctctagaatacaaaggtttcttgggtttggtcactttgtttgactttgtggagtcatttcctggaagcacaggagccatttctcagcttctctctcagtttttaaagtttgtcgaaatattttgataaatgctctgtacttgataagaactgctatctttgatttcgcgacagaggtgaaagagaacagaatccatcacctccttacatcagaaatgagagtgagaattcatagcctaccaaaacaaggactcagggaattgataagtttaccccacaatttcgcttactccgcggtcatgtatgatggatgatccagtggtatagtccaaacgaaacattcgacaaagttctttttgcttctacctagaggggtctcaatttacgttaaagccagtcgggcatatactcgatcgtataaatagaaacgttttagccctcgttttcaccataccattcctttttcctgggtattctactaagaccaaaagagtacctctccacactaccaaaaccatgagcaaacaaactccgtcaggaatgacttttatttccctagtggatgattcaaatgattctcctgtaactcaatctacttcagccgataaggacgagaagcatacagctgtgtcgcaggagcagataaacgctgctggaaagaagcagaaccaagttgatgacgaggaagaagaggagcagaaggaggaatacaaacgttctcttgaagaaattgaaatcaaagatgctgcttattacaagatgacagatcctgttctcctgtatgatattccggcccaggttaattcttctgatgagtacatcaaatggtctcccaatatcgtacagacgagaatgttgctcaaccatttgcaaattccatttgaagtacaatggttaacgtaccctcaaataaagccaaccttacaaaagttaggtgtcaagccttgggattcagatcctgagtatactcttccagctatttcatataaggggactactgtgatgggcagatccgagattgaggaatttgttaagcaaaactttgaccccttatcaactccaaattttacagattattttctggacatcgaagaccgtaaatttaaccgagctatttccaactattcagatcagattcttatggggaagctttctttcccactgttggctttttcggaaagtattgtggtaaaagatgagaatgaccctgaatatttccaaagaacaaaaaatgaaagattcggtgttgactgccaggctttggtaaaggataaagaaaagattcatgaaatggtggaagccatttgcaatgaattgcctggatttatggagctatatgattactcggaagctgagaacgctgatttactatttctgaaagtaaacaagtatttgatgggctttcacattactcgtgctgatcttattattgcatcatatgttttctggatcaagactgctgttaaggctggaatggaagaacactcatttcacaattattggtttgatgcttggtataacagaatctccaaacttcttgactcccccttcgatggctcaaaggttgaacaagaagcgcttgatgatttgaacaagaggatagagggctctcatcagaatcgtgtcagagagtctggggagcaaattgatgaaaatgacaagaccgagaatgtcaatgaactcactgaacctgccagttcgactgttgagcagccccccgcgtagttttatttaggcgtcttagttcaaaaattacataaatattagctacatgttaccaacatgcagacgaagatgtcgtaaaatcataaacttttcattccagttaataaatactcattgagctacacgaccaaaaactttgactctcttcaccccaccatcaggaataataaccagcttgacatgggtaaaaacagtctttttatcttgaacttcataactatgttcatggtcagaacctgttttactttgaggaactactattttccagccttcatccaaaggaggtgtggtttctccttcatgataagttccttcaattctgatgaactgaggaaagttacctctaaagtgagccgtatcaacgacaatgtgatcaatgtttgttttatcaccaagtgcgataactgcccagtcaatgtgacccttagaacgtgatcttttcgtctcccatccatcagacatatcgtggccacgtcctggaagcaaaagattgtctgcggatccaaaatgttgatcactgaaagcctgcacaacacctccgttgttaacgtttgccaaatcaataatggtattaacgtcacttggtcgtataggtaccacttttccatataatctgaatctagctattcctccatcaggatactgcttgagtctgacgtgggtgtaggcggtttcggttatttcgtctctgacaaaaaaatgtttctgggatggtccacattcttgtttatcaataatcaggtcccatttggcagaatcaatattttcatccgtacagatagccgcctctactgtaataaaaggggcatgattaccattaaagaatgctgtatccacttcagctccaattagctgggcactggaaactcccattttaatcacaacccagtcagattcttcctgattatgtcttctagtttcccagccgtcataccaggcgccagtgtggacaaatctagtggcgtctctgacaggggcagttggttttaaaagattctccgcctttgcaaaaaactcatcactgaatgatagtaccttgcctcctagtttctcaccgattacatcagtatacttcaacaccacctcatcttggaagcgttgttgatcagtcctagtaatcttcatatgcagctaccagattctgtaaaaataatccattttctggacggagtacaattcctttttatattcttgtcatgtccgggttatcttatcggctgggtatttctatctgaaagctaacttgcgcgccgctagcggcccgtccagcttatcttcatggttccccttcccccgccaaataaaaatcgagctcagaaatgtatgcagttgttactaagaccgaatctactcagacccggagctgaccgtgcaagatgaatggcatcgcacaaatccgtcaatacgaaaattgaatcggcgtatgggatttttctctatttcctcttggtctctggagtgcaaagttttctcaatgtactcaacgttaccttttctatctacgaggataattgtttgggttctagtgccataatagtcacccgcaactggattatctatattgttcggatcatgatagtagggtgtctcaataggaggaatgaaaatactttctgggaagtgttcaaacgccgaaatgtagtctgttctcaggtttggatggattcggtcaatcgataatatcttgaaaatttcatcgattagtgtctcgtgtcttgcatggtctcgggacatgttctcgcctaatgagaattcagaagcatcataagctttcatcaggttactaagctcttgctgcccttctatgaccttcggccaaggctcaaagaaatgtgagttcgatagtccaaattgatcggcgtcgacaaataccttggtccttttggtggacctattagtgaagacgctcaatgggcaaatgcgtccgtcatcgcccatggataattggccgtacattaaggaaaaacctccaatgctcttcaattctttctgaataaaatcgtctggccaatcttgaaccccgtgggaacactcaccatagcttaccttagtagatggcctcaccttcttgcttgcctcttctttccccgctttgtttggctttgcacaagttagataagatataggtaacagccccctggatactttccctctatggttgacttcaatcggatctctgtagttgaccaaaacagcaagtcgcccggttgtagtaattcctatccatgtccctctttcttcacgggccagatcataaggtgagatcgtctccacgccatcaaccagtcgcatctccgcctcatgagttggtctcttgaaatactcatccctgtttgaagcaagaacaagagaatactctttcgtgttggcacaagtaagtaaaatgcacatgatcaatactcaccataaagacgacttagaaagtttgagttgaaactctgcgctttccgtttgtatacttttacgtaagctatacaaactcttaccgacgtgttatcatgcatctagcaatagtggagttcacactggtagtgcgccaatcataatttgtaagcttctctccttgatttaaatgtgtcctaaccaaatccctctttttcatttcattggacagtgttggaaaagatccaaacttaccatcccttaccatagtttctcctttgaacaacttacaagaaacaatggttaacgtcaccagatacgcagttccaattctcaaaccatattggactttttttgccggggcaggtatcacctactacttgatcggcaaggctgccaatgcttctatgaatagcgatgaattcattaatgatccaagacatcctcgttttaacagaggagagaaagtcattgacataaaggctttaccatgatgtccgataaatttacgtttagatacatatctaatggaaaaaagttccaattgaaactgaaaaagaagaaagtaggaaagattcaaaaagtaaatttattccatgacgctttagcttattctatactagctattttctttttgatgtcaacctcgcttgctgtttgcaaggcctctttgagtatggctaacaactgaagttcgggttccaaaccgatactaatccggattaaattacggtccactccccacttttcgatctcgtccaattcctggaaatgtgctagaatcgaataaggacatgccaatgtgaagtttgtacctagtgaagggcccttgctcaacttcaagctgttgaaaaagcactttgctctttccgcttcaatgaataccagtgatagcaatcctccataccctcctagtggtgtcttaatcttatcgtagtgctcttttgatcctgacaaggatggatagtagatctctttaatgagggatgaattggaaagataatttacaactgcctccgcgtttcggtttactttatctgaacgtgtttcaaaatctcgactgtttctttccatatagatgacatcttgggcccagtaaaggtcttcaaagcgagaattgaagtacgccttcaaggattcataatgaggggagtctggattcaaaatcaatgacccacccataacattcgaagctccgctgaacactttggttaaagaggatacaaccatgtcagcatatggaagaacgtggatattaagaaaatttccaattgtctcatcaacaacaactaaaaagtcgtatctttgagccaacgatttaacacgtagcagatctggcgtctttaggagagggttggaaggacactcgcaaaataagctgctgatcttcaatccggatgccagttgctgttccagttcgtctaatgatgaatcatcgcccaatccgtagaaatggaccccaggaccaaatttctttagaatgtttagcgtgtctacatagggaaatccgaaacatacagatttcctgtcagcatgcccaatactcagaattgctaaatatgcgttgaaaatggaagtcatccccgagggatacaaatacacatcgtcttgcgataattctgagatggctgctctttcagttgatgccgagccctcatcttgggactctccaatttttccggcaatcctccgtttaagtagggatttagcttcattgtggaacctcatgtcaagatttcgaccaaagcgctcctcgatgaaagtagaatactcattagtattgttattgaggtcgacaatcgaagacctagacgatctcgatttgcgggatctctgcccaacttgattattgcctggagaattactccgatggtcctcaattccttcggccaagtactttaactcgtgcagacaatattctcccattctagaggatattccctctccagaatgttgccaatattgtttggctacactgaattcggaagctggaaaaaatgctatgctgatatgggtttctaacctgtacgctcgttcgtcctcattcttaggactaggtgtcgacagttggaggatacgaacgttgacttggtccaacttagtatatttttttatgaactctcggcatctcttagctacattgtaggtaggaaataccaagcagcgctcactttctcttccataacaatcttctaatagtttgcagagaagtttgatctcttgatgaatgaaaaatctaggatacccagtggacatcctttctaccacccagtcctctccttcttcgtagccaacggtagcttcccatgtcggaagagtgacggaaacagcatgtgcggtattattgggaatagagtcaccaattttttgggatatcatgtgtacgaagtgactgttattgtgctttgggcgtttatacagggattatgctttcatgaattgacctctgtatcgttcctagtgggagaaaatcgagtctttctctaacgttcgtccctcaatctaaaataagctaaactgaatcacaatttgagctttgcacttattttacttgttggattgatctatctcgaaaataagtcaaagttcccacgataacgacgttcaactataacttcgcccgtccattttcggctaaagctaacttgatcactgtacttaattgattaaaaaaaggaattcggtttgaactttggcctgtcatactatctacgaaagaattgaagcttcagcgttttgagttccaaatcggttcccagcgaagtttattacttaagaacacatccgttccactcaattccgaaagagaagcgacctaatgatggcaaaagcgtttttggtattcatattggcatattttctttactatttgacctctcatattacaaatttctggccggtacacactattgttgagcaaccaggacacaatgagatatggaaggcccgaaaagatgaagttcgtaaagtgtttcacgagtcatgggtggattatgtaaagcacggttgggggaaggatgtgtatcatcctgtctctcaaactgcagagaatatgggtcaaaatcctttgggctggattatcgttgacagtcttgatactttgcacttgatgaacttgagtaaagaactaacgcgtgccagtgattggattaaacatgaactcgactacgactttgattatgaggtcaatgtatttgaaacaacgattcgaatgctagggggcttcctatcagcttttcatctcaccaaagacaatttgtatctggacaaggcagtagacttggcagacagacttattggcagttttgaatcgaactctgggatcccatatgcgtctgtcaacttgaaaactggcaaaggtgttcggtcacatgttgatatgggctccagctcaactgctgaagtggcaacactccaactagagttcaagtatctttctcaattaactgggaatagcatttattggaaaaaggttgaacacattatagctgttttggattccaaccatcccacggatggactggtgcctatttatgttcaaccggatactggctcatattggggtaatctgatcaggttggggtccaggggtgactcctattacgaatatcttatcaagcaatatctgcaaacgaatgagactgtctacaaagaaatgtacgatgaggctatacgaggagtgaagaaacatttggtacggaagtcaatcccaagtagattaacatttatcggtgaattacctaatggtatcaatggtgagttttctaataagatggaccatcttgtttgtttccttggtggaactttagcagttggagccaccaatggactaaccatcaatgaagctcgtcaatctgacttttggaaccctgaaagggaattccagttttcacttggtaaagagcttacccaaacgtgctacaaaatgtatcacgacgtttcagcaactggtttggcgccagaaattgtggtattcaatactgatagaaaagtccagcatgatttttacattaagcctgcggataaacacaacttgcaaagaccggagactgtggaatccttattttatatgtacaaaatcaccagagatccaatgtatcgtgactggggctataaaattttcaagaactttgtcaagcatacacgcgtaaccagcggcggaagaaacaacaatgttcgttactcttgtttgcaagatgtcacagcaactatccctaaatatagagacaacttggaatcattctggtttgcagaaacattaaaatacctctatttgctcttcgatgatgatgtggctgaacaatgggatctcaataaggttgtatttaatactgaagcacacccttttccaagattcttccaaaacctaaagttcaaaactggctgggagagagttaagcctacatcacctttatcatcgtagaaaacacattagtatagaaaatgttgcatagagagaggacaagagcaaagtgtcaatttgaagctgcaagttctgccaacttttagccaatgggataatggagaaaaaaaaggtgctacgcagctaaaagaaacagttagaaaattgtttgaaaattaaaatttaaactggttcttcttgttacaagtatctacacttcggcaatgaaacaaatgtcttcttcgagaactgaagataggtttaaagaagtaattagagccaatgagctgatgaaaataaaatgacctgcaaaatgaaagcataaatatcacaagagatctgcaccgtggtcacgatcgtcaataagactcactgccgctcgaggacagagttctttctccaactccagtatgctccatcatctgtccctgtatcaatggaagcctctctcttgccaaatggttggttcttctcgttgttcctccatctgaacgcttctgcttctgcttctgcttctgcttcggcttcggcttctctcttgccaaatggttggttcttctcgttgttcctccatctgaacgcttctgcttctgcctctgcttctgcttctctcttgccaaataggcggttcttcctgatgtttgtccaactttgtgccagtctttctgacaaatcaatagcctcaatctgtgctatcttgttacctataagctcggtagctaatccgatgtcatctagaaaaaacaagtttactccctttcttaacttcaatgacatgattacggcctcatcaagaatttggttttcaacaaaatgtttgccaaaatcttcttctttgattgtagacatgccaacgccgacaccatcattagtatcagtgagtgatgaatcaggttggttagcaaaaatgctttccactggcgcactggccgcagttgatgtgatagctaaagttactgaaatgatgttcaaaatgagtgatttcattgcttatcgaaccgtcgaaattcctggatctaagttgaaggaagacagaattgaagagaatttatagaagaagcgtaacttgtttgaaacccttgtcagctactattcaaatcccatttccgtattcgatgaggtgatagggacagatgcaagatatacacacccaatagtttgtttcattgaaaagaaatatcctttgaagcctcaaattggtaaatctttaatgcatacgaaatctaagggtacatacagtgaattgcccgatttgggtttcaatggaaatcttgacgaaaaccttgagggggttgaggaaacatataaaatttgtctgcctgacttgacagtaatcgatcggtgcaatattagcattacatgtttttgtgtacatggttgtcttgaacttaggaaatttggttcactctggtcttcatcagtgcaactctttttctttctaaactggcaagggtcgagtcttgaacacacatttcttttcaatgatatcaatgaggtggacctgttttccactttcatgcacactattggtgaatttcaaaaggcccaacggagggttaagcttttcaactgtcccatttaatctttgagtattattaactaaaagggttacttggtcagagccctcggagaattgtaactctccgatcttgatcgccatcctatcggcttgtcccttttcttgctgagacagttcgtctggtaaaactccgctcaaattgtcttcaataatcgtcttggagtctgttctttcctcattcaatttacttgtcacttcggttggaagattcagaaccccttgaatttctacgactacaagaccatgtggtgtcgcaataactgagtcttgcgggtattcagagttcgataaaattttatgcagttgagagcaatcaatttttacggatggcatgaagacaaagtaagaaagtaagtattccacttggtccaaagtaaagagtattgaatgcgcgtttggtatatatgtatgtatacatttaagtgctctcagatttccgccacctctcctttcaatttttgcctgttaactcctcctattgaattaaaccattcattcaaaagctgtgtctagctcctcttgaattatcaattatatggcctggttaccctttttgcatgggtcttcggataggttcagtgccgataagtttgaaagggagttaaaagccatatctacgaaaatccttaaaaacgaaagaaagtctatacgctacaaaagacaatttaagcaatggagagcttccctcttgttctatatcagcattttgtacacaattttgattgcttatgaactgatctttatttcacgtggtcggcaaatgtatatccacttagtggtaatccctattggaatgttattgtgcgatatgctctacaagaaacttttcaatatcatgatgagacgtatagaaacaaaccttgtggacctccgaactcaacataaagaaaagattgaaaatttaaaggacctgtcaaacttcaacgaaacttcttctttgttgaaacgattcactgatggggaagatctagaagcgctggagagagaacaggcagaagcagcaaggaaacaacaagaatattttaaattgcttgaaacaccacctccagtcttaagtggcgtgccaaattcgtcttctcgtccgagttctctatttgaacctattatgaagctgctccttggagaggacgagatgtctcctaacaatcgatatgccctgatatgcactctttgctatcaaaataatggccttgcacctccaggtgaggttccaggggaagtgaaatacatttgcatcaactgtgggtatctcaatgtaccagagaaagatcagttaccaggcgtggatggtacggagaacgacaccataaaccagcggatgtctgatcatgttcaattagatagtaacaagactggagatgaaggagctaaagaaaaaaataaggaaacatagtatattatatcctaaacaatcatcatttaagaagataaagacataatagcgttgaccatatcgccattgtgagtcttcaatgccttaatagccttgtttctgctaactcctgtttgttcaacaacgatgtcaatatcggcactatctactccagtggcatcaacctcctcgtcatcgtcatcgtcctccttatttggggcattggctgaggcttccaagtcggcagtgatagatgcggggtccttagaaggtgttccttcggcatcaacagactggccagcagattgggcagcctgctgagcagcttgctgagcagctgcagtctcagcatatcgcttgttcaaatcttcaacttctgcctcaccgaagacaacgtaggacccagctggggtcctgtagacttcaggggcactaatagccaaaatgtagttaccctttttacggaaagtgactctggaaattcccttaacctttttcaagtccaatttgaggatagcggctctagccttcttttcattcttagagatgatacgaacttgagcaccttctgggatttcttgttgggaaacctcggcttgttcgttggtctcttggttctcagttatttcttcaatctttggttcttcgacagacatttttcaagtattgcttaacaattacttagttttggaaagaaagtaaaatctgtaaaggttttcgtccactttttttcaccgaagccaaatgaaaaagaaataagaactgccattacccgcctccgatcgagttgatgaagcaatataatatggtgtatggatgttttgtatttcctaatctgtttcaagtttaccttacgtaaacagttcagccttagtttatccaggctcgtccatcttgaaaggacggataaaatacccggcttactatctacactctttagttattgcaggcacatcgtagcttttcaagtttacagatcctaaatcttgacttctcaagcatgagtttcgatacagtcgtttcaggtaaacatggtggactgacagagaagttgagattgattgcctataaatacggaattcccggagtaccccctccagaatcggtgtcgaatgagttacgagctcagtctaggaaaatctatattaataccccgttgccttctgatatgtatgatgaaaagggccatctcaaatcacattatgccagaaataaaataagaaccaccaagtacacccccaccacttttcttcctaagaacttatttttccagttcaccaatattgcaaattcatactttctactaatcgtcatattaggggcttttcagatttttggagtccccaatcccgttctttcggcagtgcctttgatagtaatagtagtaattactggggtcaaggacgcttttgaagattataggagatctgtttcggaccgccagctcaacgattccagaattcatcttttaactggtatggagaatcacaatgttaataaagattcagtaacgccttggagacgtttcaagaaactttgcaccagagctacacgcctgacaggtagacttatggctaatattttcagaagaaacaaatctgcagccagtgatagtgttgaaaataaaaggaaagataaagaatccattcgaagtcttgaatctattacaacaattcccacaaaccgcaattcactttcgaagattcccaccaaggaaagaatcactctgtcatctatgagaaaatcatttgataaccgcagtaggcgtaccgcagaagttgtccagggtacttgttccaaccctaccgtcgagccaactttcaaaccaaaattcaggactgatttttggaagagcgttgaagtgggaaattttgtgagggttaggaacaatgaagaagtgcccgctgatatagttataatagcaacttctgatgcggagggtacctgttttgtggagacaaagaatctggacggtgaaacaaatttgaagaatagaactgctctacattgtggtgagggaattagacatgcgcatgatctggaacgagcccaaatgatgatcgaggttgaacccccaaacgttcatctttattctttcaagggtgcttgttacttctctacatatgacttgcaaactggggaaaaactagaagatagatcagaacccattaccaatgaaaatgtccttctgagaggatgtgctttgagaaacaccaaatgggttattggagttgtggtttacaccggtcccgaaactaaggtaatgctcaattcaggtatcaccccaacaaagaaatctaggatttccaaggaactcaacttgtcggttattgttaactttgttgttttgtttgtgctttgttttgtatctgcggttgtcaatggagtcttctataatgagagtgatacttcaaggatttattttgactttgagccttatgttgattccgccgcagggaacggtgttgtaactttctttgttgctttgataatttaccaaactctggttccaatttctctctacatttccattgaaattatcaaaactgttcaggcttattttatttacgcagatgttaaaatgtattatccaaagttggactatccatgtgtgccaaagtcgtggaatatatctgatgacttgggtcagattgaatatatcttcagtgataaaactggaactctaacccagaatgtaatgcagttcaagaagtgtacagttgctggcaagtcatatgggttggcgtatacggaggcgcaacagggtatggacaagaggaaaggtgttaatattgtggatgaagttgataagtggagaaccaagatttcacgtgataaacaagaaatgttagacttgcttaaagattggacaagtaacgaactggatgaaaatgatttaacattcatctcaagtgactttgtcaaagacctgaaaactcaaaaagcttcaaaagacttcagctataatgaaaggttgatgactgcccttgctctttgccacacagtagtcacagaagacgatgcagataaacctggtagacctattttcaatgccgaatctcctgatgaggctgcacttgttagtgcagcacgagatataggtattgtatttcaagaaaggactagaaagggtgttcttgtttcaaagtttggtaatgcgccttctgagtttcgattgctagaaatcattccgtttaattctactagaaagagaatgaccactatcatggaaataccccctgcatactctccgagcagagaaacagagatcatgttgtatactaaaggtgcagataatgttatttatccccgcttaagaaaagatcaggacgaaaatattgttaatcagactgcacttcatcttgaacagtttgcggaagaaggattgagaacattatgcgtcgccgaaaagaaattagaatccgaatacttcaaagaatggcagcagcgctataatgcagcgtgttcctccgtctccgacaatagagaagctcttattgatcagttgagcgaagagatcgaatgcaacttaactctattaggaggcaccgctattgaggacagattgcaagacggtgttccagattcaattgcaattttagctcaagcaggcataaaactttgggttttaactggtgataaagtggagactgccataaatattggcttttcctgcaacctattgaccaatgaaatgaaattacttgttctccagccacaggaaaaggacaatcaggattcagatacattgtgcaagtactttgatggtttaatcagcagatacttgtctgaagagtttaacatgaatggctcagaggaggagctcaaagaagcaaagaaagttcacacaccagcagttgataactatgctatcattgtagatggagcagcacttgcagttattttcaatgagtcaacgggaagtttaattcgaaagtttttactgctgtgtaaacagtccaaatcagtgctttgttgtcgagtatcgccagctcaaaaagcccagatagtcaagatggtgaagaatcttcttggtgtcatgactcttgccattggtgatggtgccaacgatgttgcgatgatacaggcagccaatgtaggtgtcggaattgcaggtgaagagggaaggcaagctgcaatgtcatcagattatgcttttggccaatttaggtttcttactaggttactgctggttcatggcagatggtcttataaaaggcttgctgagatgattccatgcttcttttacaaaaatgttacgttcacgttcacccttttttggtatggtatctacaacaactttgatggttcttatctgtttgagtatacttacttaatgttttacaacttggcctttacttcactcccggtaatctttttagctatactggatcaggatgtttcagaaacggtatccctgttggtaccacagttgtacaggactggaattttacgtctcgaatggtcacaatacaagtttttctactacatgttagatggtctttaccagtctgttatttcatttttttttccataccttgtttatcatactggttcgttcgctagtgcaaatgctagacaaatagatcaccggttttggataggtttattttgtgctcatatttcagttgtttcctgcaatatttatgtgtttcttcaacagtatcgatgggactacctatctaccattattgtgttattatcaatcttagtaatattcttttggaccggagtatggtcagcgggcacaatctccggagagttttataaggctgctccccaagtttttggaagtacttccttctgggcatgtttttttgttggtgtgcttgtctgtgtgcttcctaggttctgctatgacaatgtgaaaagagtaatgaagccgagagatattgatatcatcagagaaagagttaaattgggtgattatcgcctttttcctgagaggtatgaccccacagacttcaatgatgttgaagtgcatagaaagatgctgagtgacaatcactcatcccttgcaagtgattcactggatcaagcaaatagtgctgaacttgccgatttagagaaaaacgatattgaagcaaacttaaagaatgaaatacccaaggagtcaaaggggattcaacgagcactccgttcaattggacactcgattcggcatcctacattgacccctcctagtagacttgacattttgagaaagaaaagcttagagaatggatctataacttcactcgaaagaattcgtacaagtcacgagctgccaggtttaaccagggcggaaacactaatgagtacttattcttatctctctgaaaatagaaggtagttatcactccagcaattgatagaattttgtgcagttaatataaaccagtgcgctgagacgagaataatttcgtcttttatagtgagtgaactagaaaaaccgaaaaaaagctcctcatcaggggctcgaaccctggacatttcggttccttgttagacttaaaagccgaacgctctaccaactgagctaataaggacgagctcgtatccagctccataaataccaatatacataccgatttgtgccatttttcttagactaaactgtcataaatgacgtacgtatcttactcacaattaacccatcgcaaggtctaatttgaagtgtagattttacatttgattcgtgtccttcccactagtatctcctcaattgaactagaagctcatatcaagtcgcaatcattagacattcgacgacaatcctaaataatacagcgggacgttcagtgagttttattcaaaaataccgtaatgatgtctcatttagacgttgtctggaatgagcttctagataagcactttttacccaagtagtatactccgtttttgatattcagatacaagctctaaacaaatacatattgcaatgaatggtctctcttaacggttaatcatagccttccaaggcatctagcttcattgtgtgaagtggtgggcgaaagatgccctactcaggtattatgaacgctttgttatttttgccaaatagcatagcatgttccgctatccgctctaccttctcgtttaggcttaattgtataaaagttgcgagccttttttcaacagcagctaaattgttgaaagtgatcacatgtgaagtctttaaactgtagtcctttgaactaaagtccgaataaactcccagcagaaacttgagaatccttggggtcattggaatgtgtaccttgaattgagcttggcacactttcactattgggaggagatacattactttgagaatagttgttttgaacattttcaaaatcaaagttaaaatcaaaatccaacattggtaaacctaatgaggcatcaactccaaaatcttgcatcatcaaggagtctaaaccatctggagtcgttattcttttgaactgttgatcggtggaactggggccaggcatttgctgtcctgaaaggacctgtgtgcccggctgttgcgaaaacaaggaatggttgggattattattgtatatctgtcgttgttgggtctgcaatagaattggaactttgataggtaaatcttcctccttcattgaagtgactgtgccaggagggctatgggaggtgaatatatcgttaatggctccaggggtatcattttcgggtatcatttgttcattattctcactcttaataatattgggatgatgcatttggttgggttgcgggtaaagtgaagattgaacagacggagttctagaatctgatacttcaatgttgtgtgattttcgttcatcaccactaatatcttgtctcagtggcgaacttttacgcttagagctagaccttttcatctctgaatttgagccgttaacgcttgaaacttttcctggcagtgccatgatctgctccatagcattatcaacagcttccatacagggtactgagaggcatcccagcattccaatgcttgtctctattttcagctcgttgatgacgctggctagtaaaattttggattcctgaaacaatgctcctccccttgcatactctaacgatcctttggcagataaaaacgctaacctgaccttttcccttgacaagtttacaggtaagggtaagaaataaaaatttctttctttagttgccaatgtgtttgcaattgcaagtatagaagtggtggactgttgaatattgatataagaagcagaacttcgtgactgcgaagattcattagccatgagtggcagatagatcaatatttttgcatggtagtatagaaatagtatcgtaagttgattgtcagacaatctttcatattcgacaccaccaggggacttgtccaagtctacgttgatatggggcgacagctcacgtctccatagatctagggcatgttcatgcaacaggcaagtctcttcagtgatgttggtggatttagagacaacgcttgggttattgatggagcttctctggaatatcgagtccaaaatattgcctagaacttttgagtatctcattaccgctagagcacagtctgaaactttacccgcaagcgacagtttgatgttgttgataatgacagtattagtagtgttttcgatggagcccttcacattggcattatttgattcattactgaagggtaacgcgcattcaatttcataatccttcaacaatctggggacacctagtattagcgcactaaatgtgtccaaaatgtatatacaccaaaacaaaatccttctttctccttgttgcatctgagaaactttagatccatttgtccctaaaacagcagaaggacaacggtgaagtcgcagctgctgtcccatagtaatgattttcccccttagctcatagctggttgtcaaatctccgattgcaagacagtacaatagttgaagcgacaggctttcaagagttggtagcgagcaatcatctgatatgttcgatttgataaattcatgaataagatgatcgtaatactgaagtatctccacattgctctgacttgaagcatctggccggtggggatgaggcgttgaatctttcttgtaactagaagaaggtacagcttctctattattgtttctctcttgggacagcataaccattgttgtaatcaaaagtaatatttctccgaacttctcgttgccaaacattgaattatcagtgaacatagtctctctactcttgttgaatttgatataagagctcataaagatgtgcctgtttattattggaataaaattattccaagtgttgaaaaaagtggtaatgaataggtctaagttgacttggttcggaagattcagggattggaagaattgttgactctgctgtgatgtgagtttgttgaaattaacattcttaagggtaatattagcaaatacctcatcgtttccataattatacttatccttcagcaatgcaatagactttgcagttagtatcggagctttactttgaaacccatggacgttgcaaatctttgcaagtaaactggcaataaaaagcgtctcctccgtagttctagggatagacattgcaaccaaattagctagattaacaaatgtttgcgttcgcatcttgttttgaatggagatggccgctgccgcacccggtgcattggactgttcaaacgataaaggatcattgaaatttccactagaatatcgttgagaaagacgaaccatttctggaccggaagttccagtttgatgatattttgcattgtacgaagcagctgagtaaagagaatcgtcctcatcacttaaatcagtagtatcaatatctacagatccagctatcgaaactgggcgagcggaaacagaattggcacagttacaaggttctccgtccgcatggtgatgaatattgccagaatgagaaacctcttgctccttgtttaatagagtaaggttctcatttgttagagtagactcttggtcaattctgttcttgatttcaacttgctcattctttaaatcgataagtttatgcagctttttgttttcaaactctagctcccttatcctttcttctaacgtctcggtataccctcttggaaaagccctcctggataatttatcactaattttacattcaaaaccaacagcggcacattgggaacattgtggtcgttttccatcacatcttgtctttttggagcgacatctgtcacaggcctgggcgactcgttctatggacgaccccggtgctcgtatagtcttggctttgcttttttgatgtttcctttgaggagaggttacttgttcctccggcatcattttaaggagatgaatcgagacactaatcaaattaaaataaaataaaataaaggaagggaacgtcgggtggtagattgaagaaaagcttacacagttgaaaggttacaaaatctggagtaacagcaaaatcgagggtgagatagttagtacgaagccagctcgcgggagagctagtgagaaacttttagtcagagagtagaatgctacaggcatctcatcacaagtccacgtagaagagtcatatggaactagaatggttgttgttgatatcactactaatagattgcgatacagaacttgtcacaaataggatatcaatgagcggcaaaatgactacctaaatatagcgtctcttgtacagatgattcataaacctgcgaatcgtcatactcagcagcagttgcaactgtaacagcctggctgttttccgtccattatcgctaattgggtggtcgactttatcactcaattagttaggaccagtcagcggatctattttctgagctagtccatatttacggactttgtattcggatggtgtctctagagattatcaacaactaaattaactaccgaactatttattaactaggagattggaaaattccttgatgtcaataacaccatcattgttagtatcagcttctctaagcatctcgtcaacctcctcctctgtcaacttctcaccgatggaagtcagaacatgtttcagttcacccttgtcgatttttccatcgccatccttgtcaaatactcggaaagcctcgaagatttcggcttgactatcagagtctctcattttcctagccatcattgttaaaaactcggggaaatctatgcttccatcggtattgctatcaatctctcggattaaatcgttcaattcactctctgttggagtttgacccaaagagcgcatcacaattcctagctctttggaagtaatcttgccatcttgatcttgatcaaaaagggaaaatgcttctttgaattcagaaatttgggcttcggacaatttatcggactaagagttgttagtagacaattggctagaaacaatttatcaatacttaccattatggcagtaattacacggtacaaagtgaggagcaggttattttgagattcaagagaaagtatctctttaggttaggacacgacgagcatgttgtcatgaattttgtctctataagatctctatttgcatgtctcagttgaaggaaggcttatttaagttattcgatttgccaacatggtgctggttattggtattcgtctacgccacaattccgctgacattttactactttttgccaatgttaggtagttgtcttagaaagagatcgtgcattgcagacaaagccgtgatcctggttatgggagacttaggccattctcctaggatgaataaccacgcgttgtctttcagtaggattgattatcaagttgaattgtgtggatatattgattccaaactagcttttgatattatgcacagcgacaatatttcaattaaccagattcaagccttaaggaatactgtaggtttaccatactttctttttgccatgtggaaaattgtttatcaacttctccagctactaaagttactgatgagggttatgcaagattctcggtatattttagtacaaaacccgcctgggataccttcaatattagtgattgttattctcaaaaaagtattgtttccacattgcaagttgattatagactggcataacctgaattacacgattctaaatttgaagtatcaaaatttacaccatccatttgtcagattcttgagattctacgaattccagatgtcaaaatatagtgacttgaacttaacagtaagtgaatcaatgaataaatttcttcagacagagttcggaatctcttcagcaaaattggttacactctatgatagggctcctacacaattcaagcctattttagatccatttcaaaaggaatcagtcatgaaagctcatccacgtttgttccaacacagtattttcttcagtaagattttagtcacaagtacgtctttcactcaagacgaagatctcccatcatttttgaaagctttgaagtttattgattgctctttgaagtgcaaaattctggtgatcgtcacaggaaaagggcctctaaaaaataattttgaggagcagtgtaatgctctcactttctccaatattttggtcaaaacttgctggttatctcctgaagattaccccaagatcctagcgatttctgatcttggagtatcattgcatgtatcgtcaagcggaattgatcttccaatgaaggtagtcgacctctttggatgtggggtgcctgtggcttctttgaagtttgatgcaattaccgagctcattaaggaagatgtcaacggtgttttgtgcgacgatgctttcagcctaggaactacgatacaacgtcttttcgaaaatgccgcagaactacaagcgttgaaacaaggtgctctagaagaaagtttaaaggagtggaacgtggaatggaataaaaaactaggtagtttgttgacttagcggagatatggtacttctgaacgatgacaatgttgatcaccattgtccactattgggatacagaatgaactcttttcatcttgaacgcatgagtggaaatatatcataaggcgtcctagtaaggaaactctgtgattcgatctcgaccatcagaattattgggcatatcttatgtattatttgtatatatagctgtatatctgctattgttctccgtttggctcttacggaacgtgccaaaaagtatctataccaatccattagcaatatgcaaccaattaccttgatacaccggtcgaatgaacaggaactgtaggaatgcttagaactcgtttattattcaagggtaataccaagcaaccaggcacgagtaaagaccaaagatagtcaagtcagaactcttgatcgttactgagttagtactcagtaaattgatatcacgaaccataaaggccgacattagactataccaagagagaatcatcacctaaaagtccaaagcatctctagcccaagtcggcaaaatgaaagatgcttcgtgtatttttttgttgtagtaacgcaagtgctctttctcaaatgtgtcggaaaaggatctcaaagggaacttcaaactagcgttaggatctttgctacacaccataaacccaatctgacccgatggatatgttggaatggtacagtaagcgtattcaacaacaggaaaaacctctaaacaagctttcttaaggttcttgatgatctccatatgaagccaaatattctcaccttgagtagtgataactcccttctcagtcagtgcgtcatttaacaatttgaaatacggtttttcaaacaatgaagctgctggtccttctggatcagaggagtcagtaataatgacgtcaaaagtgtttttgtactcgtccaaaaatttgaacccgtcgccaatatgaagtgtgactttgggatgcttatatgatttagccatttctggaaggtagattttggatagacggggaactgcctcgtcaatatcacagagaacagccttctcgacacattcatgcttgatcacttctctaagaacaccgccgtctccaccgccaatcactaatacctttctggggttgggatgactgttcaaagccaaatgagcaatcatttcctgataagaaaactcatctctttcagtgacttgaatagccccatctagtaccagaacgttaccatagtcagttgactggaaaataagaacatcctggtataaagactgttcaacgtgtaaaattttttccactttaagagacatggcttggcccggccacattgtgtccgaaatttccataaaccaaccatcttttatcaggggatgagttaattctgacattgtttgagtaactagaaagtttatgttctcactttaatgaatttttttttttcaaatgaacacccaccatgcagaattaactgttcgagggttcaattggtaccatagtttagagtggttcattagagtagaacattgaaggctgaatctaatttacgtataacctttgaataaagagtttgatattcttaactactggaccccgaattgtctggagagttggatgcctgctgcaatgctttgaactctggcatcgagcttgtatccctcaaaggagagcctctctaagttctgcgatatttcttccagtggaacagtgaatgtttcaatgaactcgttagcctccagttcgggaacagggttctgattcctttcgtctttcatatcgacagaaacaaatactagatacatatttgtattggtgaatcctggatcgttgaacattagtggacttttgtaggtcaccttgcctatataccctgtttcttccttcaattcacgcaaggcgcatgtctcaacagattcatcaggatccagcaagccagcaggtatttcaatgcagactgcttgcagcggaggtcgaaactgcttttgcaatatgataagcggacctttaggagattcaataattgcgatgataccgacaccatcgacgtcactttctgcggcacgactctttctggacgccatttcccaatctctttcctttcccgttggatctaagtacctgattctttgcattcttacccatttggcccttgagttgctcaattcctgaaaagcaatcactttggcgtcttcaaggtttgtcattctggaagtatgagaaaagtatgtaaggcaagggcgagaaaatgctactaagggccgttcaagctttgtaagataggttttaagcatgactaagacgcggaagtattcgaatattcgagtaggagattaaaagattcggattagagaggtggaccaaggaggtgagagtgaggtacttaattgtctgactaggacagacaagaaatgggtatttccgtgcacatgatgatccaaacaccatgtgggatttgacatctgctgtaatctctatcttcattacaacagctttcctctgaaaaaatcatgacaaactcagacgtacagcatctgaagcaacaaattcaagatgttctggtcgaatctggaaaatatgatgaactttcaaattttctgaggtcaaaattataccaggtgggttggactgacgaaattaatagattgacccaatcgattgtaaccaacgaggcaaagccaactttcagcaatgtaattgaaagaatagaacctaaagcgatggatattgttccagaacatattaagaccgagatactagccaaaattgaagaattccttaaagatgtcgtacctaagtaatacaaatctaccaggagtattacttttttgttacatagtcacttaaaagtacatattacacaatatagagagtgaaggcccgcttgagaaaggaataatgttaggcacgagagttgctgattgacggtgtttcgttttcaggaaccaaattttgcaccttattttctttgccgatttcagtagaacttgataccgggccagttgttgatttggtttccagttgagcttcttccgggttttgctttccatattgggatccactttcgaattgttgcttgtgctcgttttggtcttggtcttggtctaggtcttggtcttggtcgcggttccgatctttatgattaggcatattctcggactgattcccactgtctccttcatcaatagcatctacgtcaacaactgaatttttcttttcatcagcatttggcgatgattccttttcgtcgtctaacttattgacctctggcttcttttgctcatgaatgctgcggctcatatcaagggtttcttcagtttcactcttgtcgttcccattaccattcttattgtcttcgctaccggattgtcttctctcttcctggttagttgtttcttcattgttatcgtcttcatcatcgtaatcttcatcttccttcacatttctcagcggagcttccactacttcggcaacgccagatacttttgcagacttctcttgagaaacttcttccttgaattcttcctcttccttctccattggcttcaaaacactattctttgacgaatagggactgatatttccttgaatatcagaagttgccgaagcagcaatgtctggagtatcggactgttgaatttcgtccgggttttccgatatagtcttgacattgacgtcttctgtgatgtcggttttcttctcctttctgccggggatctcatcttcatctgtaagtcgcttactggggatcgagggactagatacttggtcttgcacagcttcggccgatcgatttggaattgcatagggcaggggtggaagattattgttaggaggttccgttgtctgttgttgctgctgctgttgttgcggttgttgttgaattgggggaggaaatgtgttacttggaaacgaaggtggcctcaaagagtttccgttctgtcctacaagttgttgactggactctgaagcggtcggaatcataccttgaggtagtcttggttggtgctgcgttggtggaggtaacggcactccttgattagcaccaccttccttctgatacttgataagttggtttaacctctcttgaatgtgaggattattagggtccaatgttgcagcctgtttgtacgcgtctaaagcatcacttatttggttgttgcaagtctcgtacagtgtacctagatcataccatacttctgagatgtatggattgagccttattgctcgcgtgtacgcatccaaagcatctctatattgtgaaatttgatagtagagaactccaatagaacaccagaatgttggattccgagcatctctatttacagcctgttgatacgcatcataagcactagtgtaatcaccacgagacatatgtaccctacccaattggtaccaggtttgggcatcagagttatcaagctccaaagcttgagctaaaagccgcaaagcagcatcaagatcagcaaatgaagcctcctgttgagcataaagacatcccagttgttgcagaaccttagcatgacgtggattagcctgtagaacacgctcgtaggcatcgcgagctccattgaaatcatgctgttgttctaatacagcaccaatttgaaaccatacgtctggttgagtcaacggagaagggggaaccggtagaatgtaccgaaaacactctagtgcttgctggagttttccctgatgcttataaatgatgcccaagcggaaataaatctctgatgctttttcgaagttaggatccatttgaagaacacgtgtgaaagattcttcagcatactccaatgagccatatcgatcataaagaataccaattccatgccacaacttcggagcattagtgttctgcagtctccgcaacgcttcttgataagccgtgtaagcaccaggaaggtcatccaacattagatagcagtggcccaataatccccaagtctcaccgttatcaggttgaatgtgcaaagcacgttgaaacagttcagctgcttttccaaacatgtctctagaacgatatagattggcaagcatagtcagtgccttagggtcatttggtgcaaacttcaaaacattgttgtatgcttggaacgacttgtctgcatcgtctaaagtctcagcgtacgagccaatggccaaccaagcctccgcattgtttttatcaaatacttcctggatggattgggcctgctgttgacgttgggttagctgttgtttttcttccatggggactacttgttgttgtggaggcggaggagcagattgttgctgttgttgttgctgatgacccagttgtggcttctgttgggttacattcatatcctgaaactatgtaaccactgcaataaaaaaacttccgcttccccaactaatgttcgtgtgtatcgacagaagtgaaagtgttccttttgtcaattttccagtattcacagttggaaacccgcaagtgttttggtcgtagatacacgacctcttctacgagggctccaacgcacataaaaagaaactgcgctcttttatccctaacagtaatactgaacaatatagaacaatacacagctgcgcaacccgcagatttaaattataggtatagagatattggttgctgctcttagacaacaggctgatttttcgcgacttgtcttgttcttgagggcgtccaaccgcgaaaacaacttgacgcaaccgatccggtggcacgcgttaagcttcatagtgtaaaaataaagtaagatgatgatcatggaacgacgtgtgttcaaagagaacgatgcatcattgaaaaacaatgagccattcgcctaggaagacaaagggcattatttcttgtctatttccaatgtctgggtcgctttatggtcttgtgctcgatgtggttggtcttgcgactttgtttcttctatataattgaacttccatgtgtccatcacaaagcctcagctgttcttgattacttgaaaagagcgaaggatttgctcggtgcgaaacactttccaagctttaattttgactgttgattcgtcgatgttatcagtcaatggtttcacatcatctaagatccctcgtatgatgctaaactgtaatttcttatatacattgttttctttaaattcaacggtcgtcagcatgtgatccagatcatccatagaaggtgaaaaagataaacggaactcatcatctctacgattattgactataattggtttctccgagacaaactctaccagcttgacatcatcaacatttagttcacttttaacgttagtcctggtttcttcttctgattcacaagatgataagacatttcgaataaaactggaaatgacacaccaggttctcaagtcgtcaacaatgctttggatttgttcaacacggtgagataatttatgaagtttcacaaagcgacatggtgacatcatactaatttcaagcttctggtcacctttctcattcaatcgatattttcttttatgatgaaatttattgaagtggtcaaaaagcgcatctaggcggttgtttttgacatcaggttcagcttcatcaatatcgtcaatattccacttgtacaacagatcgtaaggaacccaaacagtaggtaaaagctctgctacaagcgtaacagaaaatttcacaatgtcattgtcattctttccggaatccaccagccatcgtccttcttcaaaccacttttctttgtagactattcgggtatcaatattcttaatgcaatattcgttgtccacttctttgattttaaaatgaagcaagaagttgtcgttatgaatctcatcgttgggcactctttgctttagttgttgggtaacaaatcggtgatcttcccagaacttcaaaaatacgccacatcttccgccaacatttagttccacttttccaataccaccaagcccttctctaacaaaacacgaaatgtcatttctgtctgataaaaatgggcttttgtaatcgagctcgtctaggtgtgaaacttggtactcgtagactctgtgtagattgaaagataaaatatgcatataattaaacaagtcatactttcgttcatgacttaactcatcgttaccggagccagtttctctattcagttgatcgttgagactgacgctgttggacaatttgtcaagcagggataaaagcctcaaattcctattaaaatcatccagagtcgattcgttgaggttctggagtagcaacttctcaatgttgggttcacaagccttatctataaagttgagttttcccttgtcctttccagagataagtttagtgactatagctaaagacagagacacatccgacaccttctgttcctgaaaatcgatatcaattaaaatgattttaccagcaatggttagtctttcaattgtactcaactctttttcgttcattcctaaaggtccaggggattgaatggccgaagccttattgacaggatcgattatatcagtaaatgtttcgaaaccgtacaaattagagagcctcttgattcctttaatacctacagcaccaggacgctttagtaaaatttgagatacttcatccaatgaaagggccaactcaggatctactggcggcataacgtaagtttgggttgcctctcgttttattgttatcaatctatccaaagttaaagtagagagctccagttaagaaaatcataggttcgaggctggaaaatgccagatgtcgggttataagtacttaaagaatcaaagaatcctctgattttgctctatttacaaactctttatgcaactcataacttcacgccaatgtgaatggctgctactccaaatgtgagatcctcatagccttttcctggaacataaaagcctgctttgcgcaccattcctgcaaattcttcctgtttaggaaatttgcggatgctctcaactaaatattgataggaatctctatcattggcaactagttgtcccattagaggtagtaaagaaaatgagtatgtctggtaaactgtatccacgagactgttgtctacatgtgaaaactccaaacaggcaaacactcccccaggcttcaacactcgatacgcggtgttcaaaccggcttggatatcggtgaaattgcggataccaaatgcaatggtgtatacgtctttggaattatcttcaattttatccaaagtctcaccattctgttcaaggaactgaattcggggtgagcgaccatatgaagtttgtactacacaccttctttcaccttccattagcatatccgggttgatatcagccactgtcatggtactttggatgtcttgaaacttgtgcttcgcatgatccaacaaaccaaaagcgatatcgccagtacccccagcgacatctagaaatgcaagaggacgatcggtacctggcctcattcctgcatctagcttgttgataaaatgagttttccatagtctatgaacacccatggacatgatatcgttcatcaaatcataattggaggcaacgctggagaaaacgcctttaactaggttttctttttccctggtggaaacggtttgatatccaaaatgtgtagtttcagatgaatccttcaccattccagaatatagtctcaaaccccgattaagaaggagtgatccttttatagtagttctagtaagtccattgagaatcatagttaattcagcaatatatttttatcaacaagtttgatacgaaggatttcctacataattcgagatccacgcaaccgaaagtctgtgagtgctcaccactgaaaatcacaccagtgtacagatgatacaattcttgacaatatacagtgaaaagcttcaggagtaactgcatacttttataagattagagagagattgcaatgattaatgttcaggaaatataatttgaaaggacaccttttttttaggattaggtaacacatttataccgatattagtctatttaagggttaaaagccaaaaagtcgcacgttgttacaaatttactgaaagatcgataccaccacatctccgcttatctttaatgacctgaataattattctattactggccaagggtgtgacgaactcaactaggaagtgcccgattttttccacgacatgttcaatgttggcgtcttttttgtgtcgaaggaatgagagtcaaagggtagcaaaggctcacgctagtttagttactctttctcgcaatatccctgaccacttccagctcagtgttaccattgcctggcttattgttttatgaaacttgcattaatcctggcgtttctctttttgaatagaatctcatgcttattcatcccaaaccagacgattttaaccggagaatctatacaagatgaacagtcgctaattcaaaatactacctttttgttagccagtgacaatatttcttggagctttctacaactagttgggtctcacgacttgatactaccaatagaagaagtagacacgttgctactaccatctttaggaaagataactcttgcaagggaggccctagaacataccatgattatcgacttaacgattcgcttgcaattaactagctgcattcgaaccataatgcttactatattcctgcaagaaccagtgctcaccaattcttcactaagtacgtcagatactagacaactgatttatcagcaacagacaattaaaattgatgacatgatagtattctttttaccaactcgaatgcaaaaaattcataggcaaaattcacacaacaatgaaattagtatttctatactacttaaacaacgtagacgttcaagaactcagcctttctttgaaggacagaaagccgtgagaaagtccgattttggggcaccattaccagtagattcattcaaggctcctccttcagtggtaaaagatttatttgaagatataagagtgaaaccgaagaacgatgaaaccaatgaatttcatgaaaagttagcttgcagactggatgatttctttaatcagcttaaaggcgttgaattcataatattgttatactttgatgacaatgagcacgacacctcaaagtgccctgttcccaagcattatgaccatgtaattcatcaaaatatttcttctcattcattgcttgagaactcaaaatatgaccgagtatcttcaacagatttccgattaattaacgcaaaagcttattggataaacacagaaaagacaatcaagcgacgtgaattaagtgaggttcgaattgagggagtagcagcctctaatgcaacctttgttcctactacaatcgcaaattctgctgaaatccgtgactgcgtgaagttaacgtggcacaatgtcttacatcatagcatttttggtagacccacaaacttctgtcacagctgatgtttgttcatacgagacagggacaattcggcatagattcgatcgtatattcaagttgggcctaccttcaggcatgtaagatttacttctcaattttcaattttctcgattcatttttccatatacattatatcgttggattcaaaaaacgaaactgagagtagtgaatatattggtcactcctacaatatatggtacaaaatgaattctcaatcccccgaagctagttccatctaacgtcttgttttcgatcagaatcgtagccatgatatgaagtatcttggtaaaagacattatttggtcttgtaagactgcccatagaaccttccatagcactagtcatttgatgaggttctgtattgctggagaatgagttccggttactattctgagctaagttatcgtaagatgcgtttttgttacgtctgtggtatttttcggatgtactagattcgtcatccaccatattcagctggttgtaaataccagagtccctatgaccactcattgcagcgacacccagtgcttgcaattctgtatcgttgttatttaaacctgagggcccaccgtctgtggttcttgggataaaggaaacacggtcgtctttcattggctgatagcgagtgtctggattcttacggaccaaagctaatgcacacgtcactatggtcataatcagaagaataagagcacatacagcattaacaacaaaatacactatggctgcaacggaggacacaacatctggttggttgaagattttggaaaaaaacaaaaagaaaattgagttcaaaactcctaccacggaaatgaatatgttcagcgcgttggttctcttatccatataaggtcttaaccagcataggccaataaagtacagtgtttctagggcaaaaacaagtgctgcctggacttttccatgcgcctgtaatatggcgataaaaaacgacctcaaaaatgtgtatactaacagcacaaggacccaataatatttgtccgccctgaattgcacatagaggaacccaaatttattgagaatttttgcatctccgaacaaaaggtatgctggattcttatagtttcgaattgaacttcttcctgtcaaaacaaccttaactgcgctctgcagaaggagtacaaacaacccgaggaataaaacaacggcaactacaactgttcccacagaatcagtgactgtccattgccatagacaaagcagtgatacttgagggaatgagagaagagctagacgatacaacgaacccttagtaatagtgctccagtttgcacgatattcgccaaacttgccttgatgcattgctccaaaataaatcagtagttcaacaatcgctttgaacacgaatagaaggaaagtaagtatcaccacaaagaatataaggaatattattcccgtcataaacaagtcggtaatttcaatattggctaagtaggcaacacgctgaattccccgcagaactaaaattttcgagttgaacgcaccagatctttcatcagtggtataaagagacgagtcttgaatcatatcataattacttcttttgatgatattattagcagcagctaaataaccgaaggatctctttaccattttttgcacgctgatagaaataacgtgcttatttttgataattgcagtagactctccgcctgtgctctgaacgtaccaattggaaatactctgaacaactcttgaatagataatacccatggaccactgaaagttttgagcccaagaagctgcgattggtggaacgcggtttactgccatcatggccgtgatggcaatactttgaaagtagataaataatgacaaagaattggaagcgatatgggctgccgtattggaatgcccaacaatggaaataacaccagatgtaattagacctaagcctgaaattgcggcaataggccaggcagcatacttggtttggacagtttttccattcgacagcagagcctcaacacaagcaaccggagtgtcagttgagttcgaataagcaataacgcgtacacgagcatcaagatctggaatcgtatatgcaattccaggcacttgcgacgtgatggatgtgctgagtgtataagatgaatccacatctatatgtccagctgcaagggggcatatggtaggaagattaagatcacaaatactcagatgctcattgacaatggttatcccatatactataacctcaatttcagcctcaacgtatcccgatatagtagaaattgcagtaatttcaaaatccacaataccactatcacgattgtatttaacatcgaaataagatgctgtcaacccagagttctccatgcaagttaacaaggaggtggactggataaaaccaccagctagtacagaggtaaaaaagtagataagcaatcctaccagcaaaatcatctggctcagcggttatgttggttagggtctaagttttgaccaatttgcttgtatgtgcgttaaaaataggacagttgggggacaatagcgcgactggatttggtagacagggcttggttgaaggttgacaattgaccaaccaagcaataccggtagtgggcaaatgaaaaaagaccaccatccgccatccgacagcacactaccgtcatcccctcttccgtaagaccaaaacatcattctctcttcccctcctaggttggtgattcgcgacccattcctcaactccagagttgttcattttacaatggggaagtgggatatgatttcgttcctcaattgacttatttgtcatgctttttcggagcttgaagcatatcggtctctgtaccctgagcctttcgcattagtcggagtgcggatatgttatgggtcagggtctgtatcttgaattattgtaaaattgaaagaaaggatctaaggattgtttttccctttgaatgtgtatcttaagaaattgagtttcaccagcgtgttgtttactaccagcgtctctcttctgtgtgatggccatactatactacataccactttactccatttccgataataagtttcacttcatcgtctttacctccttgactccgtgcggctccaactctaaatctattagatgatcatgaggggcagcatttctcgtaatatcccacagagatacgtcaaatcccattgttccgggtatatgccctcagtaaagacatggcgtccagcatcttgtactcacatctcgtttgagcgggtgacgggaggggtatatgcatctatttttcttgagtcttgactctgaagtaggtctcgtacaatatgtgacggagagcattcgtgttataaaaaggtaagaatggtcccccattttcttctttctttctttctttctactatctttataaagtttttttttacaaaggatacgacttagttgttgatcaattatgccattagataacgaacacttacttcatgaaaattccattgacccaccaaagggattctttgaaagacaccctggaactcctaatataccaggcggttgggaagaatacttgaagctgtacaatcagtccatcgagaacccctcaaagttttttggagaaaaagcaaaggaattcttgtcatgggctactcctttcactgacgctcgttacccacctggtaatggatttcagaatggtgactccgccgcttggtttctgaatggtgagttgaacgcgtcgtacaactgtgttgatagacatgctttaaagaatccagacaaacctgccattatttatgaggctgatgaacctaatcaaggccgtacggttacctatggagagttgctgaaggatgtttgtcgaattgcccaagtattgactgacctgggtgtgaaaaagggtgacactgttgctgtttacctgcctatggttccagaagctatcaccactttattggctatcgttagaatcggtgctatccactctgttgtcttcgcaggtttttcagctggttctctacgtgatcgtatattggatgctgattctagaattgttatcacttctgatgaatctctgagaggtgggaagatcatcgagactaagaagattgttgacgaggctctgaagtcttgcccagatgttcgtaatgtgctggtcttcaaaagaacaggtacaccacatcttccatgggttgagggtcgtgatctttggtggcacgaggaaatcattaagcatgttccgtactctcccccagtgaatgttagatctgaagatacttcatttttgctttacacttctggctctaccggaaagcctaaaggtatccagcattcaactgctggctacttactgggagctcttttgaccaccaagtatgtctttgatgttcagggtgatgatattttattcactgctggtgatgtgggctggatcacagggcattcttatgtagtttacggtccacttttaaacggggctacgacagttgtttttgagggcaccccagcttacccagactattcacgttattgggatatcgttgacaaacacaaagttactcagttttatgtagcaccaactgctcttaggttgctgaagagagctggtagcaagtatgtccagaatcatgatttgtcttcaatcagggttttgggttccgttggtgaacctatagccgctgaagtttgggaatggtacaacgagtatgttggaagaggaaaagctcatatttgtgatacgtattggcaaacagagactggttctcacattattgctccaatagctggtgtgtcaaagaccaaaccaggttcagcatctttccccttcttcggtattgatccggttattctagatgctactactggagaggaactcaaaggtaataatgttgaaggtgttttggctatcagaaatccatggccatctatggctagaacagtctggaaggactacaaccgtttcctggatacatatctcaggccatatgaaggttattacttcactggtgatggagctgccagagatcaggaaggattttattgggttctgggtagagttgatgatgttgttaatgtgtcaggtcacagattgtctactgccgagattgaaagcgctctaatcgaacacaatttggtaggagagtctgctgtcgtcggattccctgacgagctgactggttctgctgtggccgcgtttgtgtctttgaagaaggacgtcgacaatccagcggaagtgaaaaaggagttaatccttactgtcagaaaagagattggaccattcgctgcacctaaactcatcatcttggtaagtgatcttccaaagaccagatcaggtaagataatgagacgtattctcagaaaggttttggctggagaggaagactctctgggcgacatttcaactctttcaaacccttcgattgtggaagagataatctctaccgttaaaagggatgcccgcaaatgagcatctgattaggacttacacttctatttcacatatctattttattatcgtgaagcagtagtcaaatatgtagtatagttttattagtttaccttatcgctactattgctattttgggaggaagcctcgaagacaccatacctaccaccttgggagaactttttctcacacatagatagttcagtatttggtaaatgtgaactaggtttaccttcgtttcaacaaatcagaaaacgttgcagtttcatagtgggactagtagcattttgtatgaggggtgatcatttatcaaagctatttcacagcctagaatgaataagaattcaaattcacaacccaagtcaaacgagcaagaaatcggagattcaacatttgaagcctttaatggaacattttcctcaacacaattctctaatgataatcttgttgaagatcccagttttgatgacttggccaaagatgagtttatggaatgtgacgacatttcgccaccaagaaagacaccttttttaaacgatacaaaatcgcaaggcacattagacgcatccctcactgaattagtcgaccaacaacctgatcataaagaaacaaaggaactgaaatttggagattatgaaacctatttctatcacaagaaattaaagcagcaggagaaagatgatcagtatgtacagtggcgcacaaagaattcaaaccagtttcctcccattttttctaattgtgtgatctatgttaacggaaggacagatccagatataacccagctccatagaatgattattttgcatggaggagtattcttgaattatcttggtgctaagtctaatgccactcatgtgattgcctccaacattactccaagaaagataatagagttcaaaaacttcaaagtaattaaaccagaatggattactgatagtataaaggagaagaagattctggattggaccaaatacactctattcagtccacagtatgatcaaaaggttttggaatcagatcgtgaattgaaggaaaaaagcctaccactcaatagaccgattgatgctacacatccagagtttttaaaatttttctttgagaactccagattacatcatttgtccacttggaaagcagatttgagggaaaaatttcagcaagaagctttgagagctagtaaagtatctcaaacactcagaacgaagccaaagataattatgcatatcgattttgactgcttctttgcggcagtctcggctttatctcatcccgatattgattttgcaaatgaacctattgctgtaagtcacggtggaaagggctcttctgatgtatccagttgcaattatgctgctagaaagtttggtgtttctaatggaatgtgggttaacagagctctagaactttgcccggagcttaagattctagactatgacttcaaattatatgaggagaagtcaaaaattttttatgaagagctgactaggatagaaccggattgtatttttcccgtttctgtagacgaagccttgattgggctatcatcaatcgatgacgaagaatctacgttactgaatatatgtgaaaaacttaggaacaaaatttacgtgttaactggctgtacagttagtattggtgcttcctataacgttttacttgccaaactctgccttcgaaaggctaaaccaaatggaatttttttcttcttccagcctaataatgttggaaattttcttaaaaatattccagtgaaacagctacctggtattggacgcaaaatagaggataggctttcaaatcatctaaacaaaggttctaaagaaactgtaactatttctaatttgagttcggtatctagagacacaatggtcaagttttttggtattaaaactggcacgaagttgtttggctactgtcaaggtttagatgatactgatattgacatctctaaaaatccttccaagttcatacggaaaagtatttctatcgatgtaaattggggaataagatttgaaaagcagactcaggttgatgagtttttaagtcgggtagctgaccatatttgtcaaagactactcagattaggatttgtgggcgctcggttaatgctcaaacttgcaaggagaacgaagggagctccaatagatcctccaaaataccttggaatgggcctatgtgactttttatcaaaaagtaccaacttaggagcaccaacaagagaggttggtctaatagccacagagttgaaatcattataccgcataattggggttgcaattgctgatctcagaggtgtttctgtgaccattagtgaactgcaaaagtgtgatagtgacgcaacttcagctgtggaccaaaagcaattacaattcgaagccaaaaagcctaaagaaaaaaaagtgcaaggcatcgaacagaatgtactcaaaggtggttctgttttccctcactactctccagcaaaagaaactttacaaaaacttctgcagaagcatcttgtagatcttgacgccttcaaagctttgcctaacgagtttcagcaagaaattaaacttgaactagagagacgtagtgttgagcagttatttgagaaaagtccaaaaaagaatcgcaatcgcaattgtctacttcaaaatagatctctcaaaaagattggtaaagtgcggccagaaacccagaacaagaggattgatctaattagtaaccaaagaacattaaacaaactaacgttgaatattccaattgaaaatttaggggattctgtaattcaccagaagactgaactaagtggtttaactatggagggacagaaaacccttgtgaactcctactgggcttccgagaaaacgaagacgttcaacaagcactacaatttaggcattcagacattctatgagttcgaagattggaaaaatctcttgaaagattgggttcggttcagttttgaaaatgaaaacgagaagccaatcggtattcatgagaatgacctagatgtcttttacggtttcattcacaaattaatcctgaatgaaaagatttatgaagtgttgtcactagcagatatcataacctgtagtttaaactcaagcgagttagttgacaatgatactaacaatgagagtgattggcgaaagattagaggagagctattaaatatgctcaaaaccaacctagtccaaaagggcgcatgtattgacactacttaagcaaaaacaacgcgcatagtattggtgtgacccagtcccttggtccacccctgtactgcaacgatagcatcaccttttttcaatattcccatgccaatggcttcagtgatggcatattgtaaacgttcttcaacatcttgttgccagttatcattaacttcctgtttatagatgaatggatatactccacgatagagatgagaatatcttgctgcctcatcatttctggttaccataaggattgggcaattcggtctatacttagaaatcattcttgctgaagttcctgaagtagaaagcacaacaatggccttggcattttgttcaaagtgagcagaaacagcggcaatagcaatagtttcaactgtgttaataagaccacgagcaagatccttgatttcgttgtagtgtggaaggtaagcaatagctgactctgcaattagagcagtgtggtgcatcatagcaacagcctcatgagggtagtttcccttggcagtttccccggataacatcacacaatcggcgccatccaaaatagcatttccaacgtccgaaacctcggctcttgttggcctaggattgtaagtcatagattctaacatttgggtagcacagattacgggtttacctgccagattgcacttggcaatcaattgcttctgaacaacaaatacctgaggtgcagggatttcaatacctagatctcctctagcgaccatgacaccatcagtgacttccaggatttcatcaaaattgttaactccttgctggttctcaatcttagcaataatctggatctgtttgccatcttctccgagaacatggcgaatctccttgatatcattagcacaacgaatgaaggatgcaaataccatgttgactttgtttttcacaccaaacctcagatcttgcttgtctttttcactaagagctggcaagtccacgtctgtgttaggtaaattgacacctttatgggatgaaattgcaccagcattgatagatctgactttgagagtgttttcatcaacgacttctaaaacttcaaatgaaagaacaccatcatccacataaataatctttccaggttcaataacctttgtaatgttcttataatcaatgaacatcactttgtcatcgctagactttgcgaaagacaaatctgtggtgaatatcatttcatgtcccataggaattgcataatctgtttcacctttggtagttcctgttctgatttcaggacccttggtgtccaaagcaattgcaagcggtctaccaggatatatttcctctgattttctggcattgtccacaactgattgatggtactcgtaagaaccatgagagaagttcattctaacaatattaagcccagcctgtctcagactgacaagtacttctggactgttagtcttaggaccaatcgtaccaataatggaagatcggcgaagattgcgctctggagtggatgatacatccagtttggatagccatccaagttttgaagaagttgacattggattgatttcagttaaaaaaaagtctaaaacaatttactgtacatgaacggtcgcctgctaggttatatatacctattacagcaaagttggatgccattaaattttgatcaggggacgacattctaggggaacggttaagaagcgtccgtccccacgccctatacaatctcagcacaaaaggtttcattccgcaaatgatggtgggagaccggagtaatagttcactcgtggaaaaccctcatccttgaatgtgaaaaacgtacggaacctctgatccgatttggtttagtttaaacaatttctttagaaccccgagcggaatacagtatcccgcacactgaactacgtactgccgaagtagtaatcgtcgatgaaccgtgtacgaaacattggctctttcaataatgaggtcatcctcccagaggataagcctacgataatagtaaccttttggaaagcgttcagtatgcgacgtaggccagcttcttctgcaagataacttacaatcacgatattaccttcttcaataccatggtccagaagtacttgaatgcccataattgctgcggcccccgatataatgtgcgcatcgaataatagtagcttggtagtttgttcacatggaggcagcgactttgtatgcaattgaggttcgcctgtaattaggtctgattgaattagcaacttaccaactcttacatctggaatagtttttctgattgaattcataaatacatcacctgtccgtaccatagtcacaacgacaaccgattgtaacggtcgtatcgcatcagttaggcaatggtattgcggggtcaatacctcatcttgcgagggtccgaactctacctgttccaatgccagatggatcagcatgttagcaacccgatcaaagtaaaagatgaactctgtacgagaagtttctctgtcaaaaagaatggtacttatacattttaactgatttgttagcggcaaacgtgctatccggttcatgagagtctcatcgttagatatctgccccagctcttgaagtcttttcaggtgaaccaatgacttttgttccaactggttattgatatggcgaataatcatatcaagtgcaattttattatcagtgctgcgaggtaggatcaaatccgcattcttggagctggggatcacataccgaattgtgttaggcttcacatgtcgatcccactggtcaaggatgccttccaaatctctacccctttcaatcaggtctcttttaacccttcgagccatgcatatatctagatcagtatccacaaaaacttttgtatccattaaatccagtaattgtccatgatggagtgccaacaaaccttcaaccacaatgacagatgctccataaatcgttgtagtcttttctgtacgggaatgggtgcaaaagtcatacaccggcagttgcgttggttttccagttttaaggtctccaatacaacgaagcattaaatcaaaatccaaagcggttggcgaatcaagatcatactgcgcatgctccgccaaaatatgttgctccggggtcaataccttgtagaagttatccagagacaatacaactgtccagggttgattgatcgccttcacaatatgcttagcaacactggtcttaccagaccccgaagttccggcaacacctataatatagggctctgtccacggcggaatatattgaggatgagttccagatgctggctcgttgaagtcgtttgaagtacaaaaagaattggaattgaggagtatggtatcagtgtgtctcagtcttgattgtttcataggttaaagaaaaaaaatcttaaagataatttttgtattatagccttcacgcctgcaaagacttgcaatagtgccaatcctttttttagtagctagtgctgagacagtactcgaatgtctgaataagctggaagagatgaaaaaataatgtacaaatccacatacgctggtgtcatccttttactgctatagtgtttctaaaatatcatacgacgttccattagatttataatattatacaaagtaaagtggttgcaagtagatttacactgaccagtagcctcttttattcatttcacgtggaacaaaggaccatgttaaaaagccgaacataagtacgccccaagtaccaactgctggaacaaccctcttggcttcaagagcaaaatagtttggtctggcattcctagatgctttaattgcttgcgatgcgacagtttttagggcgatagttgacattgtggaaaagagtagagtagttattctgactattaaatggggagaagaactaagccctatttatagcccttcagactgcggtcaaatttatataatcttcatctcatttagttcaaaatcatgctatctttggctgatgtggtgtgttttctggggaaatcataccactagacggaagcgcgaaagatgtgaactattatggtgtgcagtacactgcgaagacgagttttctgaccatgcagattgatgttgcaaagtttagcgacccaaagtaatcaagttatgtgttttccttactaaggtctcaacttttactgcagatgggtcttagtattgaggccaaatgtaattgcacatccaaaagcttagtaacgcgaaaagagtccagtttgatgccactcaatcgacactacgatttcatgatacaaaaaataagatgcattttatacgaagaagttaaaattttacacaagaacagccaatatcatgaaatgaccataaacccaacatctaacactctatgaggtctacaatgtccaactcgactggttcacactgttcgccaattttttcgtcatagagattgtagaaggtacccgaaagacattgatagaaggttgtactgttaccaagggccagcttagcatcgtctgtaatcgaccatcctcctgcatatatggtgccagcttggggtggcggtccatcaaattgaaattgcctattggccacaatcgcaccaattctaccctgagcgtctgtcagcacacccttttcaagaaccaaagcaagagaagaatcagtaaggcaagacactaaatcagaagtccctttatcctctgatgtgtccgttggttttgactcctgcacttggccgtctccaatctgagaagcgacagatgtagtggctgtagtggcttggatctggccatctcctatttgggagacaactcctgtagtttgttttacttccgatgaagtggaggtcgtagcttgaatttgaccgtcacctatttgggaaacaacttgagcggtttctttcgattttgatgaagtggaggtcgtggcttgaatttgaccgtcacctatttgggaaacaacttgagcggtttctttcgattttgatgaagtggaggtcgtggcttgaatttgaccgtcacctatttgggaaacaacttgagcggtttctttcgattttgatgaagtggaggtcgtggcttgaatttggccgtcccctatttgggaaactacttgggcagttactttcggttcagatgaggtgattgtagccgcctgaatctgtccatctccaatctgggaaacagcctctctcttaatcttgtcggcatctaaggacttaatagctattccaaaagtttgtgagtaatctttgagggcactttcaaggctagcatcaggtgtcagtgtgctccatggttcggaaggcacgtaggcactgtatgcaccgcaagtaagggcagtagcaattattaagttcctgtacatcatttctcagtatttaatatgtttagcaatgagtatgaacgggtcagaatcctaagagaagtcttccttttatactgtgaatattgaatcccgaaagatccatttttcagatggctgggttactatttttagatgtaatggaaatttaatcaaacctacagacaagatcataaaaaattacctgattaggaaactatacataaagcttgactgagttagagcttgtttttttgaactcgatccagtttaacgtttgatatattgcagttaaattccccgtaaccggatcgacggtactaaaaaatatctcagtaactgactactcgttgttacttgctgtattctttttttatcaaacaacacaatctaaataatgcgccatgactgaatgtggataatgggctgaaattcttgaatgtttccgagagacaataagacgattcttgttaaattgcatcctaagaaagtttgtatttatttcgttgtgtcgtacagcttctgttatttctttgatttctgagttttttcttactttagtcaagtagccggcactgcatgtaatttacttacactgaatgcgtcacgtgtaaacttcatcgatcctcgatatgccgttttagatataggccgattagcagcggccattctaggctacgtgagatagctaaatttcggtaaacaaggtattacatctgacatcatgtccccatcaattaaggcgttagcgcatcaatggcttagcattgatcgtaatccatccactagatctgagattctcaaacttcttgagaatgaaaagtttaaagttcttgaagaacgcttacgaagaagaattacttttggaacagcgggacttcgaggtagaatgggtgctggttttagtctaatgaatgatctcacgataatacaagcatctcagggactggccaactatatgtcaaaagctggcggtaaatcaatagttattggacatgatcatcgtcacaactctaaacagtttgccgaatacacagccacagcattcattctaaaaggatttagcgtgtattatgtaagtaatagagaaggtggtgatatcccaactccatttgttccgtttgctgtcgactactataaatcttttggtggaattatgatcactgcaagtcataatccatcagcagataatggctacaaagtttattggaaaaacggatgccagatcatccctcctcatgataggagaatccaggatgaaattctagtgaacactcaccctattgagggagcttggaattttaaggctgcattcgaccacgctgaaagcatatcttgtattcattattgtatggaagaagtttttagtctttatcttcaacgtttaaccacacaagtgataactacccaaatcagtccacgtactcgatttgtgtacacacccttgcacggtgtcggattaaagattgtaaccgctgcttgccagaaaatgggcatcgactcacttatctcagtagaagaacaatctcaaccagatcccgattttggaacagttgaatttccaaatccagaagaggccagtgcattagacatggcaaaagcaaaagcagatgctgaaggaattgatcttctcttggccaacgatccagatgccgatcggttctcagctgctgttaaggataatggcaattggagacagttgactggtaatgagcttggatatctattcgcagagtacattatatcacagattcctcgggaaagatactcttctacgtatttactcaattcaacagtgtcttcgcagatgatatcatccatggctgccaccttaggggttaactatatagatacgcttacggggttcaagtggattggaaacaaggccatagagctagagaagagcgggtataatgtgccatttgcttttgaagaggccataggtttcatgctccctccaattcatgataaagatggaatctctgctttggtattgtttctgcaaatgtatgatcactggattaaaagcggaacttctgctgttctcaaactggaagaaggattcaagaaatacgggtatttcaaagagtgtaatggttactatcgtatacccaacttatcttcaatcaaaacaatcttcaacgaaaatatcaggcgtttaagagacgctgatactgaccttgaaaaaccctatcccgataagctaggacgatttactatttcagcatggagagacctaaccacgggctatgattccagtacgaaggatcatttacctcttctccctgtagacagaactacccaaatgattactgctgttatgcgaagtgacgacgaggatacagttcgctttacagttcggagttctggaaccgagcccaaattaaaagtttacattgagagttgcagcaataccgaaaaaaaggcatcacaagtttcacacgaagtttggaagttactagattctgaatggttcaaaacagagaccactggtctagtttctagctttgtagcttagtaaatggaaggcttgatcacatatatatgttttcgcgatggttttatttactatctatttgaagcagcgaccatttttacttatcaaataaatggtattattcaaagatcattacaagaaaactgacttacctatgtatgtttccaggagattttttcctgctatttctactaacacgtatatgcggtagtcattctgctaaagcaaaaaaatctttttccatcgtgaatcgcataagtcgggttcctgttattatcgttgtctttcttttgttattattgacctggttttatttgaaagaacatgggatacacaacactggatcaaaaagtgatattcattctactatacttcaagatatggaccaatatcgcaaactgtttgaggtagataaacagagtatcgataaaacagagttttatgatctgaatttatttgagggaacctcaacgggggtgaccaatgaggaggtaatcctgatgttaataccattgcgaaacgccgaagacgtgcttcctttcatgtttctgaacatgatgaatatgacctatccccattctttggttgatgtggcatttttagttagcgattgttctagtggagactctacattggcaacagtctcagatttcagcttgttattacaaaatggaacactgttaactcaccttcaggatttagagggaaaatatccgggatgtacactcccttcgtcatttctgttcaaaaattttatgaaaccgggatatggagagtctattttaaaggcatattcccctccttatcattctgagtttgaaaaaccgtttagaactgtccagatttttcaaaaagactttggtcaggcagttggccaaggattcaacgacagacatgatgtcaaggttcagggaattagacgtaagctgatgggaagggctagaaattggttgttatccgccgctttgaagccttatcattcgtgggtatattggagagatgctgatattgagtcatctccaggcagcgttattcaagatttgatgaagttccgagatcaggggtttgacgttattatacctaatgtttggcgaccactcccagaatttctcgggaacgagcaaccgtacgatttgaatgcctggatagagtctgatgctgccagagaattagcctcttcgctagatgaagacgatgttatagtggaaggctatgccgagtatccaacctggagagtacaccttgcttatcttaggtcaaatgagggcaaccctgatgatatcatagatttggatggtgttgggggagtgtcgattctggccagagctgaactttttagaaaaggtgcacacttcagcgcctttacctttgaaaaccatgctgaaacagaggcttttggaaaaatggctaaaaagatgggattcagagtcggaggtaccccacattacacgttatggcatatttatgaaccaagtgtggacgatctaaagcaaatgaaacactacaaggcaagcgaaaataataaacaataatttgagcgtgctacttctactgttacacgtaaaccgtcaactatgatacatctattcacgtaaacgttttcagtgaatcatgaaactaatcagtcaatcagtcaattttgatctgagaataaattttgaaaataaatagcatcactgcaagaaatgcaacactcccgcaaatcaaccccatagccgcactcatcaataacgagtagccaacatacaacaaagtagacgccagcccacttaatctaaacttagatagaagtagagcatgtacgaagacatatacagagattcctgcaccaacaaagaaagatttccactgccagtggtagttctcattgcataaagtgtagtacattagcaagactgtcactaggatagtcgttgctagcatcagtataaagcagaagaataggaatccaaacatgtaatatattctgttgaaccacaaggaagaataaatgaaatacatctcaatagagatggcaccaaatggaaacacaccagcaagcagtgcaagcatgtaagtcctcaaataccatggttgcggaggtatttgtcttggaatttgattcacttttgttggattaatgaaaatagttttcttactaccaaaaaaagaacctgccacggacaaaggcacgctaaaaatgaaccaaatgaatacaatagcaaatagtgttccaatgggaacggcgcccgaggagtgcacggcaatgagtacaaagtttaaaccaataaagaccagaaatatggcgccaggtacaagaactggattgaggagcatgtttttcttccagtcttcaccttggaaggtcttataaagattggcagatacaaatgatcccaccgatccaaatgtggcataaaatatgatcattaccgtggataaagagcccctatttgaaggagatagtagtcctagcaaggcaaaaaatgtagtggtgaaggccattaacagcatctggactccagaaccaactaaaacgcacaagattagttttttcttaggtgccctgaacacatctccatgaatcaatttccatccggtttcatccataacatcttcatctagatcaacttcgttgtatttgcgaatatcatttcgtaagcttctaacaagaatatgcgacattataatagatagtagcaaaacaatcactgaaaagttgaccaaagcaaaccactgaattttgggatcgtatacgtgaagatacttatcccagcgagtagcccatgctgtttctgaggggatgaaaaatacagaatacgtgaacgtgactttagtatcatggtgaatgttcaaactaacaggtgaaaaattgcttaggtcggcattgcaggttgaagtattatccccgtaatctaatgaaaacggtaatacagtcacaccaactattctgaactcattatctccacgctgatggtattcaatatgcagttcataatgattgtacaagtttggacgcatgtctgaatctatgcttccgaggtcaaatccagatccataaaactctgtgttggtctttgtgtcattcattttttgagcaacaggcaagccatcaattaaccagttgtgtttgaaaccagctctaatgtttttattgacaaataaggcgtctgtttttgaatacgtgggagagcaaagagtctcgcaagttttgttctccaacatactgatctcaaagggcgagttgaagatacggtcaccaaaaattatagctcccagtgattcagattgcttatgaggcccgccatctggtttgcagaagtgaaaccgaggaaaataataatcgtaagaataaacgtattttttggaggaagtttttagtgagggagtgatatggttcaccagtagtggaacagaatcatttctgctataagtggtgggagcaacccctggtagatagaagccttcgaccatctttatcgaaagcagcaacatgcataataacaatcgcattgttaagacgatccgatagtgaacgttcagatcagaaaaaaggtttcggaagtgagttggaaaaaagccaacattttatgtgtacattacattatacatatatcatcgagcgcgatccacatgtatatttgcgatactgacgagattcggaatgcggactgttattatgtaaataaacatgtttcaaacagccaactgaacataatagtcaggaatttagataggagccgagaatgctaagagtttaatatcaaacttccatttctgaatagccagcacagctcaacatgtctccaattagaatcaacatcaatccctttttcaatcatcaattgtaccaagttcttgattatgctttgttctaaccccttggtgtaggcaggtctctgaaatgggtcgattattttgattgctagaagtagccacaacgatgccttacgatgtcgagtaagtcccagtttttccatatcaatattctttattcttagcttgtcactgggcctactaacttcttgatggttcaaagggcgagaataaatggtataggcaaaggaaatatgctggtatatgaccgccaaagcagatccttgaagaattttcatagaaagcagctttcttagtaacttaattgattggacaagatacagctcattcataaaagcttctcccatggaaatgaatagttcactcatcaggatgcaagatctcaaggtattagttctaagtgaacatcttgaaaggtaagtgtagtgcaggttttcaatcgttggaaggattaaatcgttgataattttattggtaattcccaccgtgtttccgttgccttcattcggcacggatgcttgcttggaacttgctccgatcaataaggaaaaaatcatgaagtcctgtaacgaagccaaataggtccacgatctatctttcaaaaaatctttcttcaacaagtcataggttgtataagattttttgtagtctctcatcatgaagtaccagtctgccagtcgcctgatcttgaattcctgagatttatggtggtagtatccttgcaccgcattgaatccattttcatcaattccctgttgcctttcctgttctgagaacgtctcaatgcttctcttagatcctttccaaaaacgattgctgaaactttttcttggaacaataaggttttcatgccattcatttacttttttctccatgaatgggaaaacgactttagtagtaagatgcttataaaagccatgaatatcttcctgtaaggtctttggaataatcataatttctggatgtgaactaaaagcaaagacacttcttttaattgtcgtttcattcaaatttttggtcttatcattcgggtttaaactcaaaatcaaagaggatagaccaaacttgtttttcaaagaatcccgtaaccataatccctgctgaaaatcagtttcaatactcaagtcaacaatgataatacaaagtggattaatctccttgagatctacccaaaaaggcactttggtacccttccactgggtgtagagtgcaccaatactctggcagtcatcctgagtcgttaatacaaacaattgaaatatggggtgggagaatgtctcaaaatttgaaagggtgtggccacctaggatttttgaaagaaatctaagagacacagacttatacaatctcgatctctcagcttccactgcagtttctgctagctgttgatcgattagttttagcatgtcatagattgatgaatgaaactcctccaaatcaaagagttcttcatttgtctgaaatgattgcagtggcatatctgatattgattcaatgaagcgaatcgagacttcttgagtggaatcaatattatcatcttggaagtactgcatcagttggaggatgttgttgaatccgaacctcttagcaatatcatcagataattgggtcgaagaaatagaaactcttggagagaatccatgaagaattacggcaatcgaaactgagaaaggggaaaaatcatcagactcaactcgatcaaatcttttctggagattaaccaaagttaattccatcgtacaaggaaaagaaaagtattgtcagacttaagtggtcggaatctactcgcgactaggtaccaagagattagttagtactagtatttacttcatgatatacctaccatgttttgtcactaaaatgaaaatttcttgtgccagttttgcaattgggctaagaaggggattaccaatttaatcaagtgagtctgtccccttttattttccttttatttggctgattgtttttatccatttatatgcgccgacacctactagatacttaaaaattgactcctaaatttgtgagattttgcgaagtgaactaagctctttttggctcccttttttccgatgtcgttgtttgagcttgtattaaggaagagcaatgtcgggggcattcttccatatattgtctagcaggtttccctcagaatttcgaagatagcgtgtcgcgaacttatttagtcatttcatgtgctactattaaacaatcacaggccctgaggtaactggtttccaactttttcctcatattgtctccctcttattctaatatccttgccaattacatgtcattatgccagaaatcgagaacgctaccagtttcaagatcggcccagcattttcaaaggtttcagggaagctacaggatatttcaaagcttatacttggaggggcggtattcaatacacagtataacgatgacccgtataatatggatattgtcaatcttttaaaatttggattcctgcatggaatcaacaccatagatacttctccctactatggtccttcggaattgctcttaggtaaaagtttgaattacctgattaatgaagcaaattacataaaaagggatgaattttacatttgcaccaaggttggccgtgttaagttaaatgattttgactactcacctgcctggattcaagcaagcattttgaggtcattagagcggcttcacaccgattacttagatttggtgcatctccatgatgttgagtttgttgaagaggacaaggtattacaagctttgaggaaactgaaacgactgaagcaaaaaggaacaattagacatttcggtatttctgggtatccagttgattatttgtatcgcatagctcttctttgtgctaatgatcccacaataggccctcttgattctgttttgagttactgtaacggatgccttcaaaatactcgattatttgattactatgacaaattcttaagtaattgtggcattcaagtggtgttgaatgcatcaattttatctatgtcaatgttgcgtcttcaagaagtgaaaccatttcatccggcaccacagttacttaaagctgccgtgcgagaaatagctatggatatgaaaaggaactataatgaagatctcgctgatttcgccaccaggtttgcattgaggaattggttattcaagtcgggatcgacaattttgggaagctcaactgtagaagagctgaagtcagctctgcaacagttccatctagttagttcagatattaaccacatcaatcgaagagatgagatcctcgtcaagaaatacagaaacgtgcttggagatcactacaatgaggtatgggaaagtggcattcctcagaagacatcaaattcggtatcaattgaccacagttactaaaactcttcaactcttcaaccagaatcagtgccgtcaacatttacacactgattgctcttcttctttcatagtttgaatttatctttcgctagtttgaccgcagcgttactaatgaccacgacatttctctccacactaaaggtctgaaacaccagtagttcattgccgtctttccaaacttttagcctcaacttttcaccggggtatacgacatttgagaatctgcatttagcttcatcaaaaataccaaacgtatctactaatttcttgacggatattccaaatgaacacagtccatgaagtatcggtttgtcgaaattagcccctttagcaaaaccagggtcgatatgtaaaggattgaaatccccagatagcctgtaaattgcagcctggtcaaacgaggtatccaatattgattcaaaatcgggccgtctggaaggtggattgaaagattgggtagcaaatttggatcttgactgtctgaagactttgttgccaaccatcgattgagaacctcgaacaaaaaaagacccttcattgtaaaacaccgtttctttagttactttgtcgatagtttcatagccagcaacaacaagtgcatttttgcctttattctcaactgcgataggatatgattttgttaccaaatcaccggaggtagggaggggaattttgttgagtttaagatactgctctccatgtagtagcatcataggattgaaattattcagtagggactccatgttcaatccaccatcatcttgtaccatgaaaggaatgactccaaaagagggaacaggttgaaaatcttcgtctccttcatacacatatctcgactcatttgcatgagatccaactcccaagttataaagaattacatcacgatgattgaatttatacgatgaaactttggcttctttttcatcatcgtcatcaacatcatcaagattgtcatcctcactttcctcctcatcttcatttctcgtagcactgagtatggccatggacgactcctgtgtgcttgaaatagggatcccgttttgtacatcagtcacggcactccaattcttcaaaatgaattctggtgatggtttagaatcgttacaaacaatgccactggctcttttccatcgggtcttccctatccaacctccaccaacttcaaaaagttcgccgctaatccccagttcgctactcgctaagagaactacaagaggagatacttgggaaggtggaaacaaatctagttctttttctgacattatcgttttggtcatagaagtcgcagcgtgcggcgcaatagtgttcacatgtatattgtgtttctttccttcgatagctaaggttctggataaacccaaaacacctgctttcgaagctgcgtaatttgcttgaccaaaatttccataaataccagaagtcgaagtagtattaatgatcacacctgcattctgcttgagaaatatgggccatactagtttacagagtttgaatgtagcgagaagatgaacttgatacacttgattccattcttgttccgacatctttaaaaatgacctatctctcaaaataccggcattattgaccagaacatggattctaccaaatttttcgcaaatctcattgataattttttcaggctcctttacaacatcatgctttgaaggataagccttgccgccagcttccttaatttcctgcacaactgtaaaggggtccttgaaatcgttcacaataacaattgcgccataacgggcgaaccacagtgcatggcttctgcccaatccagaacctgcacctgtaatgagtaccaccttttctttcaaggagtttatggtgacctttccctgactattttcgatgggcattcttgaagcctttttgaaagcggattcataatctttcagctctctcgggtatgaagattgtgagcctttttcaaaagttgttaattcgttccatttatgaaggattgcttcgggagtatagctatcgttaggattgaaataagacccaccactcctttgccatgtaatctgaccataaaacccagcagcaacttcaaagatccctccggtggatgggaccatatcatgacctaacagtaataccaagggtgcaactttatccggtcctagtttttccaagatatcttcaggtaagattgcttcagtcattctagatctcgctaacggcgcaatagcgttgaccttgatattgtacttttgaccttcttttgctaatgtctcagccaaagctaccagggcgagcttagcggcagagtaatttgcctgaccaaagttaccataaaggcctgccggagaagcagtatttattattcgtccatacttttgttgcttgaagaatttccaggcatattttgtaagcttgaaggcaccagttaaatgaacatcaataacctgctgaaactgttcttctgtcatttttttgaaggaagaatcgttcagaatacctgcattgtttacaagcacatgtattgcgccaaaagatttgatagcagtgtcaatgatcccttcgggattcaatactacattgtcgtagttagcaactgcttccccacctgcttcttttatatttgccacaaccagatctgccgctctggatgacgtcccagcccctccaagagtcccacctaagtcgttgaccacaactttggcacctctagaggcaaattgaagagcatattccttaccgaggccaccaccggcaccagtaatgacaaccaccttattgtcaaatcttaattgggacatctgtaatctatgaatctttaggacgaagttaagtacgagaactggaacgcactttatattaatatatgccttttcgtcggcactccttaaccattgacatatgattaaggtgtggggagtagtttccaactcgggtcagggtgccggtttataaacgggagcatgtgaattgaaggtaagtccagaaggtgttcggatgttacatttgatcttcaagtggccaaggaatgtaagccataaaagcgatactgtaggtggattccttatggtggttcgacattccactacaacccagttttcgttatattcccatttactctcactaaccaaaatactaaatcttgtacactgcgattcatgtgtcaagattccccaataccttagccagaagctggctccagcaggtttcacgtatggaaataatgaaaaagaattgattcagcgatcgaaaccatggaagcaaatctctgggggtagaagagttatcagcccgttaccaaactttaatttcgactttcctttgaattcaaatgctttgtcaaagccagttgcttcaattcatgctagttttgtgaaatcgacagatcccatcgcccgaagtttttcacaactaaaaggagtagtcagcagcttaagcaagctgtacaagtcaaagccaatttatgtgtactcttgtgactatttttgtttgaaattttattcaaagtatcagtacacaggattgatcaggaagacaaaaccaggaatactcttgaaaacctatgggcacaattataactccttcaaagtccacaaactatccgccacttcgtttactcgcactatgaacccatttgaatatgcaatccacagaaggcgcactcgtagtatctacaaaaagctgtttatggataggtttcttggcagagacggattgtatgagtttatcatattcaagattcctcatcagaaggatattgcatacctaaggaatcgagtatgtcactgtctaaatgaagttaacgacttagatgaggagtgcctcaggagtgtaggccagaaggaaattaaatccattaataaagggcttataaataaacagtgcaaactgctgggactgcctattttgctcagatagataggcccttggaaaagacaagcatatagtcaaacctgcagtttagcccaaggaggataccgagtatgaaacttccagtcaattgaccgataactaagcgcgtgcagccatattcccaactcttctggattcctttgcctgtacaagttgattccgcattttgggcaagtatttgcagaccttgattcatctcttttctttgttgctaatttaacaacttgttcaaatgacttttcacttagcgttccacacggtgattctcttcttataccaagcaactcgttgaaaccatacagtggatcatttgctatgggatggcccaggtttctgagatggatccgaatctggtgagtccgacctgttttcgggctgcattttactatactttgatttaagctagtactatatgcgagccgttggaaattagtaagtgcttcttttggttctgtaattccgttttcttttccccttttacaatctatgttaacaattttatccgaacaaacgatattgcccatcgggaattcaccatctacacgagcaatgtatgttttttgtatggagttctgtttcaactgggtttgatactttgctgcggcacggggtgtctttccaataatcaaaatacctgaagtcaatctgtccaatcgatgacacgggtaaagtgacgatacacccaattcatttttcataatttctgtcatagtgttgtaataatacttgcccgtaggatgtacaggaacaccgcatggcttgttcacaaccaaaatattatcatcctggtagacaatctcttccccgataccaacctcaggttcatgtttgtgttctgtattcactacgcagtcaccacttttaataagagtactatacaaaagacttttgtctattgtttgctctgttgcgaggcccctattgcgtatgagttttattgttccattgtcaatgtttaatctataatactcctcactccttgatttgaactcattgcaaaaaacgtccaaaactgtcatgccaatccatctccctttaacatggaatacatgggtataaaaatacggattgcattgcctcaagttagcatttatcgtatatctcatctccatggcacattcgctttcctccttcagcgaacaataactatgccgttaaaaaggatattcgaggcattgtccaagttctcagatttgtttgaattctccagtgatgttaacctgggttgcgatattattgttcgttcatactgctatcagcgccaagagagagttgttcaagtcttgtgctgaatctggcttttgtcacaggaatcgacattatgcccatgaagttacaaagttgggggatacttttgaatctccctattttgtcctttcggactctatcgattgcaatcaactgtcttgcacgggtcaaatcgtaaaacaattgaaaaatacacagataatgctcccatttgaggttgatatcttggaggagagtttcaggctcagaattgacgaactacgatctgacacccatttccacaaattgaattcctgtaggtttagcgcagcaaacctctctatgatgcacgggtctgcaacatcatccaaaatatcgtcaacaatgaacgataagtcattgcaaatctttttcaatgattcttccgcaactatcaatttcaaaccttttaaaattacgatattctataaaggaaagcctcaggtaatactgaatgacaataaccttttcaatattgaacattacagaaaagaagaagaaaactctatgtttgaatttgagtcggattatgatttgtttcacgattcatttaaagattctagggctgactcactaccgttggggccagaatcgataggtttagatatcaaattgttaaacatgagtcatctttatggtattccagaacactctgatcgtctatcattagaagacaccagtcaaagtgatccctatagactgtacaatgtcgatatatttgagtacgaaccatattccaaattaccaatgtacggatcaattccctttttaataggactcaatcccgaagtttctacaggtgtattttgggtcaatagtgcagatacatgggtcgacattaacaagaaaaaggatacgtatactcactggatttctgagaatggtattttggacttggtgataatagttcggcagaatcctaaggaagtctcgactgtttattcttcgctaacaggaagagtacaattacccagccaattttcactgggatatcatcagtgcagatggaattacaatagtgaagatgatgttcgtgatgttcatagtaaaatggacaaatatggtattccctatgacaccatctggttagatattgagtatacagacgagaagaaatattttacttggaaaagggaattgttccctgatcctagtggactgcttcaggagttagatgaaactaaaagatcattagtggccatcatcgatccccatatcaaggtgggatatgaggtaagcgactacttggaatcaaatgggcttgttgttagagaaaaagactttgacactccttatcatggccattgctggcctggcgaatctgtttggatcgatactttcaatcccaatgctcagagttattgggatacactgttctgtaagggttcggactttgctggatcttcttcaaacctgcacgtttggaacgatatgaatgagccttcagtttttaatggccctgaaactacctttcctaaggatttagttcattttggtaagtgggaacaccggtcaattcataactggtacggaaaaagttttcatgaggctacctattatgcgttaattaatagatcaccaaaccataggccatttgttcttactaggtcgtatgcccctgggtcacaagctactgcagctatgtggaccggagataatgctgctacttgggaatacttaaaagttgcactgcccatgatactctctaatggaatagcaggtatgccatttgccggtgctgatgttggaggcttttttggaaacccatccaaagaattgttaacccgatggtatcaatctggcatttggtatccattcttccgagctcatgcccatatagactcccgaagaagggagccttggatagctggtgaaccttacactacaatcattagagatacggtgaggttaagatatcagttgctaccagttttatacacagcattctatgagtcgtccaagttaggttatcctgtcctgaggccattgttttatgaaattccagagaaccagaagctttacaatatcgatgatcaatttttcgttggtagctccggtttaatggtgaaaccggttaccgaagaaggtgctactaccgatagtatttatctgcctgatcctcaaatttattacgatttcttcaaactcgggacaactctgcaaggtgaaggaattcatgaactagaagttgatttgaccaccattcccgttttggcgcgaggtggttctattatcactcagaagctcaggtatagaagatcgtctcagttaatgaagcatgatccgtacacgttgatggtctttttggattcggaaggaactgccaaaggcaaactttatattgacgatgggaccagcttcaattaccgactgggtcatttcttggaaatcagttttcagtattctaacaacattctgtcttcagagctcaaaactaatattgctagaaagtttcaggattcattagatgacgttttggttgagcgggtaattattattgggctaccagacgactttacttctgtgaaggcaaaagtcacccaaggtgagaaaacgtggataagtaactggacgaaggagaatgggtatctagtagtcaagaaccccagagttagcatttcccagagctgggagattaatatagaagtatgatagtgatatatttacataaacactacttttgattaatccatgtttcagttagtggcaagccaaccccgaaatgttgttgctacctgtcaggtagaatcccacaacagcccccataaccacactgagcatgagccataagttaaaagtcataaatatgagcattatgaccaaagaccagaatatttgtatcccatacaaaatggaagccttaactcgaaactgttgcaaatctgaattgattagcggcctgttcagagataaaattctggtggaccaggttgaatagaagcttttgtagaattcgtagcctataccaaaaacaactatgatggcacagcttaaaagtagatctcgaagtccataaatatgccatctggaagacaagacacagatatcctcaaattccgtggataacagcatgttcattttgcacatgtgttcaggcattggcatctcgtggcccgacgaagagtacgtgcgagaagtttcaatcatactaggtggaaggctagaatcactgtttaacaattgtgctgtaattcttggagctccaaattggtaagttttgttgcacgagtgtggtataaataaatcgcaccttctgttgtattttttatcgaagttagaccccgagactttatcaataaaaaaaagtagcgaatggccagatgcttatgtatcagactagttgtcatgtaaatcaaaactttacatcaattgatcattcaggttggctggttgtttatagtcaaagtaaatggtaatcaaattcattcaatattttttttttttttgatccgtttgactttcctttgtcgtgttggccaaagatgacgaattgtagaatatacacaggactgccacgaattttaatcaactggcaagtaatctaactttttcaaagtaaataccagcatctgttttcagtaaatgagttttgtaaacagagaactttatattacaaacacgccgataagtaaaaaaaaaagggaaacataccaaccagtggtactcagttaccttgccatattgccacttttcagaataggatgcctttgtccggtgggtttctaaccagctcaagaggtcaatacaatcgatgatcagaattttcaaatttcgaaggatgtgcaaggaaattatggttatcacttttaactatacaatgtgtgtattgatctactaacagtagctatgaaacctttactttctgagtcttctagcaggagccctagttgaagaaacaggaacaactgcaattggcagtttgaaacccaatgagttgacaagttgttcagtgtctgcatccaagtgtaactggtccttggtgttggaaaggtccaaagcagaaacttctggaacgtattggtcttttctctctctctcctcttcttgcaatttaaaagaaatacctctaactggtccattttggattctgcgcatcaagtgggtggtgtaaccagcaatcttatttcttaaacgctttgactgaatctcagcgacctcagcggtcaggcgtttgttggtctcaaagtccaaagtgagctttggataataacgctcaatcagaaccttagaggctctcttgactgtctttgttctcacgcgtcccttttgaatagttagtatacatcaaggtaaagcttggagtaccgccgcatgttgccctctattctctcaaagtttccagaacttttgtaacttttatcgccaactccattagtaaatcatcagaacgaaaatcgaaactggcctcataaactaatgataacacaatttttgagctcaactaatacaggacgcactatgccaacaatctccttcattttataatacataccattttgttgaattcttagtagtgagttcaaaagaaaaattatttcaattaattagcctcgtctttctggtgtactgatgtggaaactgaacacttggtgcgcgacagtacctaagtgttctagatattacatacacgatgtgactgctgaataattcgctcacagtaacaactgctgaggtaactacattgaagtccaacacgacatcttacatctcaccttggataaataaatgctcgaaggactcctacaaaagagtgatcatatttgagacatcaaatggcgaagtttcattgcgacgtgtgctcttccgattgcactaatcgggtgcggatacggtgtgctgtatgcgaggagtacgatctgtgcgtaccttgctttagccagggttcattttccggtgctcataaaccttaccatgcctacaggattgtcgaacagaatgcttatccaatactaagcgaaagttggggcgctgatgaagagctgttactgatcgaaggatgccaaaaattcggtttaggaaattggcatgacatcgctgaccatatcggtaatcgctccaaggaagaagtcggacagcattatgaaaaattctatctctattcgattgattatccactaccggacctgacaaaggatttcaaagatataactcctgaagtgttcatacagcaacgcaaagcccgacttgaacgtaggaaaaagcagccgttaccaacacctaagaagcctttagcgtcggtcccgttatgctctgatattcaagggtttatgcctggtagattagaattcgaagttgaagttgaaaatgatgctgaactcactgtaaaggatatggtctttgatccggatgatcaaccgttggatattgaactaaaattgtccgttctggatatatataactcccgattgacaactagagcagaaaggaaacgagtcatatttatcaacggtttactggagtatagaaagaacgctagtatcgataaaaaacgtacaaaggaagaaaaagatctttacaatcagttaaagccatttgtaagggtactaaccccagttgactttgaagagtttacggaagacatgctagctgagttgcgatgtagaaataagattcaacaactacaagagtggcgcaaaaacggattgactacgatggagcagggtatccgttatgaaaaggaaaaaatctcccgacaggttcaacttcaaaggtttaacatcactgcaggcagtgctaggcatcctaacagctatcaacaactgaataactcttatgggagaaggtcgcatgctaactcgcctgtcccttacgaaatagcaaataatgagccgaaaagatcctccaaaaccatggtaccattggatatatcccacgcggctgattatgagttgttatctgacgaagagaagatcctctgctcgacattgcggttgcttccaaaaccatacctagttatcaaggagactttatttcgagaacttattagatgtggcggtgtcttaaagaaacggacagcgagggaactgttaaagatcgacgtgaacaaaacttctaaaatttatgaattttttgttcaacaaaaatggtgtaacatcaatagtgcaagctaatgattactgatacactttcactcagtgaatagtatacgtgtggtttttttcgtcactaattatgcggaggtattttgtttttcactttatttctcgtaccagaagtgaaattcaattactctaattgcttgaatcacaattccattcactcagttacgttttcttcaccggttgtttttgttcggcttggggtgacatctatttcttagattgaattctccatgttggtcgggtactacacataatacataatattttgacaagaagaagtaaaagagaataacagaaccgaatgagaatatgaagagcttagctcttcagtttcaattgctaggtggatgaagctcggccacagactacggaggcacatgtacagccaacttatattcaaacaaatgactacttcttcactaccatttttcccactatatgttcattgatgtatatatatttagtgtcttagtagggaagttgcctttgaagcattgaaagcgataagctgtgcattcactggaaagagttttcccaaaaaagaggcaaacggccgatgtgataggaatgttacaatggcttatcattagcaactgaaaattaatatactatctgtttcagttgccagttttgagctatcgcagagacaggacatcaatcaactgagatcaaaactggcttaattagtagaaaggcgtatctttccctccttccaaacatctgggctgattctttagatctcattccggaggctttatttacagcaaagactgatacgactatatcattaatgttaggcatctatctagtagtagaccaattatcaatactagagcacagagcggtctcagtacaggagtgtcctggatatacaggtaagtcattgttaattatttgggaggaaacacaatatgttattgtatgcatgaagatttggctctgtatatacgcttcatcatgacagcagaaactattgcgatcttattctactggtcctccttaattgacgtctcataagtcatgtggtcatctaagtaaaaaggctcagtcatggcttcaataaaacaccataaaccaacatgctgaattcaaaaaagaaaggctatcacacagaacatttgcatttctttactaattgttgtagtaaaacagctcttgtatcattttcttcgtttctacatgcttccaaaagtttggttaaaaactcaacatagccatttctagttgagggctcatctagctttagataattcttgacagacagctgcagcttgattggaaactctggtgacgaaatagacaaatatcgcaatggaagcgctaaagcaataacaatatactccgaacatttgggatccaatgaggacatgtgagttacaatcgaggaaacaaggtaatctctgtcaagaacttcaaagccgtcaacaattgaaataaactttttcaccaatgatagagtgtatcccttagagtttctctttgttcccgtcaatgtatctacagctattcgaaaaacggcgagggctacatcacccttaagagcagggttagaatcgggatctcccagcatgtcgatgtctgtttcgggcaaattgtttagctcaacagtgcctgaagattgaaaattcccagtagacatgtcttcatgtagttgaattctctcattgatttgtctctgttcattttccttcttgatttcatcaagctcttcttgttcaatttgtagagcggcactgttgagtcctaatatttttcttcgtaaaagcaacttcgatatatagctcaattcgaatacgaaataatttagccacagcttgtcctgttcagagttgaatctaagagctctctgcaacaggattcgggcgttcttggcgtcggcgttctcttcaaactcaaatttagcagcggaaatccacaaatcggtatcagttggatgtaactgtagcattttgttgtatatttgctcaacgacattgatactaccaagttccttagcgtattgcaaatataaggaccacaattgtagatcaccatgaaattttctaacggccctttgaaaaatgaaaagaattttcctttggccgctccaatcactgatcgattgactcatatcaactatccctgttggcgataacctctcaatccgctttctcctaagattatctaaactcatttcgtactgaatgtacttaataaagtctgcactcttgctagctctacctgcaattctatgttcaaattcagttctccttctcattattttgtttatttctgcttttgaaaaaacattctttctctctagatcctcaagctctgggaccgtctgctccaaaaagtatcttacattttctgccatgtcttattttttgatagaaacaagaagctggatcttggaaaaaaaaaaaataaaataagaaagctagtgggcttgcgcacgtgaatagtcatgtggctcagtaagatcgtgctttgattaatgataacaaaatacattctctccaattctaatcactcggttgcagtatgttgttgaagatgcctaccacgtctgtagggtgtctcttatttgcatgctatcacgttgcgaagtagctacttttacggataagatgacagaaatccacttcgttgatatatagctaatacttaacaacgattaacgaaaggaattatagaggacagttaaagtaataaaagcaaaatccaacctgatgcctaatgaacgtggacatgccagaaattaaactgtgttccatcctgagttattctttggtgtacctttcaattccccctgagttgctacgccttctcgcattcttttctatttcggttcaactaccagtaacgcttacataagtctaacgataagataaggatcaatttgggaagcttaaagaaagtaccttaaaggggcagggccatctagcactttaccgataccatcaattgaagcaaaacacacagccaaatttctgtaattatcttttccatttggagctggcgtttgtttctgtctttacgattgtttgatttttctttaactactatataaagcgttgcaattcccctcaaggggaaaaaaaaagaagtgtgacttaaccccaaaatatgatcaattctcattttattacacaacatcatacttcctctttacaacaaaatacaaagtcaagtagctggacaaataacaatatggaggaatctacagaatttgatccattcaaagtgaatacctccctttggaacacactacctgcaacgactttgagtagcaatgttggtctcaataaccacaatggaaggcgagggtccctgattgacaacatcaagtcgccaacattgcctggtacttcctatatgacttctccgacctccgtaaattcggaactcggcaatccaataggcctgagaagagcctcatacacgtcggatactatttgggaaacagacaccagtaattttaacgatcagaataataataacagttggtccttagggtcctttcctgcaccaccattttcagcgccttcactcacccacgctgctaatggcaattacgaatttcgtcgacattcttactctaacgactggtcgtatgaggtgcctcgcaatgaaattaatcatgttatggaattcgccgaatcttatttcggtgatacgtttacaatgaatgacaaacacattcgactacatccaatgttatctgaaactgatgaactctcatcattcagatctttagatcttccaagtatcatggtttctaataacgaccaggttcaagagttaggcccggaactaagtctgatactaatcggcttcaagaatggaagagctgatatattctatttcgaagacagcaatattcgtccttctctcaacgatttggtaatagtggaagcagatagaggtcgtgacttgggcaaagtacttaaagttggaatagatctttttcaagctagagtattcaagtacaaacaattcagggtgcaacaggcagcattaatcagtgacaaggataattctcatcaaacatccaactcaaactttttcttccccaagcaggtggttaagtttgccagcaattcagaaatctcacaactgttaagcaagtctgtagatgaagaaaaagcaaaaaacgtgtgcctacttaaaattgtttctcataatttgcaaatgtctgttgtggatgccgaataccagtgggatcgacgcaagcttactttctattaccatgcttcccacagaattgatttcagagatctcgtacgggaactatttcgtgtttacaaaactagaatatggatgtgtgcagttaacctggaagttgctgcttgatattaggatacgattgattatgttagacattatttgagactattattttctcgccacaaaaatagcggtgcagataagtagagtaaagggtatatggttttttttacagtaggatatgttgaagtttgattttttgtatctctgtcttctttattcgcgcgcctctttagctttcgctgctcagacgtgcaagctacttttccaatttctaatgcccataacccaaatgatggtactaagagggttgcaagttggctttagagaatactcaacatctcttgtcaatgcgatttcaaatgctccaacctacttactcagtactgtccgttcgtttccttctttagaacctcacactgtattgcctatatcaacagaatttttgaacagtccacttaggagggatttgctatggaaagcagtagtgatggaatttgacaacatacgtgtaggtgcttcgaatccacctggtaggggtgaacataagttctccaggagaaaattacgcccccaaaaagggtctggaagggctcgtgtaggagatgccaactctccgacgagacacaatggagctagagcgctagctagaaatgcgcctaatgatttctctactgatttaccgtttaaagtttatgctagggcttacagaatagctttaagcagtttttacatcaaggggcatttacatatcattggaggttgttcatcactcatccctttcaatcgaggtgatcaaaatatactcgagctctctaccgacaaaaaagaggccctggaaattttccaggcaattcacaatctaaaaggactgaatattctgttcatctctgatagcttaaataactcacagaatctgaacaaagccattcaggctttaaacgatgaccagatcagcctgttggataaagaaaatgttgaggttaggcatttattgaaagctaatagagtgttcattgatcaggcatcactgcagtttttcgcgaaggagtttgctggctgatgcatttttgtatatagttacgctatgtaaatagtcaaaatagattcgctccactgtttaagggtcaaaaattacctctccaaatagaaggaggctagaatttaaactaccgataaccatgttcgaagaaacgttggaaggctcagccagattcttgacaagctcgacaaattgtttcttaagactaaaaactcactcatacattctagggctcaaccctaatgtacaataattgcacgtgcacagagaatttacaccctcacataatctcactgtttttcgaatacgaaaaaaattcgttttctaacttctcttcactacagcaacatggctaactcatctctagttgttcaagaggctaatagtttccagcatattctgcgtttgctgaacaccaatgttgatggtagaatcaagatcatgtacgctttgaccaccattcgtggtgtgggtcgtcgatactctaacttggtttgtaagaaagctgatgttgatttgaacaagcgtgctggtgagttgactcaagaagaattggagagggtcgtcaccattatgcaaaacccaactcagtataagattcctgcctggttcctcaacagacagagagacactgttgatggtaaggactatcacactcttgccaacagtttggagtccaaataccgtgatgatattgaaagattgaagaagatcagggctcatagaggtatccgtcatgcatggggtcttaaggtcagaggccaacatactaagactacttctcgaggtaagtttattggtagaaactaggtacactaggtaatttcctattgtatagatcgtgaatacgaatacactaagatagtaatttgcacaccgttacgtaatttatgattctatgttggcctacattctcctcgtcaagagctatgtaaacttagaagttgcttgacacattcttcgtcttcgtctctgctaattttgatacttggtgctgagttcgacttgttgagttcgcttctagatttgtcttgaaggactaattgtttggacggtgtcttggcgttatccaaacctcgtttaaaatcgaagttttgttgactaactttcatgatcggtttgttcagaaattcagcgtccattctttcactcacatgcactaggtttcggttggcagatccagaaccagaactgaacggtgatgaggattttcttggacgtggtccagttgcttgcagtctgaaagtcatagttgatccgaaatcattagtgattgatgacctagagattagttgcttgattggggtggaaacaactgcagatgtgtttagccaagtaccttgaggaggaaaatgagagggactctggctttgatcagaatttgggatagagttgtgaacttgaccattatctgaatctgtgaagtaagaattcgaacgtaaaggggaggttgtaaaatgcaactgctgggaaatcggttgaggtataacaggatctagaagtatttcttgttttgcttgattatgcttgcgcatcgattgccttctattttgaaaccaaacttgaacagctttatcagtcatgttgactcgcctggaaatctcctttcttcgagctctgtttggagtactcccttttgaaaactcttccttaagaatgaatagttcagcgggcgacgttcttcttctcttccttcgggcaagttgtgcattatctatggtaggttcttgtagaggaaatgtctccggagaatgggaaatgaatgcaaataattttgtattctgtggagtcttctttgcggaagaatctagactcgtaacagaaagcgttttcggtacagatatagattcaggtgtatgctggaaagaaggattggtcactctggaaaaaaccggagtgccaaatgttgggtcaggtttgccttgcatcgccacaacgttactatccaacggaccgaaaggcggaagtgtgtgaacatcttttcgtgaaatgctagcaggacttaactgatgagacattaacggagaaccaggccggcttgtacttcgagttctctcatggcccaactggttacgaagaggtgattcattcaatattgcagatagtggtggcagttcaaacttgttaacagtaggtaacagcgataccatttgctctatagattgggtaaattcaaatttgtacaaatgagtaacgctacgagcgttcttttatttatgatgcaaagtattaaccaaaggtcaatattaataatttgaagtaggtgtttccgttttaggtatcaaaagctgatttttatttgctattgttgatttacgttggaaaactgaccgcgttttgtgtttactttttaggctaacgggaagtgagcccctttcccaggttgcagaacctgtgaacgagcgagcgactacattccttgaaatactttctgtcaagcatttaatataatgtttcaggggagctcagttatccctacgacaatacttcagtatcgtcaccgttaactctatactttaaaaattaactacttctttttttttgatttttgttaatgagggtggagacgtgtttcaattgctgatagtaaatacagtgttgaaagtcatgcatgagattgatattcagtgactaaatcttttcgttaaagaattaatcttaacaacagcaaatttcagattgtcctaggaaatctatggattcgaaattgtgcactattcataacatttgtgtaccaatggtttctatgaacacgaacctgactgaagcacagactatgatagaaattctgtctcaaagtaatactgtgaagttatacttatcagattcaaactataaattccatcattcataagtttccagttcttttacattcatataaggccaagaaaaaaaggttggcagcactttgagtattcgaaggcagagacttgcactttttatcgcaatcttccgaaaaacaaaaacacatttcaccttgcttatagaagcttatagttttcttgaattcaaacattttagtcattggttactataccattcccatgaagtacaagatctagatctggacagaacacaatatacatttgatgtacagaggtgctagatttgctcatttatctcatcccctctcttcgcaccccttcgctcctcttttctcccctcttgctgctgaatcatgatcaccttcatcagttaccctccttattatttgtataaattaattgaagatggcaagtactttgattgcttgaaacaacaaacacgcgtacaaagaaaacttcaagaaaatggtgtttcaagtaaatgttcctgtgggcgaagctagaaagggtgaaacagctcccagaagatactacaaggttaaagatgcagcggtgctcaaaccgagtgactgtaacccgaaaactgaaactgtttacgattacttggttgaaatgtttgaacgacatgaagacaacaaggctatggcttggagggatctcgttgatattcatactgagaagaagaaggtcaacaaaatgattgatggtgagctaaaaaatattgaaaaagaatggcaatattacgaattaagtgattacaaatttatcacttacaaagagctgaaatcgataatttttgaatatggccggggccttgtggaattaggtatcaagccgaatcaggaggaacggctgcatatatatgcttcaacatcacacaagtggttccaaacatatttggcaactcaaactcaaaacattccaatagtaactgcgtatgacaccctcggtgaaagtggtttaactcattctttagtgcagacaggttctgtggcgattttcaccaacaatgaccttcttcacactctcatcaacccgttgaagaaagcggtttcggtgcgttttattatccacactgaaaaacttgattccagtgacaagagatatggtggaaaactttaccaggatgctcaagtcgcaattgatgagatcaagagaactcatcccgatatcaagttcatctcatatgatgaaatagttgccttaggccgaggctccaagttgaatgctattcctcccaaagctgatgacctttcgtgtattatgtacacatcaggatctacaggcactcccaaaggtgtggttttaagtcatagaaacgtacttgccggtattggtggtgcctccactttagttcctagaagcctaattaatgggaaagaccgaatcattgcatttcttccattggcccatatttttgagttagtatttgaattgatctccttgtggtggggtggatgtttagggtatgctaacgtgaagactttgactgatgcttccatccgaaattgccaatccgacctgaaggccttcaaaccaacgatcatggttggtgttgctgctgtttgggagtcggttagaaaaggtattcttgatcagctgaacaaatccccttttctattacaaaaagtattttggggagcctacaaaagcaaacaagcaatgaagtactgccatattcctggcacttcaattattgatgcggtaatttttcgcaaggtaaaggctgctactggtggtgaaattcgccttctgcttaacggtggatcacccatttctgcggatacccaacgatttatcacaaaccttcttgctcccatgctcttaggttacggtttaacagagacagttgctaatacatgtatcacggatatcgacaactttgagtttgatgttgccggtgcattgactggcgctgttaccgtcaaattaatagacgttccagaagctggttattttgcaaagaataaccaaggagaagtgttgattcagggagcatgtgttacaaaagagtactataagaatgagcaagaaactgcaagtgtttttgattacgaaaaaggttggttcagtactggtgatattggagaatggacgtcgtcggggcagctaaaagtaatagaccgtaagaaaaatctgattaaaacactgaatggtgagtatatcgctttggaaaagatagagtccgtatatcgatctaacagctatattcataatgtttgctgctatgctgatcagaataaatccaaaccagtagcaatcgctgttccaaacgagaccacgttgcgcaagcttgctgttcaactgaagctagcaagcgctgttgatgaggtcgacttagcaaaggtagtccacgattctaaattgatctccaaagtacaccaatctcttctggagacggctaagcagcaaggtctaactggaatagaattgattcagggtgtcgttattttggatgaagaatggactcctcagaatgggtttgtaacctcagctcaaaaattgcaacgcaagaaaattttggagagtgtcaaggatcgtgtcgatgaagtatataggcaaaacagttgagcgagcagccgattgaagttttctacggacagaatcttctagttttatagattactattgacacgatttcaccgtttttttttctacttgcttgcttggttccttgctgactatgactaccttggttactttctaccttgcttttcattcatagcttccaacgtactacgtagttcaattgtactttttcatttgtgagataacaagaccattgaaaaccaagtgattatcgagataaagatgatgaccactgttcggtaccacatgatactcacttgaatcgttactgactttattcatcagttcgtgacatctacgcccaccatgaacatccatccagtcatcttcaccataaatccaacatacttcacacttcaacttttgaattgcatctcttaaagggtatctgggaatgcctcctgccgcaagcagatagttgagaacatactctccggacccaggggcattgaaaatgccgtaagcgtacctgtgcaaagcctcctgttcagacggggtcagacgggcaaaccgacgggaagtccagccacttaccagcatgcttcctagtatactagcgtatctgacaatgaaaaagggagaaacatttttgttccagagataattgaaccaagtgggaactggaatatctgattcgggtgctgatataccagcaggcgaacacatgaccaaacgatcaaaaaactccggatggtgcatgttgaataacgcgcaaaggtacgctcccatcgaatgagctacgacaagagtatcatctctcggggatgatactctcttttcgaaccattggcggagagtgtctgtaaaccactctgtcaccacagatgacgttaaagattctgaacatggaaattgagggcgagatgaacatccgtacccatacaagtcaatggcgtgaatcatccaaccatttgaacagccatactcagatattctgtcaagattcttgagaaagaaacccaaaccggcaccataaccatgcacgagcaccaaatgctttaggttcgggtcatcgtggcttttcccctttgggtagatgcataactcattgataaaacccgtttcagaaggtattctgtagacaggaactttcaaaatctgaactttgcgagtgtcatctccgtcagggaaaaatgaaagtagtgagagaagctcatgttgaaatttgtctagctgtaaacggtctttataatcggataacgaatcgataaaagaacgaggaaatgagtttgaaaatatttttgtcaagggcacaccagccggcgctgtactgcgccgataggacgatctgtacaatctcggtagtgtgccacaacgcatccttaactatttactagttcaatgatagatagtatactccactacccagtgaattgtagacagttcgcgatcaatagtacaattgtatctgattcgcgaacaacaattaaagaagaggttggatttttaaacaaataagaacttgctcctctcaattttcaaacgataaacggaaaaaaaaaagcctcatctactatattattctttagctgctttacgttcaccattgagagaagattaaaaaaagtttagaatcatcattgaacgtaatcattcgttgcttggtcatcacttttttctactcgattcgagggcgcgaagagaagacgattatgtaagtatagaagcaagtatattaaattcaacttaatctacttcaattcatattgaactgatgcatttcgtcacttatccaatattactctaattatagatcactattcagtaaccgttagtctcaatcggaggatacgatctattgtttactttttttccatgaataagtagcggtcaaacttcgaggtggtaaatataataatatcactgtgtccagtactttattcaaaaactaatgtatttagtcgttatacatatctgtcactttccgtattgtggtcctatgaattaaccatttaaaaatattgctattaatgattatgttaggtggattaatgttgtcattagtacatatattcgtattttaacttaattactcattaattaagtgtagaatgtcatttcactggatttaacttgctttgtaagtacgaaacaatgctcgatcaataatcaaacagtttagttcagagattagattcaaatataattctaaatttatagtatcagaaatatatattaaggacagtgttaattttacctcatttaaactgctgctagccattaaacgattgtgcttttttagtccatgtttaagaacaaatgaccatttgctaaacctactgtaatcttattataaaaatgaagcctacaaatcatttcttacaagcaaatgattttacagccccttgtgctgaatgtatagtacacattggacgaggagaaacgatctaagtggccactcgtaggtgttaatgatactattcgctcgaacttaacggtgcttaggattctacttaatccttgcacgtgacaaggcttaaattaagcttgttttctgatgtgtgtcaaaaaaattttagcttgacatatatcgaacgatacggcgtattcttaggcaacaatttcaacttcttcgcttatttgcaatactggtatccacggggtaatgccaaacttaacaaacagtaatggatttgaagctagcatgctgtatttcaaggagcggagaagcaaagatagccccccttagattaaatgcatgtttaagctttcgaggcacttttctgattaatgcataagcctgcaggaaaggattccacttatttagtaaaattatcagttcaatcgccaaataaaggcacaacaagaaaaagaaacaaaacaataaaatttcaaccttctttcagcgtatataaaagaaatttactgcccacttcctcgaagttttcctttcccctagctgtaaccactgccgccaacactccatcgaagaatgtttgtattcgaaccagttctgcttgctgttctagtggccagtacctgtgtcactgcaaaaacacatacatggaacttcactacagggtttgtgaatgctaatcctgatggagtttatgagcgtgatgatgtaatagggttgaatggacaatggcctcttccagtgcttgaagctgataaaggagatcgcatcgaattgtatttgacaaacggattcgaggattacaacacctcattgcatttccacgggctgtttcagaacggaactaactccatggatggccctgaactaattacacagtgtcctatccctcctggagaaaccatgttgtataactttactgttgaccaagtaggtgcctattggtaccattctcatactgccggtcaatacggggatggaatgcgtgctgcttttatcgtccacgacggttcggatgatgatgactttccgtatgaatacgatgaggagttcactttcacaatttctgagtggtaccatgaatcctcagtagacttgatcccgaattttatgtctcgtttcaacccaactggtgccgagccaattcctcagaacttcttatttaatgatactagaaacttcacctggaatgtggaaccgagtaaaacatataaggttaacctgataaacgttggtggatttgtctctcagtatctctggatggaagatcatacattcaaagtggtccaggttgacggtgtttatacacagccaaacgaaacagacatgatatacatcacagttgctcaacgttacactgtattgattgaaaccaaagatgacacctcccgcaactacgctctaatgcaacgtgttgatgacactatgttggatgttatacccaaagaccttgaactcaacggcactaattacatcgtgtataacgagtcagctgggttacctgaagagtataaagtagagtcattggacatatttttggacgatttttggcttgaacccttggaggcacaagaagcttatcctgatccagactaccaaattgtcgtggatgttgcaatggataacttggacgacggtgtaaactatgcctttttcaacaacttaacatacgttgcacctaaagttccagtattgggtactgtcttttcggcaggtgaagatgccataaatcctctcgtgtatggatccaatacaaactcatttgtcctagaaaaggatgaagttatcgaaattgttttgaacaacctagatactggtaaacatcccttccatttacatggtcatgtgttccagacagtcgtaagaggtcctgactacggtgaggagagtacaccagtcccctataatgcttcagaagcacatgacatcccagagaatcctatgagacgtgatactgtttatgttaatccccagtcatattttgtaattcgtttcaaagctgataatccaggtgtatggtttttccattgccatattgaatggcacctggaccaagggttggccctagtactcattgaggatcctttgtcaattcaaagccagcaaaatcttgatgacaactggaagcgtatgtgtgaagtaaacaacatgccatacgttggcaatgcagcagctaataccgaaaactttttagaccttacagatgagaatgttcaagtcaaaaatttgcctgcaggctttaccgcccgaggtatcgttgcattggtgttctcctgcattgctggtatcctcggttgtgtagccattgggttatatggtttagctgcgacagatgataaccctgttaagttgagtcaggatctgggaattgatgaggagtttattcaagacgagacgtcttcgcaattgagtcacaatggttccaaagatacgaccgaaaagactgcaactgagttattgaactgataggttaatatccgaatattggtgatacttcaactattcaaaccgaatcgtgtgtgtgtgttcttatcgaattagtgtgtttgttgaggtaatacttttgtattggatattggagccatagtcataattcctaagatctacgatggatcttcatttggaggagtggttagattattgttacttctatttgtttttgtttctgatagcttttaagaaaaagcatgtcttggatgtgtgtgtgtggttactattggtgcatccgttgaaatttatgaggacttcttaactgaatgttcttgttagatattgtgtgtatattttaatgtgatcaattgtgatttatcactcgtcagaagattggtatcatcaacatggacatggttttggctaacgaaatgacaagttaactaaatgatgaactaataccctctagtggtgtatgggtgttcatgggcactaattgaagctacatatctttttacataattccattggctctatcaccacatcattaatcattatttcatggattcaattgttataactgacgaattttcaaaattgctttaccagtatctgtggagtccaacttctatttctttcggtagtttgatggcacgtttgaaactaatgccctctcaatctgaaaattggctttatattcaatgtgacggaaaatacatcatcaagtatcctaggaacggaataatagtatggttggtttgcctggaacatgatccatttgtatatgccctgtttgtggatacatttgtcaaggtactcgaagaatatattggcaaaccaacagccgctacaatcaaatctcattcggataccatatctctgttgctacttgatatggctgatggaggctttcccttcataattgatgataatcagatcaaagatttgatgccaaataaatctattatggataaaattttatcttctacaaaacaactcacgaagacagcgaataactcattgaatagaaatgttgcatttaatacctttgctaatcagccttctatgtggtccagatccaactattcaattccctggagaagaagcaaagtttaccatactaacaacgaaatacttattgacattgttgaggaattaagcatgattacattggcacacaatggcactaaagatgactcaaattcttccgcattttacagttctgccgttcgacattcaaagaggatgcccttagtgtctaagatcaccggtaaaattttagtaaactcacatctaagcggaattcctcacataaatctaaggctgaacttgaagcataatcagctaagctgtccttcctttcatcgagcagtagatataccaagatggaactcatcgtccggtttaatatcatttgttcctccagatggagtttcaacactggtatcctatgttactgatcttgatagacaccaggattttgtagacgtgcagtacggtttttttcaagggaaacggtcgaacgagtttgaaatacggctaacaactctcagctcatccagggttaatactatagagaatctgaaactggagattcaccttccaagagaacgcgaatattcggtgaaggttctacggtgcactcatggagacttgcaactgtcacgtaagaatcgatattatgagtggatttttgccaaagaggttccaactggtataacagctacattcagagggtctttggtcgatggttcggatccagtcgtagacaagcttcgacctagttatttgcaactgtcgtatgagaataagcattctcttttgaccggcttagaagtacggtcgatagaaatcgaaaaaattgaggggctcagcaatcaggtaaagccttacaaaggagctaaatacatatcccgagtcactcatttgatacgatgaaatccattttccagtcaatcatacccagataagttaaacgtacatgaatcaacttcgggaaattccagtgaaagcttacatccatttggtatctttcaacctaagtcttggaaccatttacaggcggttcaatagtgatatctcaaagagttcttccaataataagacttcattgcgattttttcgctcacgcagaacggagctactagggcggactttgatccttttgataccaatgttgttaggagctataaatcattaataaagtctttttaaagatgctttcttacacaggttctaatttgattgcatctcgcgttctagcttccatgatacaatgctgttcctatttgtaagtacgtccattcaaagaacagtgaggctccaggtgcatgaatgaatcttactgatcaacctgatgacatgttcgattacgcacagaaaattttttgccacaatttcacatggacttttttacttgttgatggccttattttttgtctggtaacgattctttcgacatctccaaatggcttaatagggtgtcctcgtattgtatctaaagaaactttttccactcttattcccaacaaaactagtggctggaccaacatttaagtttttacatcaaagtctttcattacgatcaaatattatcatctatcacaataattaccaagcagttgtcaagctccgcgtaatgtaataaataatcttagttctgtaagcatgaaagactgaaaaatctgattcgcgcgcacaagttgaaatcccgttcgaagctaagccagcttgggaaattgtgtacgaaaacattagactgctaaaactaaaacgatttgggctattaagatgagcactaccgtcccatatgatccagaagattttgacaataatccatttagcgagcaggtcataaagactgtagatgcaggaaagcagcctaagtatgcaaacccccaaggggggcaagggcattcgtcagtcaccgctccacttcgactacctactgactccaaccaagagcctagctatcacatcactaccaacgtagaaaacgagttggttatgccaacagaaactgagattcgtcggtttattcctgaaaggttcaaccagaatcgtagaagtatctgccttgtgataacagatatagagaagaacggcactgattcatctgcctttaaaaatccggtaataaaatttgatgcctttataaaaggactcaatggatttcgaaaaaactcatacaaggatattcgaaggacctacaaggaactagagagttttgccaagtacctgaatatcaacaatattgaagtgtttgttcccggattacctagcataccaactctttataatatgggaagccctgaattcaaatcatccgtttctaagttattgcaagagtggatggatagaatcaccaagaatcccatcctgataaaagatcatgatttcgtactgttcttggagaccaacgacttctcttactcaccaaccaagacaatgagtcaaagtatcgttgccactgggttgagaaggaaaactctcaagcaattagcaccaccttttgatgcatgtcgaagactagctgagttcaggcctttagtcaaatctttgtatatcgtatcacaaaaacttgtgtccctcttggaaagaatagggaagttggataagaacatgaacggcttgtactcaatcttctataggcagctacgtgaactatcaatggtcgaagtggaagaagacatgccaagactatggacaaaattagaaaaagtcatgcaacttttcaatgagttagacttgatgaaacgtcttagttacaactctgcattgaatgaatgcctactccttgttattcgtgactcatttactatcaaagagtcgctgacaaataggcatttgttgatgagggaactttctcaggcgaaggattctgcaaggaaaaaatttgagcaggtgcaaaagttgaagtccaagccaatcattgacactttgaaagcggacgaagcgtcacaatcattggaggctgttgttgctcttgaaaaggaactagaattcaaggtggatcgcttgacttacaacatgttaattgagtctgaagaataccttaattacttcacagaaaccgtaagagcattgtttcgaacactagcatatcagcaaatccagtttgaacgtaagaaacttgcactattagctaatgccaaactaatcgacgtttctcattcattgcataggctgggcagagaatccttgcctttgagaaaagatcctaatcgaatagaggcttggtctggtgggtcttcctctagaaattccacagctgatgcttcttttgaacgcgatatgcaagaatatgaaacttatcttgataatgattttgatactgtgctcccggtgctgaatccttcagcgcagtcttcaaagaaaaaagttagcacccagtctgcaggtaacaatctcactgagtttaatgcgaagaatgctgctaatctgctcggtggcacgacattttgaagtctttggttgaattcttgaagaactactgagatagatggcacattgtactttctcaactcttagcattaataaacttacccccagtgctgaatgttgcaatataggcgattgaactgaaacaaaaaaaagcaactaacctatcataaaaaggaccttttttgcgctttaggtttctaactgataattcattacaagaatattaaattttgaacactaatgaaccaagggaacgtgaagctttttttcggatttatctaatgagaacttaaataataggacccatgtctttggaagtttattctacgcttgtgctactattcaggtgacactattattccgactcaactatatcatcagccttagttactgatctcaagagtcctctggagaaaattgccatttcatcttttttgggtatctactagtgaaagtgctttttcttcagaacaatcgagagttggatataaactctcgattgtgtttagaaactattaggcatgcttagaattaaactcttagatgtatcgttgataaggtacaacaagataccagaggacgaatcctgctgaccatggtggagtgcactgaaagctccaaacgcctaaagatacatacacttctcatgctaccaggaaagtgataactcgtataaacttaattatttgtgctatttgactaatgaattcttaaagacgtagccaagttcatagtggccacttgttctttcgtagttttctcacaggatgcttctggataatgcatccgccaagtaatgttgggaagttcatcatttcttgaagatctttatgttgacatctttttaacacccttcaaagttgaaatggagcgtaacaatttgaacccttcaggggaaccaacagatagaccagttcataatagcttcccggactcattgattaaaaatattttatgcgaacgagcccaagttaaggcctttctcaattcagtccatcaattaaaacaaaactgtacaaacttaaaacatgagaacagttctctgggcctttttgctgagtcttatcttacatctgctggggaattcaaacgaaagctctgaaggcttcagtttcaattagattcactatttttttaatctacaatacatttacttcgctagcatgagaaagaaatgctatactttccggggggaggggggctcaatgcggcgtaatagtgaatactatcacagaaagaaacacaaatgcattatgtgaattagtgttaatagcttactggtgctaaataatctaagtatgggaaacattcaagacgagaattccaaggatggaagactaatgttgcccacccatgattcttattatgactacaactttgatagtttaaaaactccaggatccgttggattcataggaagaaaggcttcaaagaggaattcagtaatgaagagaagggacttgaatttaaagagggtcaaggatgtaagtcattcagtacgaacagagtttaatactagtttggatactgggagctctaaaagttcactggaagctagcgccaaacacactggaagtgaattacctaagacaggcaaacaacaatatatcttggtcagtcatgaaagtcaagggggccctttggctcctctggattcgtttctaaatctagatgtgttacagtgtgataaatatactcaggcaagtccattgcataacatgcttgaaatcccttgcgatcccatagggtcctccaatgaacgtatgttactttctatgttggatcaggagtgccatatccttagaagtactgtacccaatggtttaacgcaacgatggaatgataagatttattcgggtctgaggtttctttatttttctttacccagaatttccttacttcaaggtgaggaatgcagtttactgaaatcgttaattggttgtagggaatgagcttctacgaaaactggttcgaagcaagcttcgaatacaacggatcaggccgaaactcaggataaaaaataatcagcatataagctagtgcattgccacacatccaaagggctaaatatcttggtacctatggaaccgacctcctcctgtaagatttctctgaaatgtggtaccaagaacttattagtcactaaaatcttgttctgtaattcttttcgaatatcaattggcagttcttgtacgagttccatcagtaatttggaaactgactgttcttcgtcgtccaatggatgttcattgtcttctggggggaagaaaattcctttgacttcctcagctgaggccgaataagcagcatacttttccaactcataaaaaactgaatcaaaatcattaacatctatcgtacgacttccgctataatgtaagattttataacccctgtttgtagctttgactgaactattgagaactctgagatcatacacagggattatgtatactccttcccagctaacatcaactattatagcatttcggataccagacccaaaacaatacaataaactctcgggtatgtattgaatagatttgaaccttaagtctaacaaaactttctgcaaaatctgctttagatgggaggggaaaaaaaagggctcagggataattacaccataatcataagagtccataataatttggttcttgtagacatcaaacaaaattctttcaagtttagacgttgttttgcataacagcgaactagcccccaaaagataatgctggaaagtgtaactgcttttgtcataggtccaaaggatgtgttgattgaatagatcgtacttttccaagtctttgaaaagttggtttttcaaaagatatttaaacgtctccaggctagtcatgtaactgctatcaagacagttccattttttgtcatttatgtaaccttggaactcacagtattgtaccccagatcttccagctctaatacgaagatgatccaattgcaatataaaaaagttttcggatctagttgacctgtctttataattgaatccttccttttcctcatctagcatcctcgtctctgtttgttttgctgtacatctcattacaatttaaggaatcttcgcctcaagagtgttaacaacgcgattcacaaactccttaagtaaatgcgcttcaaactcttattggatctgatgatcacatgatcgcaataaaatagatagcaattgtaatcaacactcacaattaagtttcaatcaagcgaacgtttgggaaagcttacgttcatgaagaagcctccttgcgaaagatcgcatagctcaagatcctaaaacacttgccaatttctagattttggcggcgttaaattgaatagagtgaaaggttactgctatttaagaaccaggttggcccacctcgcggctttaatttgaacagaggtagttctgacgtttctcactattgaagattaaaaacaagtttacaacatgggagcagtgctatcgttgccgctcgcttcattatcactcattggaagttggatttcgtcctttattggtgcgggattggtctcagggtgtctttctgcaaacaatccgctctcaaaaacattcaagtcctctgtggcaacaagagtaatgtatggcttcttgttcttcattaacagtgtaatgtcttgggtctccttgtccaacaccataacagaatggttggaacgagccagttggggatttttacgttttggcaatgcatattgtagagagaatcactgtattggcttcactaacgttcatagagtaagccttagcctggggataatgcatctaatcttagcgggcctagtgctaggtgttcaatctaccagtgacaaacgagctgttatccaaaatggttattggcgcaccaagatattcgtctcatcactgcttttgattctaagcttcatgattcccgacactttttttgtgttctggggaaactatatctcgattatattttcaactattttcattggaatcggtttgattttgctggttgattttgctcacgaatgggccgaaacctgtattgaaagaatagaggaaggggaaatttatcttgacgacgatgacactggtctgttcacaagcagcaaattttggaggttgatactggtaggtggcacgctgacgatgtacattctatctgtaggtctttttgtgtttatgtaccttttcttcgctcaggatggctgcatattcaataccgttgcgatttctctcacattcggatttagtgtgttggtgacctttctgtcggtgtctcccattgtccaggaatataatactaatgctggcctcgcacaatcctctatgtgctgcttatattgtgcctatttgacatttagtgcatgccttagcgaaccagatgacaaaggttgcaaccctttgatacgaagcagaggtactagaaatctcagtattatttttgggtcctttttcactttcattgcagttgcctatacgacaactcgtgctgctggaaattcggcgttctctcattcacaatcttcttatggggattcacattttgattcggtgtcagatatattcacagcacatccacctggaagaagaaatgaattacgagctcaagcaatcaggcaagctgtagaagaaggctcccttcctgaaagcgctctaaacgatcccatctactaccaatacgatgaaaatgatacagaagatctcggcgaggagaaacattttacaaagtacaactatttcttattccatatcatattcttcttggccacacagtatgttgcggcacttttgaccataaatcttggtattgacattgatgacaatgatggcggatttattcctgtcggtcgtacctatttcaacacatgggtaaaggttattagtacatggtgctgttttgctttgtatggctggagcttgctcgctccagtacttttcccggacagattttacatcatgtgaaactatcaacatttctatttcctttctatggacatatgtaggtcagaaaaacagtctattgccctaaactttcttcattatatgctgtttgacatttgtttctatataattttatttatgaaagctaatcgcatgatcacgcattttaggctgctaatcccagggtttatgattgtcacaagccaagtcatggccatgtctcacattcctgatcacttttgcaagtcccaacttgcttgaaaatcgagcacagttggtactttcgagcagaatcgttggatacactgtgactgatgtggaaaaccgcttcatactatctaacacagttagagggatacgccacaagaagtttcacttcatacaaggaatatcacatttaatatattgttttccgccagtattatataagaggaactttcaaacaaggaatcaaaattgaaaaagagaatttgcatttggacaattgaccgtttaatgttgcttgtgggcaaaccatctttgagatttcctctcggccttttctccttctctacgtatgacttagaaagctctgcattactggacaaaaaggaaccacgaatcacgacccctaatgactcgaatgatattgtcatcagcgaccgttttgaaaccattagggacgattacaaagcacccagatacccgcttgtgttgtgtcatggattatctggatttgacaaggtagtgctgcttccttcgctgaaattcttgagtgctgccggcacaagaagacctgagttgagtggcttctcaatcgactattggaatgggattaaagaagccttgcaggacatcggctgtacagtattaaccggtaaggttccaccctttgggaccataagagaaagggcagaaaagttagatagcttcatagaagaagaagccgcatctcttttaaaagctactcacccaggagctgattctaaacctatcaaggttaaccttattgctcattctatgggggggctagactgtagatatttgataactaagttacagcaaagcaactatgaggtaatgagcctgactaccatagccacaccccactacgggtctgcaatggctgactggtgcctaaaatatgcctccaaggccctattacctagatccataagtgagctttccatcaatagcatgaaaactttcaatcaggaagttctggacaaaaacaatgtaaaatatttcagctatggagcaaggttttgtccgaacttatcctacgttttttttccgtcttggaagataattttcgatattgaaggcgacaatgatggaatggttagtgttagttcatcgaagtggggaaaatatttaggaacattagacaacgtcgaccatttggatttgatcaactggaggaacgaagcaagggttgcgatcaacttactcatgttcaaaaaaggttcgaaattcaatgccgttgctctttatttggaaattgctgatcagctagcacgagaaggcctataacaatttttcagattgtgcatagacttgctccaaatgatctgagcattgctgacagtaactcaagatgctggaaatagtctcttgaacaccgtccgtgatatctcgatctaatctccttacttggttacatcttctgctttcagaaaccaaccaatttctccattcagcttccgcaatctgcaattcagcatgattcagtattcgcaactgtacaagaaggtgattccgtcttattccgatattatcaaacgattgctttaaaatttttgctgattgagaagtttcgatatcactgtaatcttgtaattgcacgttgggaaaattgaatagaaaggatgtgttcataaattgctgataaacaaggtctgaggtgctattgatgtaggtccttgatgatatctggtctttgatatccgccagctgtattgatctttgcaacaaatacggtgtctccttcatgtaattggagagtaatgtacttgtcttgtgaaatgtgtaatatgatgacaccgtttgacccatcagcaacaagttcagtatcagagacaaagacaagcaaaacaggattacatggttggccgtcacgatgcttaatgctgatgcaataattagtcgaatttttgataatactccaaagctgaatttcaaggctttgatcaggcttttctttgtcagaaacaaaaatagtactgcagctctaatttcaacgacttctgcaagctgtccaggtggaattaattgttctttttgttcggtttgagagatggggccaaaactgtgtaacgctttcactatctcatttgaggcacccaattgtttcaacatcacctgtagctctctatccaatttcgtaactctgcttctaaatagtagataatacaaaggcctgaagagattgaacttagcggagttaaaaattggtctcaaataaattttcaaccttgatcgcttggaactcaccatctgtattgtcaccctagtttcggtactgaaaaaaatacctcctatattgagagtttggtcgatctggtaaaactcgtagtatctattgttgaccatatgttcaataacctgagtgaattccagcttcttcgaactaatactagtgattcctatgaatgggtaaaccttacgttccagtcctggaggtttcctaccagcatgccaagaagttctagcagtttcacttccagaagtttcaaccaatggaacaactttatgcagcatatcaacattatctcccaagaatgcatgaaacaaaaccttaggaggggaatcgtaaaccttgtcccatatcaaatgaaaatccttttgatagtcaatatcgattggagcctccatacttgttggaactgaatgtacaattgaagggattgtatctcttctttgagtagctaactctgcctgctcctgtccttttagttcatcaatgttattaaaatcggatagtaggctttgcaaactcctgggaacttggcgcctctgatttaaaattaacaagttaattttcttttgaacagccatccctgagtccaaaaatatcttaactttagacacataaccactactgtagtacagctttaagatatcacaatcttcttttgaatcacattcgatgtttatgaggtctgccaaattttttctaatcaatgagacgaaacccatatgattcatgtagaaataaatatgcttttgggtaagaaacgatcggccatataactcttgctctgagttgggtatccaattacatttcattgttagcatagtcttttcatcattagcaaagacaacttcaaataatgatttgagttctatatctgccagttgtaaatctacagggtaagatgaaggatagaattcctttttcgaagctggatagatttctcttttcatttcaggaaaaaagtacattccccagttaacggatccccatatattagctgtaactgcatttggaaaggagggaggggaaaaaagggcttgaaataagatagattctactgacaaactagtggtaaccggagtgtttatgaatactcctttatgaattctctggtacaaagaagagcagggtaaacctttgtaaaaaaactttatgtgttccagccccttggtactagtgagttctgtatcaacgtaagtactcatattcgatgcaaagtcttccattggtggaggaagctcgcattttacaaaacagtggttcaattctttgttcaaaattctctccttctgaatctttaacacagtcatccaagttttaagttccaatagcgtttcagcttgtaaagttattgagacgcgtaaagtcttgagttcaaaacaaaacctgcgttcttctccaggagcaaacttaaagtttataagacccaaccctatcttgtttgtctcctgaacagacaatttatcatcgcttaaagagaaaatcccaaataatccatctttaacaaacacccaccttcttacccattcgatcttattttgagaagacgttttcatgtagagccagccatgtttttcagtccttattcccggctcatcctccaagaaaacgttactataactcaataaactacaatcatagtcagtcagcttgctgggaggtttcattgaagcggtcatcatcatctcggtttgagttttcgttctttgtatgttacgcatcatgtcattggatgactgttcaacttgggttttccatccataaatccttttcacactcatttggactttggcgataccaagcaactggagcatgtctgggtttaaattcccactccagaaagagttggcaatttcaatcagtgtgaaattgatactattagtcaatcttgccatccggtaatataactcaagggagctttccagatattgctttcgtacttcgtataattgatatgactcttctttaatttgctccaatggttttgttttctccattttatggtgtaaactggaaaccttatcatatctaagttgaattgtctcaaattgcatcctctgtattttgtaggaatttagctcatttttgacaagattttcaaccaattttaatatacgggtgtcgaaatgaagtaatcgggaatattctaaaaagatcttcttcagcccctcaccagtagagaccattgcagtctgcgtgtaatcattgtctataacgccagaagtggaaacaacatcaggaactatcagcatctctataccatttgctacttgctcaactttacccattccgttctgtatcagagttagtgccgtataaattccgttgagccatgcttcaacctgttgaatctgctgattggtaaaattcacagaagcacggaaagtcggactatctaaagaagcttctttgaagcctacagagattagtttgacaaacatttcttccgactccagagacattctcttcttaaataatctattttccttagctagaggcgattcttcggatatcagagtttcagggaggtcatgtgatttgtaagttcttattatcagcagagggggattattatcggaatccttcgattgaaaccactatagcactatgaataaaataccaagagagcaggctagctttttatgcttgggttaaaagctggcataatatggacatctaaaataggaggaaggtataagttacgatggcattcatcgaaccgtagaaacatccgtagagtctatttacaggaactaactaaaagtttgccagaagatgacgcacttgttgaaagtaggaattatcaaagaaactggcagcttcatcgttggtcacccacttatactcaatattcatgggttgaaaagagccggcaactatgtgactctttataatatagtggcgttcaatgcgttcatcaggactttcgtaagttggtgccactaattcaccttcgcaatactttattactgcagccggcgtattggagactgtccagattttaatttgatttccacccagatctaccagacccttctctgccgcggtatgtagcgattggctttcaaggttaaatgagggaaacttccactgatccttttctttgactattaagtataatgtatggcttaactttctgttcaaagaagacatgttattagttttgtccgcttcagtaactcttgcattaacttcaatgggcctggacaaattcttttcgtcatttttgttggcttcttcaccaggaataaggatattttgtttgaatcgcctatctcttccatgtttaacatctggaataccttttggataccatacattgggctgttttgagatgacaccattctgtatatctagaaactttctctctgcaagtgttcctttcttaaaatagtagtattgcgggaaagttctcatcaatcttctctcaagttcagcctggtagttaaagtactctttttcaaaaggattcaaagctcgagtaacaattggaatgcggctaagcattagtgaacttttaatcggaccactagacatgtatctagcagataggcgtgggacaatcatgatgggacttcagttgtcaaagatgtggaacattgaaaattttgttataaaactgagtctcgcgagggaagtgggtgccgtttgtggggggacagcattacctactatatacagagttcgctcttatcaaatcgactgtataatattaacacctaatatctaatataaaatgaaatcttgtcttattctactacaaatcctttttctgtcgaagaatttgatctgcagtccatattgtcttatccaaaacagatccgagagttaagactcctgcaacgcttgcgctaaccccaagagcaaaagcagaccgtgtctttgaatattgttccctgttaattatttttaaaggagatatttcaaaatgaaaaaacgctcccggtattcctcctgaagcatgtaaagtgtttggatgatcagagtcacgaccaccttccaatggcctatcatgatacgtggctgaaaactggtttgtgtcccacttcaatcctgacatagactcatatctagttgctaccactttcaaaaaatatgaataaagatggtttttatttccggtagctgcctcatatccatcaagagggtgagtggacatctcctgattgtcgattgtctttccaaaagaaagatgattcacagtatgatcaaagttgaacttatccggatacttttcgaaaagtgataaatcatgaatatggcgggagccgctggttaacgaactcccaggagcaaaatgaagattacctgacactctatttatctgtgcagttccagaaacctggcatccttcatcaaccatcgaagtgaccagttgcacataaccctcattttcgcactgctcaatgttccttccgtcataaaaagcccatcctgcctttgcgtaagctttcttcacagattcgcaggtattgcaacagagtttctcgtcgaaaggtttgttttcattatctttttgatttaaagctccgtagcagctaccacagtaatatggattgttgctattagttaacttattgttctcttgcttgtattcattgacccttaattcagtcgtctcttttgccagaccatctactactcgagttttctgaaacccggacataagaaggtcaatctgtagatcgccagttatatccataatatccatcgctagaagttcgcaagggatgtgatgaaatgtcacattcaaagaaatgtctagcttttttgcgtggtctctatctaccactagctcaggtcgaataactactgtttgataatcgaagtactcgttcgtaaccagtatcaaagttacaatcaaacagattaacgtaatgacaccaccactagttgtcttaacttttacatcatcagctgtttttgcaaatgcgtccaagctaagcaatttcggtttagccatttatttttcttccactcaacgtgttcgttggacatagaacccaaccaaaagaagcgcaaacggtcgcgaaaactcttttcctccgccattaatactaccagaagcctggccaaatcgaaaatttcatttctcgaatgctaactccagttcatcatcattcaagtaatccaactccatttctgcttctacgttctttgtttgtaatttttgatgatcttttagctgttcagcattccatacagataccccttcttggtcctttggattagatggctgtgccaaagttcgcaagaacttttttgcattggcaatcgccatatctgttgacaagtttgtgtcagcgtctaacagattttgagcaatccattttggtaactgatttcttttgcgagagaaccttcggtccgctaaaaccataattccgtaatcgtctttgcctctcagtactcttcccaaacactgagcagcgtgtctcattgcgtcgaaagataaaaactcgttctcttttatctgatgatgatcccttaaatattctaatcgagcttttaaaattctcgactctgtatattgaaatggtataccaatcatcaaaacagttcttccaaaatgatggtcgaagtctataccttcgctaacctttcctctggcaacagataatagaacagctcctcttccatttgaacatgctttacggtatgtttcaagtcctaaactggtttcctgtgaatcaggagtctccaccagtatcaatttgtacttccatacttcgtctaagatgcccatattttgccacatcgaaatgatactctccatgtacaaatatgaagggaagaaaacaaccaacccatctggcgtgatcttactaaattcgattagcaacgtaccgtagtttcgaacaacactgggatcgttacgaatctcaaatctagaagagatggacacctgatctgaccctttggttacaatcagcggaagaaaggatcgtctactcagagtcatggtgtaagactcttgtataacagtatcaaacttcaacattttgggatacatatccaagggggaaatagttcctgatgttataataacagaggaaaaacggtcgaagattggttttatcgctatagaggcatccaagcatgtaaaatgcagtattggattcggtcccgaagcattctcagtctcgtaaggttctaaaatgagttgaaacccggtctcatatgttgagactaatgttgcaaacgttgcaatatctttcaatgctatgaactcctcaatttcagttagttctaacgttttcactaatagagcaagacgttcggcacaaaatcttagtggcttcctttcaatgaacgttaaaagctttaagtgctgcaaaaatgacgccggtgtttctgaaattacatgtaacactttcatacgtgttttaagatattcaataaaccgctttaaaaacatgacaaaatgctcacctcttcgaatatttccaggaatagactcggttaatatgtcatccggtaatataggattagccatgatcagttcctcgttacgggaagattctgttgcccttagtccctccaccaatctctcgtactcatcttgcaattttttgctatcaattcttttgatttcatcaacctttttggaaagactgtttactcctctggaagctttcttaagtgtatcatttgttaaatccaaggataaactttctatgcaaacattatctatgttgtgtgcctcgtcaaatataacgatactttctttagaaagttccttcgaaactctctgagctattttgggatctaataaatagtgataggaataaataattatgttgcaaaatgacatcatacgacgaaccgtaaaatacggacaaatgcctactcctttgcaatattttatgagctcttcaaatgaataaacaccgatgggaatgtactcgtgcgaatctaagtcattcattttttcatggaacgagcatagttgatctttatcagcttctcctttggcaacttgaagactgagttgtccatttgtcatccttctgcatttttcatctactacgataccctttctctcctgtgaaatagggtgaagacaaaggtttttacgactggttaaccccagacctctaaagttttctttaacgcctaactcttttgttctaaagtccattaatttggttaactctataagagccttttcaatttctgacatggtacgagaacaataaataatctttctatgttctggataaaacatttggtaggaaactgtcaaagaaagcaatgaaattgttttaccagttcctgaaggcatctcaagtatacaattacccccaatatccaaggttctcttaatatcacacatgtacgcatattgctctggatatatttttggatatggaaatatcactggcaaatcatctattaagaatttcatactatcaaatctagacaaacttgaattaagatttagtgagaaaggttatggtgcaaatggccgctgtggtgttggggctgtaattagtagctaatgcatcaaacttttctgtgctaatcttaattcattctctaatgaaattaaatgggttttatgacctcaaacttcaacttactaattacttgaatttctacatggatgctactagtccttttctttccgtcagttgagtcagattccgtgtagttttgttcgatagtgtcagcaatgagctttgaagcaagccaagcgaatgcatgttaggtgaacctgacttgtacggagtatagtttatagtttatgctggacgtatttccccgtgtttttgaaatagtctcatataatagtagtaaaagacttttgtgagctgtctctagaattgttatttatgcagagagcacaaggtgacactgcgaaaacgccttacatttttgagaggactatctattgattgaacaaggtacgtatctcagatccacaatggaatactatcataaaaaaattagtaccattgggtcaacagactttgcattattacctgcagagtaggtaagcttcggttattgaagaacctgcgttcttcagccactgtcgaactaatggtgcagtaagaagcactggtatactaactgttccaagatatgtacctggcctcaagaaagatactaccttgccattgcttaaaatatttataaaacaaaaaaattttaaacgtttattgtgttctattcatcggaaaatgttcaatcattctaattatgatgttggaacataatgaacttgacaaacaaaaattagggtcctagtcactaggcaggaatccgattttccaattttcaaatgacttgcaggagtcaggtaggcacttgtttgttttttctaaaacacttgctgtatctgacagaaccaaatctggtaaatcttccatattttcaatattttggtgctctgcagcctggatccagtgtacaatatccccttcatcagacatatacattatcttcaaagaattctcgtatatatgctcagctaaagtcacagttacgcctgttccaaaaatccatactagcagactcttgattcgtataaacctggcgccattagagtttatcctatccagtaaaacactgtaggcatagatgtatggtgggaactgttccaattttaaatttcctggttttgtaagaagcaaattccagttatagattttccaattggagcaattcttagttacaatacctacgggaaaaccgcaattggcgcaagctattgtttcatcatcctctttctctattgtctcaaaactgagagggtgaaacaaaaggtaataaaagcccaagatgatagcgcctttcctcggctgcaaatttccatagcgcagtccagaattggaaactttgcttcctggcttgtgacaatgccaaaattccatcatctccgcccacatttctgaaggcatggcattgatggaactaactttacttctatgaatcaattcagctctacaatttccacaaccaaagctgaactctcctattgttttaaggtaatctgcactccaccttggttcagcatccataagagcgttcgtctcattgaaccgattgctttgcttgagccatagtctaatttcaactacattatcatgtatgcttatatttggaagcttttccaaatcaggattaatcagaggaattagtaagttatattttaaacagccacgctccacgagcaaagctcctctaagtattttcacgttgatcgtgaaatcaggaagattagtaaggctttcttctatgtatacacacaaaacattgatttgcgtcaataactcggtataatatttgtgcattagaaacctgttgtaagtagtaacctcttcttttttgcccgaatcatttagaaattgtctaaatggaaaaccataatgttttacttagtaagtacaaaacaacaatatttgttggtgcactattcactactttaaataatcgacgccaaactacttcgtaaataattcggatccttaggctcaattaggctgctgcttgctacattcagtgaaatttaaaattataccaattcactttttgactggttagggattaattgctggattgacctagaagtttacttgaagtaaaagttgtcagctttaactcttgttagttcattgatttgttaacggagaaatggtgcgtaaatctgataatagctaactgaataaaactaacactagtagtcgatatttagggcagtcaatgttgaagacgatgaaggtgacgctgaagatcatacaaaagagctgcaaatcgaagaaggatttagaattttttacaaagctttgaacttgcagaaagatgcacaattacaagaagcagagcaattatacaatcagctattctcattgaacattatgcaatcggagacaccaacaatatctcccgttatacgaacgttaaactacttagcctaccgcaatagaggtatcttgcggttgcatattttacagttcacagcagtcaaatcgaagccgactgatacgcttcatgatgaactcttgagccttcttactttgtgtttgaaagatttggttaaggctctggaatacgaggaaggagatagtttcttaactcaactgttgtatgacattttcatgatgctcgactacaagagaattgcaaggtacatagtcgaatacgaactgatgaaatgggacaatcaatatggatctgaggatgaacttcctgtgtctaaatacaacatttctagaggtcagctacaggataccttgagcctctatgattttcttcttcaaaagtttgatgataacatttgcgatagtggattcatatctaataatcatattcagtcgtttgaacgagtaccatcgaggaagaggaaaagggcaaattcgattattagctcgatctcttcttgtaagctaaatccttcaaataggtcgttgttttcaattgatcagaaacactctttcaaactgaaaccttcatcatcatggggcctactgctcagcaatatagaagtgctgataccgaagtctaaaggaaaaacaaaatgtcttgatgattatttactcaccgactttcccatggaaagagtcggtttagaagctccgaatggagacggcagagacttggcggacactgaatgctctgatgatgagctagtatacagaacgcctgatccgccagactacgcaacctcgcaagatgcatcaaaaaccaaactagataattcatgccataaacgtgaggaatcacatgaaaaagaaagatcctcttcaaacgaagagcacatgatcaaccccgaagcatcctcctccaatagtgccgcactagaagaagaacacaggacacattcaagaaacaagaaaggaaatgagaatcgtgggaatctagatgttgttacaagtcccaacttcaggggcagcctggacgctccacctactcagtcagaggcacaaaaattcaatcgtagtagtcgaagccgaaggaacatagattctctttctgttgtagttgcaatggatgattttgctcataatacagagttcatcaaatcatgcaacatcttcttagccttatgtcctggccacattcagctctttgacaacactgaagcattaattgatgaaaagttgcaatcacgaagaacagatgtggcgattcctattccagatattgattttgttagtattttgaacaattggacccagaactgttctgcgttattgttacttaacattgaaatggaaggttttgagaatttttcggtgattgacattctaagctcgacgtctattaatgattttgatgtggcaattagaaacttcaacgatctaccaatggtcgaaacaacgcttaaagagttcttggcgatgattgaaaacaggtgtttgaacgtatatcaattgaagtatcttgtattgaagcagtttttcggtcacaacgatgttttgaactctcgtatcataactgattatgagctggagaagggcgctctaaaatcgctccggagaataatggattctgtggatgtaacgctactcaataatattcggtcctttttgaatcgccaagatggttcaacaatcaagttatttgaattttacaccatctcaatatcgttcactgagcagcttgtaaatgactacatttcactcaagatggttatgaaaacgaagaaagattgggcaagcaacaagtctcgatacaatgagctattaaacagtgcacattgtgttgagggaagaattttgaattggagttccattgttcgtgatatttacttcttgttgcggagaagatcattttcggatgttgttcaaaaatattggtttcaattcagatgggtccaaatatcatattcacagtatagtaatgacagctctctcacttatgcgaggctccttttgtctcgcttagacaaggaattaaaggaatgccatatcagtatcgacacaagttacattaataatgaccatatttcgatgcttagctcaaggaatgctggcattcaattgtcgaaactcaatgttttgaatcttttttcttcgatcatagacaatagtgtagacaacgcaagcactcgtatagaaatgctggaatcgctacttgtacaaagatctcctgttgcggaagaatattgcgagctgaaccaattcattcacgggtcgtctattgagctcaagttaaaactttggcaaattctactaaagcactattttgaggtacaagacatcccaaagtataacaaagggtataatcttgttattgctttgttggagcaagagttacatggagaattctataagaatgcggagtttttgcacaggcaaaagctattactaagagtattaggtttctttggagaatttacaattaagtttgtcagcttactggaacagatcaaatacagtgaatccttggatcctgaaagcatgcctttgcttgctacatttgtacaactttgtgtagtagttctcgtcctcgaagattttgcacagatatatggtcaagaaagtttctctagaaaatctccgagatcttttcatcggctctctgatatattatgtgccacgttttgtttgttttttctgtattggaaatctcttttgggagctgcagcagtgaaggagaacatcaatgattttttgagcttacttcacaaagcacttggggatcgtgcaatatgtgaccgtgctaatgggatatttctaaaggtgctccagcgggaactgctgacccttgactgtgacgattctgatagtgaactcttccaatgtttcaactgtaggttcggggtttccttgtcaaaggaaaaattttccccattcaaccataggtgccatcatggacctatgtccaaggacgacgcgttaaatatctcgctctacattcttccctatattttcaacaaaaagaatccgtttttatcgccacccaggtctgacatgaagattctgctagacaggattcacgacgtgctaggtaacccgaacattgatctaaatgacaggttcatgatcaatactgctaaaattgaatcatttttcaacaacatgatgatcacagtaaagacccttaaatattcttttcatgggcttttacgtattgaacttcaacccctgacagaatgggatctggctgaggtgactcaaagtggcctttactatttgcaaggattgacagctttgaatcttttcaaggtgagaaaacgcagtatgcaagggaggtcggcagaactaggattcgttatcaagatgctaaaaaatgatctactatgtggtaataataggctagagacttggctttgtctgggacagtgttatacttttttatttgaagatgatgtgatctggacaagcgataaactcaacaacgagaacaggaagatggcaacagcagtgtatcaaaagaaagctattttgtgctatattatggcgattaacgaatactccagaagccaccgcttagtgaaaatcaaactctcaaaaggagtttcgcatgctctattcagtggatttggaaagcttttatttggcgcattggtcgaaccaatgaataaactggctcttcttgtgaattcgacccccctttttgtgaagcatcaaggagccaaagcatatgaaaagctatcagcgaacaatatcggagattccctgatgtacaaagtattagaactatctttccagttagctatcagaaccgctggcgatgactgggttaattattattacttagctaaggttcaaaggaaattgggctattctgcccatgttgtggtccgcactctgctactctcctgtaaggtgtcttccaaaaagagcactgaagtgataattgagcctcattacaaattggtgagcttacttttcaaatttgttttaaaagaacagaaacttaccgttgcagaaggatcagaatatcttggagaagatcccgttgtaagtactcttggtaaactcgtcgagtgtgaagatgattttgctagacagtgtttgcaggggttatccaaattgaaccagattgataagagaaactggcaacacaaacctctttatcgctctgctaggattagatgcgagatttttaatgactttcaaggagccaaaaaggagatgcttgctttggtgaatctaaaagctcattccaaagctcttgtttccatttggaaaccagaaaatgaaattcctggtaagcatttcgtatacaactatacttatgtcatattttttgttgatattcttttcgaactggaagatatcaacagcatgataaccttgtgcaagaagcttaggaaaataggccagaatctggtccagccatcgaaagcatgggaccatgcatgtaccaagttgtgtatactggtacgaaaatactgtggaatggatgaaaaatatactgagaaagctctggctatttatcattatggtgagttgttggaaaaaaaaaaacttttcctagaggatctttccaaaacagggattatagattttgaaaacagggtagattactatcttctttttgaaatgtcggaattcaggaggatgactaatggatttgctcccactgggatggttgatgataccttttttggaatatatttgaaaattttccaggaatgggagcgtcgcaaaggtctcattgaggtcaatactgaagaagtgaagaaatacaaaccaaaagttgcaaaaagggacattttgcctttatgttccgagctcctaaagctcgtctccaaggatctagtgagtctaaagcctcaagactttgactttgagctaagactcaattctgggctgagacttgatgagcagaaccatgaaaacacagtaagcttactgaatgaagggccagaagcactacatatataggtttgggtactactaagttgaaggcactcaatggggcggtaaaaaacagaagttataccccaaattgctgttccgaaggtgagagcatatcctttttgtggaagagaaactttcaaatgtaactcttctatcgagataaaactgttctcttttcgaaagataatacaagtgtatagatgacaacgagtaggaaataaatggaacaaattagagagggcgatagacaattttcttcatactttaactaagtgataggtagcaataaattttcgagcacaagaaccatccaacaacgtcaacctaatgaaatcataatcgaagatattgaggcaatcaaaataatgttaagtaatcacttttctttcaagtttatctaatacttgagggcgacagctccgaaatgatatggtgatgaagttcctgtaaaatatgatgcgcaaagttgattgaacaagcaatcccaacattcaagaatcttagctcacaatttttaactttggaattaaacttatcattctcccctttgaaaattttctctaaagattcaaggcctccagaatctaaatcctctttgtttacgttgatgaaagttttcactaaagttggtacagcagtccaattcttgatttgtatattaagcgtaacctttctctttagcttcaaattttgatttttaccaggcttttgaaaagcattagaccagtaaatcagcgaaaaccaattgatatcgtacataaatcttgtccattgtaggtgcgattctacctcgctagacaaatccttctcaaggtggttcacgaagttaactaaagagaatgtaacctgcatataattgatcaaatgatttatcttggtagaaagtggcattgtctttgttctgttttgaatcatagattccatctgaggcaaacaaaatctatgtggactagttttggaaagaacaaggcttacagaatccccctctcttaaaaatgatacatgttcctttccataaatttcattaccaacttcaaatttcaccttcgaaagtgttacatctaaagctttgattgcagcttgctgatccgtcaatgacaaaagattgatcatttcggtgaattggtgaattaaatggagagaatctcctaataaatttgtagatattaaggaagagtggacgggaaaacttatctcttgatatgtcctgaagaataggcaattctcctttgaagagaatgtagcaaaattggcggttctgtagttttcagttaaagaatcgaacattcgatgagaaggcaaatctgtgagttttccgagaacaaatagcttcagaacgtctagagtggacacatctaaagagatgaggatggttgactcacatgagggtattgccgtcagagagtgattgtccaacactaacaaaggacctttggcaggcaaatgcttcttgatctctgatgataaggacaacagaactctgtcgtgatctttattatcaacaacaaaaactttggtgttataattatttcgcaactcttccataagtaaattagaaaccagtttttctgttgtcatattgcttaaatccagcaacatagaatagtcatagtcagcaacagaaacatggatttcttcaaaccattgtattgaccactgacccatgacagatttaatataggacagccaccactggattttagaagaaaacccgttaactcccacaatcaaaaaccaaccaccaggccattgcttcctcctataaaacttgagcttatacaatagaagactgctgtcattgaatgaagaattcattaagttgaataatttggtgtttatagatagacgtttcatttctgctgttgaaagggtgacaatatcattactgatccacccagtggaattcattgtatatgatagttcgtaaagctgtgtttctaacttgatacgcagcaagtttctggtggtggattggggatcaatgttaattaggtcctcaatttcaaccattttgtttgaagatggatttgtaaaataccctaaaccagagagggggtcgatgctatatatcgtggacttcgtaggtgttaaactgaaaacaatagaatcatttgtgtagtaggtaataacttttgatctgtctaagagtagctcatcaaactgtagaacaatgtgatcaatgatttgcttcacatgtttataggtaatttgcatcaacaagctctccatcgaaattgttcctgctttgtctgctagctttataccatcagccttttgcagaattcctcctttaaaccattcgaaagaaagggtatcattgtcgcttacgctgatctctattgttggctttcgtagatttctttggttccaatacgttaaaatgatcttgtttttatcaggatagtaaactggactcagatctgacttccaaatattcaccttcaaagtgaccagctgccgataaagtagatagagcttgtagccgacggagaatttgcatagtagtctgcataggcgctgcaacgattccgtgagacttttatgtctgggcagctttgtttctgaatcatcttcattcgtctgttccactggaacaaaatccacccttagtgccctgttcgcttttttgaacagtaaattttgggtaccttcatctaaatgagtggtcattgtcataagtttattatccaaagaaccaaaattaaaatgaaaataaaccatatataactgattttcgttctcatccccaatactgagactggtttcaaaaaagttgctcacgtgaaatgttattctcccattagcaactttgtagttccgtaaaagaaaaggtaactcttttgccattgatattcggctcgctagtatgacgttaacctccttgatagttctcaagatcaatacggaacttagcttcttgctctgaagaaaaccataagtcttcaattgtggccgtcctttcaatacaacttcaattgctgttcgcaaatcgggatttggcagtttggcatctattaaggataaccccatgaacttcattccgtgggcaacatttccgatctctaatatcaaccttcgcaagtgtgcaaataacttgatcagcttataaatatcatctgcactttttgcccatttactcaaaacaaataggcgaacaaaattttctcgtatagtcactagtacctccaagaaacgttttttcttactgtggtcatcctgattcgattgtaaaatttttatactttcaccaagttctttatatacatgcagacagtaggtagagagtatttgcttcagaggaatgatgttatctgtgacttctgagatcatgccgcaaacactgattcataaactctgatctctttggccaaaccgtagggcttacgaagtacttctcaccaaagaggctcttagcaaaaaatattcggtgatgcgtgtgtttatcgatttcccaaaaactccacaaacacggctccttacctcaaacaatcggcagtcaaaatcctaatgagaagaaacatctcgtgattggtatagcataggccgctaagaaaatgaatgacgattagtttacttgataccgactttttctggaaattgagtggttgaaatttgcagacattgtacgcttgttaatagtacgtgtactttatccaatttccccaattgggcactaaagtgtaacttctatgctccattatcgtagccctcttgattaatggtaaaaaaagaaggccaacagttttttccctcttcgggattgttttcaccggtctctgagttgccgtctccagtttcagatttattcttagtcaagaggcgtcagaatgtatcattatttagtaccacaaaatcgcaaagaacggtgtccgagtttcggaaagaatacttgaacgcccactctaaaagacaggtatctacacccactgaagttacagaacaaccagatgattatgcggaacaaactgaagggattcaattgattccagggcccattcaggagaaaaaaaattaactgtagaagtagacaggtttcccaacttttttttaactctcaaagatggatcccagcatttattttatggaatccaggatttgggtgaaggatcattcagcaagatatatcttgcgcagaccgttgaacttccagatcctgtagcactcaaagtgttcactagaattgtagaatctaccagctacacgaatagtaccaaagaacgacaggagatatctaccagtcgagaaatacagctactaagtaaattggatcatgaaaatattgtgagatatattggatgcagtgtcacggacagctgttctattttagctctcaactactgtaaaggaggtgatctttatcagtttttggtggagcatcgaaacgagctacaaatgattgttgtccaaaaattgacaacggatatagtgatggctatacgctacctccatcataataacatcgttcaccgagacatcaagttggaaaatgtattagttaattgtacttacgaagaactcaaaaaaatgtacgaggacgagacattaggcaccaagccattactacaagtaactgatttcggactggcccgtgagatcagcccagaaaaccctatgctgacaacaagatgtggatcagaagattatgtttctcctgaattgcttatgggtatgccctatgacgggcggcagtctgactgctggtctctgggagtgcttttttatgctatttttgagggtcgattgccctttgaccctcccccttcatatggcgaccacaacagggtggttagttctgctagttataaacgtagagcaaaggcttctcaccgaatcgctttaatggattggtgctggtttttatttgagtcggttggagacgaatgggagaacgcgaaagttgtcgttcaaaattgcctttgtaggagggattccaggtgggatattgatcaaatctatgatagcaagtggtgtcagccttttcgcacattttcggtttagtaatattgtaatactatgatggtgtcatgaatgattactgagtttcaaaccagttttcaaggtctgaggtgctcttttcaggtcccacacccaccgccttgccagtcgtgtaggtattttgtgcgcgcttagtgaaaagtgcaggttttcaaatttaaacctccggctcagtgagactagtaagcctatgtgcctaatctatgcgtttcatcaccaacaaaaaagagaatgaaatgaagcgtcccaaaaagttctttaggccgttgtctatgctacgggcgaaaactgaaaactcaggggatgagtcgactgacgggaatggaaacgatatggatcatctccaacttccatattttggtgaccaagaagattctgaaagtgatgaagagttaggtagttgtcagatcgatctagaccatgcagaatcgattattggaggatcatctgtaatatcaaggcatgagggcggcaatcacaatcaaattgctagtggcaggaatgaagacgctcagtccacgcacaaggttttctcattttcgttaccatttgccggttctttttcaccaaggtctttaccacgtttggctcgtttaaatccgttcagctctaacgaagatcgaaggcaacagattaagcttaaattgacaaggcaggagtcaatatcaaccttggaagaagagtatttattcaaagataggacgttggacaattctagggttacagcgataaaacgagccctcaccccaacaaacataaaaaaggagataaggtaccatctcacatatgcggagagacctcaatgggaaaggatctttgaagagctagatggtgacgtgctcgtattaggcggatatcggggaagtattcttcgtgacaccgcaaccaaaaggcgcgcttggctacctgtagttaaagcgggattcaatttcaaaaagattgatctttatataggacctgacgtagcagatgaattgaatgttgaaagcaaaatttatcctgacggaattctatcgcatattggaccaatcgacatttgcaaaaagctactaaaaaggttagagaactcaaacgctacacttcacaactatggctatgattggagactttcagcccaccttagttcacaaaaattaactaagaccttgcaaaggataaacagggaaaatggtggaaaaggtgttcttgtaatcgcccattctatgggcggactcatagcgcatcactctatgcaatgcaaccctgaactatttagggggattctttacgttggagttccttctaaatgccccaatgttttaggtccaattagatttggtgacaatgtattactatccagtaggatcctgtctgcagaagtaaacttcatgatgagatcaagcttcatatttctaccattagacggagagatttttgttgataagacaaaaaataatgagaaaattctactcgatttttttgatcctaaaacatgggaagagtatcatctttctagtttagtatgcgaacagagaaagcgcctggtttctgagggtaaagacttgatcgaagaatctactgggctggcatttcggacttcttatctcgatgcctgtaggtacctaagtgaaacactaaaaagtgctaaaagtttcctactagagcttgaatatgatccatcaaaaaaatcgagatatccaccactggcaattgtatacggtaacaactcggcttctgtccgtgaatcccaggttcaaggctttgatggactaaaagctggtgattggacagatttcacgtatgggcctggtgatggagtggtgcatcaaaaatggttgatgcctgaaaaaagaggatttaacattgtggggaaatttgcatcttctgctggtcatgtgagccttatgacagactttgatgcaattgcgaaaggtttgatggctatactaaatgcggagggagaaggactggctaagtgagtgtgcagatctgcctacgaaagcgaactttgcttgcatggttcttttttttgtaaactcctctctctaagaacgtgacaaattcacttcattgcttagatttgatgaaagaagcggaagacttgaaccattgacaattgcttgactgtttgtgaagtaaatacaccaagagtagttttctagaaccgctttcttggtatggtctatccatggaggaatgtgtcgtctacttcatctaggtcataatagataatttttaaccataagctgcaggaattacattgagccaaaacctcatatcttccagactctccagtttctgtgactttcgtaccctgctcgctaagagcagtttccgttaatataaaaccttgttctgtagagcatcgcggacaatccttttcccagtagatccgtgaatatgagttgctgtagtcatccattggaggctcctcttggaccattttgaaatcatctaggtcaaacatatctagtccctccccatcgcttacgactcctgctcgtttagattgttgggtaagtccctcattgtattctgcacgagttctttgatttgaaagaactgcgtaagcttcttgtattcgattcactatggttttatcttccatatggtggtgtaatggcttcttatcaggatgataggcaagaagtttgcgtttgtaggcctcctttatagctattagatcggagtcatcagatactcctagtatatcatagaatgacccgtgtgctttcattttctaaagagaattttgttatgttagctgtctactaactaccctttgagaaagaagaaaacacatacataccatacctatcgcagatgtagatgcgaaaaaaagaaaaaaaaaaggaaaaacaatcgaacatcacctgtatcccaactagttattcacagtatgcaaatccgaaaacgtcaaacaaattttgatccagtgcggtactacatttcagggacatacttatttattaagcttatcaacttcccatgggaaacgcaagcatcccttgcagtatgctacactaatgagctgcaattctcagcaatcgtttgcgaagaccaagaaaaggctaaacagcaactacagattattttgtggccctagtgactttccggaaaacctgagaggccagcgcttcaaccgttactatattgcctgttcagtcaaatccatcatctgctcagttcgttttcacagcagtattatggtacggtgattttttgatagtaactaatgagcttagttattcagatcaccaagatcacaatttatgaaacctggagcaatgtatgagctcctaaggccatccttttgtaacagaaactcaagatcataaggaatgtgaagtttttgtggagattcatttatttttagtcggtccaccattattgttggccaaattcactgaaatgactagacggggttgcaatagattcgaaaacaaagctccccttgttgctaatcctagtcagcgcatagtccactgggtaacaattcttgtcaagttccaaatcaagctctaccgggtttgagggcttctagttctgcaaagtacttttatactctgagattccagagatgtctccccttagctacatgaagtggccacataagctaccaaaggagcctcgatttgacgaaaagtaaccatgtcgtgattgtcagcattacatcgatcgagacaagcttcattttcagttgtttttctatgggtgaagctttgaacttgtcgtattcaccaataacgttgccttcaatgccgcttttgaggtaccagaagccataacttgaataatatagacaggtgagaaattctcttatactctttaactagcaattgtaaagggaaactctttaagtgacgaactataccgagagcagcatacttaatgagagtgtatggacaaattgcttcttacgtgcttgttgagctaaacaaatccaatcaagaatctaccaggactgaacccgtgacgataagatatttgattcttcgttttcattaagagctgttcccagataacccagacagaatcttgacccgtagatcgcaaccgaaatgtagcagccagctctcatttgatattccagcgagtctgttccctaataagaggacatgaggagtatttgcaaagccgagtcaacgctggcataaaattagtcgtccaagatcgagatacaaaaacttgcaatggatttatctgggtggaagaaatggtgccgatattggataaggtgtagtcaacatttttcagtgatctcctcgtgctataaccataattattttcgtcggcaatagcttcacggtcatctccttatgcagttacttgatagccattgagacccttataattcgtacttgttgtgcccaaactgggaacttcttgtttagaaactttcaaaagaacgcttacgtttggttcccagaatcatatttgcccagaatctgttatgtgcgcagctagtgtattataactccgaatattcaatttgcaattagttgctgatggcaagaatcacttctagatttagaaaaaaagagtgctgactgttaataaatagtgttagaagccaaacgacagaaggagccttcgcacttccctcccgttcctacttcaaaagtccaattatttgctgacaaccattaacgaaaaaattcgaacaagattgtggttacagcttccaaaatacaaaatacactagccataatagtaaagtaacagagcatcctgaggtcaaactgggagcccgatggtggcagtaaaaattttaccagtaaccaaacttgcgccttagtgtacgctttcattgaatgaacctttgtgagaaccgttgtcccttagaatcaaacaagaacacaataatggtaatatctactgtagcttttattgcttactgaacggagaaattaaaaagtagaatggatgattaatcgtgcacagtgtaacactacacgaaataataaattggaccaagcaaaaacacaagccagcctccgctcatatcaacagaatttctggaaagaaaagagaaggcgatataataaaggccatattgggtatcataacctctctcatttgctcacactccaatgctacaaatagtgtccggcaaattggcatatccccaggctccaaactgagaaactaaacttgactaaccgatctccgttgatactcccaacttaaacaaacaggaatgaataatgaaggacaaataatttcagcctacagggccaatcaaacaaggtgacttgcgcgaagcaatgatttgtggatgggctgcggtatggcagcataacaatgcaacgctatttcagaaattgtaaagtgtaaaggaaatattcaaccctataaagaatctaccgaaacgtaggataaataatttccacagagtacacttttggtttttatggacggcgttgagttgcacagatgatggaatattgtgataaaatacgctatataattttggagaccctaagatcaagtggactaggtcgattgcgtatattagggtgttaaagacttacttaattctataagagctcggcaagctatattctcagttccttcgcagtcgaccttcagtgcccaaaactttaaagtggacgggtgttttctaaagattgctattgttcaattgcccggttttttaaccgctgaaaaccagtggcaagagtggactacgtgcgcattgcaatttgtataatccatataattttgttccacggccttaagttattgtactgtttgctcaattttgaagcggaatatccgtcctagtctcgaatccttatttaagtaccggtatcatttgcatatcctctcagccctcaaacgcccattctttatagtaatggttatgtattaatcgaactacgatgattgactcagggaggcacgaatagtataatttgaacttgcagtgggaagctaatttcgggtgtcttgaaagacgaggttaaaaatttgaacccaaaccgattttaccggagatcctacctcaaattagaacactttaaagctttcaaggaattgaaattccatctttatagaccggtaattctttgaagagtaatcaatgtaagagcaagttctaaagagaggatccaaattccttctgatagcaattgtaaggagctgcaaagttcaacataatatttgcgatagtaaccgtcctacggatacttaaatcggtatcaaagagtgaccaatcctgaatcagtgtagtgcaaaaagaaataacgatgataaacgaatcaagattctgatgagttgtccaagacggggctatcataatatttaaaaaatagaacctactaatttaacaaggtaaatctcatagatttaagtttcacgactagcttagctaccactcaaataagctcccgcttgttcattcggctggggtctccaatctccatctccaatggatattttttttttaagtggagagagatgttcagtaaactgtgagttcagttgtcagaagcaaccaatatttaccatggagacgaataagcagatattatatactctatttttacagcccttttgtataatcctcagggatggttggcgcttccctgtgttccaagtaaccacactcttcaagttggaaatgcaaaaggtcccaatgcatgctcccaagtcatactgaatacagagatagattctttgaattggatcgatctctaatgaaattcatggatgagaagagagtgttaaaaactttgccccaactaaatactttatctgaatgaatcattaaagaacacgacaagttcagtatgttgcttggagcctccgattcacagtcttgtaagtagtgcgtgttttcaaatatttgcattagcaatccctccaagtagcccacatagggaccaaaaaataagtatagtttgttttggggggaagggagtaggaattgctttcgaaatggttaactcctgcttagtttcatttaaaaaatgaatagagaagtagatacagaatactttgtaagactgcttacatgaatgatgccagagagtgtgccgaaagatctacatgctactaaatttactatcaatagggataaaatgtattaggctacctactatgccgtattggaaaggcgaagtgctttgtatgcaagggattggggcataggcaaacggatctatgacaagagatacgaaattacttctgttacccactctgctcctaccaaaccaaatatatctgtgaccaaaaatatcatttgtcttgtgctccacatagcggccaggctcaaagagaacactagatctgctttcagacattaccgcgtgcaaatatgacaagtcactaggtgatgaactagtcgataaaaccaaaaacgatctgatcaataacttgacaacatcgttcttatcggatttctagctcttgaatagtcaaatgctgagttcaattttaaagtgaatatttttcaccgaagtcgattttagcccattagtcaaacaacagaagagaaaagacaaaccttctttttcatgacacatgaaacaaatcacaaaaattgagtcatattacggtttcaatttctgctgtttgtataagtcattggctggcaaacacatctcctggcctcatactgaaaatatatgaagataactgcttctaccaatttcaattgatcaaggttctacccatacgtatagttccagagcatgatgttagggaaacttacagggatgatgtgggccacagcataatatcaacaatacctaacaatcggtatttaattcatagatattcaataccaattctccacgatgagaaggggcgactcctcttcttggacgttctgaaaatacaggtacgctcacgtcagtgcctgagcacatacagcgacgttagtatcaatcttcctgggacatctctaatgctctaaaatgaagaaaaagtaaaattagtatcagttggccatgcgaccaagcctgttggaacgcaaaagcatatccgaattatggttggaaattaccttcgaccttcaaacactaaactcttcacagggctattattccagctattgcagaacttcatacgaatttgggcttgctaaaaattggcaggatcgttcttcaataactgaatacagtattgtacctattcaagcagttagtccatacttagggccttcctagcctgtccagtctaccattaacgaaagttctgagctgtgtctatccaaattaatttgtgtcagaacctacgtaaccactataagtctcataacgtttttgaaatagataaaattagtttgtttgatcattcaagcacattatagataatattccaaaaagaaagtttcaaggtgccccttggacatataaaactttgccacggtgctaaacttaaaagaatgatcttccaaaaatacggaatagaataatctatttttagaagagaagactaaaaatcgagcgatactatgaatgtctgttacaaactgaatttttgcacgtaacgaatactttgaaacaatcctcaaaatcttgttttggtgtttgtcgagtagtctttaccaggccgaatcctgtagttaaaaataattttctatttggacaactaagggtatcccctcaagtttggcttttgtgtaccttgttcggaaaggctccgttctgcaattctgcagcaaccttgtcattagctgtgtaatgctcgctggtgagtagcataagtcattccaatggtaactaccaagcttgtaatataaccaccagcacctccattcagtagtagcaatgagcaaggtcggagattgcttttaagcgaggtttcaaagtaatcttgtagttttgctttgtcgaaaaatggccacggcttacacatacagttcgtccaccagatctttaggcttcatcaacaaagttttcgacttcgttgtctataggttttattctttatcagcgtcagactatgatcgtactagtttgagctgaagcccatcaggatgtttaccactccagttttgtaatttccgcggctatctagggctacgttgtccattgccgagtttatatatgacatcacattaggcagtaattctccatgcttctttttcgataatgttttggtctaggttcgtgcatgaaattttttcttcatccagactatctctgcgctgcactgttcacatagccaactgatactgatttcactttttcttcattttagagcattagagatgtcccaggaagattgatactaacgtcgctgtatgtgctcaggcactgacgtgagcgtacctgtattttcagaacgtccaagaagaggagtcgccccttctcatcgtggagaattggtattgaatatctatgaattaaataccgattgttaggtattgttgatattatgctgtggcccacatcatccctgtaagtttccctaacatcatgctctggaactatacgtatgggtagaaccttgatcaattgaaattggtagaagcagttatcttcatatattttcagtatgaggccaggagatgtgtttgccagccaatgacttatacaaacagcagaaattgaaaccgtaatatgactcaatttttgtgatttgtttcatgtgtcatgaaaaagaaggtttgtcttttctcttctgttgtttgactaatgggctaaaatcgacttcggtgaaaaatattcacttaaaattgaactcagcatttgactattcaagagctagaaatccgataagaacgatgttgtcaagttattgatcagatcgtttttggttttatcgactagttcatcacctagtgacttgtcatatttgcacgcggtaatgtctgaaagcagatctagtgttctctttgagcctggccgctatgtggagcacaagacaaatgatatttttggtcacagatatatttggtttggtaggagcagagtgggtaacagaagtaatttcgtatctcttgtcatagatccgtttgcctatgccccaatcccttgcatacaaagcacttcgcctttccaatacggcatagtaggtagcctaatacattttatccctattgatagtaaatttagtagcatgtagatctttcggcacactctctggcatcattcatgtaagcagtcttacaaagtattctgtatctacttctctattcattttttaaatgaaactaagcaggagttaaccatttcgaaagcaattcctactcccttccccccaaaacaaactatacttattttttggtccctatgtgggctacttggagggattgctaatgcaaatatttgaaaacacgcactacttacaagactgtgaatcggaggctccaagcaacatactgaacttgtcgtgttctttaatgattcattcagataaagtatttagttggggcaaagtttttaacactctcttctcatccatgaatttcattagagatcgatccaattcaaagaatctatctctgtattcagtatgacttgggagcatgcattgggaccttttgcatttccaacttgaagagtgtggttacttggaacacagggaagcgccaaccatccctgaggattatacaaaagggctgtaaaaatagagtatataatatctgcttattcgtctccatggtaaatattggttgcttctgacaactgaactcacagtttactgaacatctctctccacttaaaaaaaaaatatccattggagatggagattggagaccccagccgaatgaacaagcgggagcttatttgagtggtagctaagctagtcgtgaaacttaaatctatgagatttaccttgttaaattagtaggttctattttttaaatattatgatagccccgtcttggacaactcatcagaatcttgattcgtttatcatcgttatttctttttgcactacactgattcaggattggtcactctttgataccgatttaagtatccgtaggacggttactatcgcaaatattatgttgaactttgcagctccttacaattgctatcagaaggaatttggatcctctctttagaacttgctcttacattgattactcttcaaagaattaccggtctataaagatggaatttcaattccttgaaagctttaaagttgttctaatttgaggtaggatctccggtaaaatcggtttgggttcaaatttttaacctcgtctttcaagacacccgaaattagcttcccactgcaagttacaaattatactattcgtgcctccctgagtcaatcatcgtagtcgattaatacataaccattactataaagaatgggcgtttgagggctgagaggatatgcaaatgataccggtacttaaataaggattcgagactaggacggatattccgcttcaaaaattgagcaaacagtacaataacttaaggccgtggaacaaaattatatggattatacaaattgcaatgcgcacgtagtccactcttgccactggttttcagcggttaaaaaaccgggcaattgaacaatagcaatctttagaaaacacccgtccactttaaagttttgggcactgaaggtcgactgcgaaggaactgagaatatagcttgccgagctcttatagaattaagtaagtctttaataccctaatatacgcaatcgacctagtccacttgatcttagggtctccaaaattatatagcgtattttatcacaatattccatcatctgtgcaactcaacgccgtccataaaaaccaaaagtgtactctgtggaaattatttatcctacgtttcggtagattctttatagggttgaatatttcctttacactttacaatttctgaaatagcgttgcattgttatgctgccataccgcagcccatccacaaatcattgcttcgcgcaagtcaccttgtttgattggatatacattttacttttgttctgtataaacgagctgactatataatataattgaagacgatctacttcaaactaattctgatacatgctttttgtaaagagtccggatcaaactattactgccagttccaggaattattgataatattactttttgtcagattctctagatcttagtgttctgcttgtcgatataaggctcttgtagatggaggaatgctagcctagttgtcagagctttgtcccaagattgatcgattctcaactctatcgaattttcggatggtactctttgggtaagtcatcgtttgagggttagagaaaaaggggaattcttggttccaagctaaaactatcatatggcttgtcttacatccaaaagaaagtccttcaaaaaagttgtcttgcaaagaaacgtgtcaatttttttttggtcttcgacacacctcttgtcgcttggagtttgaacgcaaattacagaattaagaacaggaataaccttttttcgctcggaactttgttttcaataatccaaggacgattcaactggatcaacaactttaccataagagctcctccgctcatgtttgaattctttattcttcagctgaactcccaagaaaagaaggaagtcttcgtacagccggtacaaaaaaaacatttattttggagctctatcgttcttaaaaataggccgattcttctatcttcgttgtaaaacatactattcttgatagcaactaatcagtagggagatgattttgttcataattccctacgcatattgtatagggttctcatggtaaatatcggtatacattgaattgaacttatttaggttaaagaaggaggaggttttttttgaaaattgtaagattagttaatagtctataatcaaaacgttgttagctgattcgtttatagtcattttcagttgtttttaagtatacaaatgtatttgagaaagttaatcaagttttatgtgtttttaccccactcagggttacaaggtaatttttttctacatttaatcaattcattatattataagtgtactctatttcattaaatataacatctataaataatatatatgttgatactactgatacaaagtggtattcaagcagttgggtttacatcttgtttggtgtccatacactttgggtaggctcaaaaattcgagggagtatctgtgtagtctcagaatctgcatttttggtttgatcgcaaaacctcatttttctttttcagagtacgatggcagtctatgacacaattattttagacatagagggaactgtttgctcaatatcttttgtgaaaaatgtgttgtttccatattttttagacaaacttcccttccttttggaacaagttgagtttccactggaccacactgataatgttacagtgacgcaaattctagcaaagtttcctgagagatatactaagagtaaagaatgcttaaaaacatatatcaatgagcttgttgctaatgacataaaagatcctactttaaagcaattgcaagggattgtatggcaagctggatacgaggagggcgaaattgtggttgacctttacaacgatgtaatagaggccctggatcgttggaagaaagaagacaagtctgtttacatttattcatcagggagtatcaaagcccagaaacttctttttagccatgtcaaattcaagagtgaaactagggacctaaccaattacatcaaagggtattatgaccctacatctgttggctcaaagatagaatccgaaagctacctgaacattttaaaagacctcaacaaagatccagagtctgcaatattccttagtgataatataaaggaagtagcagcgtctatacgggcaggaattaaatctctagttgtgaaaagaccagggaataccgttcaccacgacaaccaaagttttgattttgtgtattcctttgacaacgtttaaaaatgtataattaataacagttagttctgaagactgtatactgactatgcactcacgaagtatacaagtgaaggacttgaagaagaaggaattaaacgtataggcccgacttgtctgttggagtaagtattataaaaatattgggcatattctagtctatatgctcactaaataagagatcggcggtcatttcttcatttttgtcacaggcgaagtacacctgtacaacaaggttacgatcgaaaccaagctcacataatctgttaattgctgcttcttcctcaggtgctacttgtatctgaacaccttcatcttctagttctccctcaccattatcaccttccattaatgccctcataaactcttctggattctgctgaataagctctgccaattggggattggagctagcaatttgctgaaggaaaggttctaccatttctgggttattctgaatgagttccccaatctgcattaaatcgtcacgctgagtattttctcgctgttgttgaccactactggccaccgcggcagcttcgaataggtctgttccaggcgccgtctcagtggacgtagattcaacacctgtacttgaaactggttggcttcggccatcatttggagccgatctggatcctgcaatcggctcttcattgtttactggaagacctgtaagcaaatattctactgctctgtcaggattgttgaaagcagctctcaaggcggcttctacttgtgagcgatcgtagcccatttccataatatttctgatcgcattctccctatcatttccgaccgcaaatgtggatgcattaaacgaaccagacgtattgacaggtactggaggcactgcaatacctggagcggctatagttgttgttttggaagattctgttgaagtcttgtctatcctattctccaaattcttgggttcctcttttttgaaaacgctcggaagcatgaaaatgattacgtcgttctccttcactttgaatgcgtcaaagtccttatcatcttgtagaaccttacctgagtaaacaaattttatcttagaagcatcggaattcttcactgttgctagcttctccttggcggaaagaatcttgattgccggttagaaatattcaaatttccagtttcacaaagtaaatacgtacagtatcggtcgggtccacatctagaattactttttcttttttaagatctttaaaaactattttcattttagatcagagtatctttgtttttggtaaagaacagcggtttttgccatcctcgcttgctagaggatgtaaccagagatttaaatcgcggactgcaaatcaaaacagtgtagctagttgtttgtcaatacgaacgtaatgcaatttcagatcaataggatgtcatagttggttcaaactgaagcacaattgcatcatgcaacgtattcccagttaataagtgttattttttactctaatatactacatgaagacacctacgtatcgtgtgtttattaatattttgattagattaatgcggctgttgaaggattctttctttgtagtttagatcatgtcagatgctgctacactagaactcttagacaacttagggaagagggctcaggctgctgaaaccttcgagggttgggatcaattttttgaaggcgcagagcaaataatttatgaacaaagagagcataacgaatcaatttctgaaagtgttgttctgaaagtggaacaactgtgcgaagaattactgacccaatatcctttgattgttagatattggaagagatatgttgcaatggaatatcaattgagaggtatagaggcaagcttgaaactgctgagaggcgctttgcacatattcagctcgtctagtgaactttggtgtgactacctgagtattataattaacaataaactcgaggcttcaacaacaataaaaaatctttttgaacaagctattgatacctgcgggaggcagtttttatctcatccactatgggatagctatttgaaatggttggtatctttcaatggagaatcagaagcgtactttaagtcattactgaaggttgtgcaaattccactctatgaatatagtaaataccataaagctcttatagattctcttcagcatgaaaattcgaaaggtaaggtcaaagtcttgctaggggtctctagtgaagaagagctttaccaaacggtggatcacatttgtaacaggacacaagaagcaacgaataaacgctggccatatgaatctttaatcaaacaaccatttttcacttttgaggaaccttctgatgatgaattaaataattggaatagttacctggattttgaagaaacacacggcgataagaatcaagtgattgctttatacgaaaggtgtttaataccttgctcaaggctggagagtttctggattagatatacaaattggttccagaggtccaacgagaatgaaatcgatcaactgatggctattttcaggaggggatcagatttgtttttgccacccgataggcttaagttcagatacatgtttgctgaatatttgagcaaaactagcgacgtcaacgtggccgctgccctgaatatatttcacactatgttcaagaaacttcctgggaattctgaggttgttagatattatttacaacttattttgcaacatagaaagggccataattttatcagtgaactgcaaatcgttctagagcaggtatgtcgtaggaatgacaacaagagggccatactaaatagtattgaaaatcaggatctcctcaaattactggaaattttgaataagaaaacgataacagctgttttgactttactaattaagcacttttggacattcggagaacgtgaccatgtcgaattaccaaggaatatttttctaagctactatcaacatgagttcttgagatcgagtatccccttttgggatctgtttttcaaatttgagtgcatagaaaaatctaacacaaacctcacaaatgttgtaaaccatgttagcaattcacaacgggtttcaacggtccaaaaaagtaatattttgggagcttatagagattgcacgctcaacaatttattcgcagaagggccattcccaaatattaaccaacgatcgatgtcagtggcaatgacacgcttgttgaacgctgagatcatttttctggagctaaaagctggtataccccgtgaaacgaaggactttgttgaaagcgataagcgactctttcaagaaaatgggcattcgggaatagcaattgaaaagcaaccatcaattacgaatgtttcgaacttcagaaaatctatttttgaagaatcatctccggcatcattacctaccttcaaaaacgtagaaaaggctgctcagccggtacgtttcgaaatttgatcatacggaaaagttttttccagtctcttgctatatactatcactttgtcttcccaacactttgaggccacgtcttatcctcgctctttgagtacacctgttgtttccataaacttccaactctttcaacttaggacaaattctcgacaaaattgcaatcgccttgtcgtccaccgatcgaacaaatcccaaatcgagtgcggtcaataggggaagttttagagttctcgacaaagtttgaaacaaagtatggctcaagctgtacacagaattgaggttcagactcaccaaagaagatgcagaatggttcaaaaatgtcaatatacctctgtctcccaagccaaaacaccgtttcaaattgacttcaatcaatccgctatttatggtccaaccaccaaataactgtgtaaggccgctatcagtaacttggtcaagcgactctaaactgatcctttttaaagaagaacagtatcttttaacacctttgactaaaaacaaatcagttagaccagaacatccatccaatagaagcgtctctatagattcaccattcaccgagagaatactcataatcaaattatcgtcaatcagattttctttgaatgggttggaaagatctaaatgttttaaattcctcaagtgatagggcaaaacatcgtatgcagccttggacataagaccatcaagtcgacttaaagaaagagactcgaggctagttccacagttagttagtaaactctggagagaatcacctgagaatctatgagtgttcgatacatgaaataactttaatctcgcattcatcagttcaaagaattgcacccaagttggttcgctaatcaaaaacggaccattcagtacaatagagtttaaatccaaaagattctgggcaaaagagatcaggttgctattatgtaattgcccacacatgttcaacgtcattgattctaactttggacaaaatgcggtgatcttgtccaagtatgccatatctatgtttgaacagtcccaaaattccaagtgtttcaaagtgacgtccagaaacaacatcatggtcctattgttaagggagcggttcttagataggatccgactaattttgttcaagctaaccacactgatgtcccctagtgcatgaacatcgtcaatgtgcttgcttagaagtttaatacaaatgtcttgcaagctgggaattttaagttcctgtctgtttaacaaagcagaagctagcttttttctcttcttcctggcttcgaatgcggttttcttcttccttcgttcttggtctacttgaaaccttgtgcattcagtgcataaataaccaacttttccatctttctctaacttttttgaatagacagtaattttaaactccctatcgcaattcatacaataatgagaatctttcacgtcgtcactgctgaaacttgagtctgaataaccactatctgaattggcatctgtcctcctgcgtcttctcttctcaattgctgccagtatgatctcattctcttgaaagggttcttcttgctcatgcaagtgactcgtttgctcgttacgttcagtcaacaaactttgttcataacgtcttctaatcgcaccagcatcaatcccctgttctcttaaaaacgcagtcagagcactattagggcctcttacttcaggttcattttccttcttgtcagcccttcttctggacatatagcaattaacaatgtaagtcaattcatggaagtgagaaacaaaagaatgtgctcacgtgatgtcgaaattcatctggacattgattgaacaactgctaagccgttccgttcctgtaatgaagaggcaattattttttgacttcagtttgaaatttaaggcaagggtgaaagcatattaaagggctataaggaagtcaaaactaaatgcgggtacaataactttggtgaggactagcgctcatgtttattaatatattttgtgttgacttttttgttcaaggatttgtctaagagacattcccgggtggattcacactaacgagatgagatttctgacatgagaccatgttggaactggtttcaatctatgcaacatctggcttgttggatttgcatccttttcgtccagcgtataccttaacttaatagatgaggacagcaaagctgtcaacaatatgacaacaataaatagctaatctgcaaccgatacgattgaatcatgtaaagcagcctctttgcatatgacaacagaagctatcgaagtaaaatttagacaggaatccaattaacatgcaaactgaacttaaagagaacgaatgacatcagatacagatccgtcatcctaaactaatagccgagatagtttgaccatattttcagcttgcaatcagcagcattgagtaacttgtttctgaggactaatcattccaccattttttgatatatattttactggaagtttccgacttgcagcaaatccttgctcaactttggatgatagaagtgatgacacactaacgaaagtttaagttacacaaaggtgtactagattgagcaagtctcgcgtacctgaagacgaagacaaattcacagacttgatacgagtgtacgttctactggccatatggtcgaaagaagcgatattgatagagtaggagttgagtcgtaggtgttccgttccgtaaggtagaggggggggagggaagacttctgatccgaatatacttctctttttttcacgacacgacgtagcactaacgttcacagtataggaagaccggctaaatcaccagcagtgtgacatgttttgctcactcttcacactgttacgcaatccactctagacaccacgctaatactgaatttccctcctcttttcgcgacaaggaaaaagaacatagctcgattgataaagaaagttggtacgctgaagagatccttgataaatttgtttgaaatgaagttttagttttcctatttactctgtacaaagttaaagcaggagcactctcaccttgtggattatgagtcgacaatccgacccttatggattgtgaagcttggggccatagagacagaccccttagacttctttcaatagttatttcctcgcttcagtagtgtgcattctttatagcgagatgaacgtctggatgacttgggatgacttggcacccttcttaagagaattccgaacaaacgttctatacatcgatggtaaatctctgtagccaattgatctaaagctatcattccttgaaaaggagtgagccctatccggaaggctatcagcacaaactaacgtgcattctaaattgtgctgcgcccaatcattgttctgatttcatgcctttgtttaattaaatcaccgaaaccatcttcctcatcccttccattgaaccattgattgatcttgcgactccaccgatgctcctcatgctgacatcgctctttccaggactctttcaatgcgaaaataccaccaatatctatcccgttcacaatctcaggaatagcaggcctgtatgcacttttattctgattgctggtcatacctccaaacgattcccgttctaaagctgcctcaaacctttcaaggtcttcctcattaccctcccatcgactggccatagaattaaacctcatcggcccaatgtgagcttttcgctctttacgcccactaccatgtctaattaatcgcatccgagatttctttgttgtgcttccaactgaggaatttgtatgtgaaacttccatgtaatttgctaggttgattagtttcttgagcgattgacgatcccctaatgtgatccggaaattgttactatcttctaattcatcatcaggatcatgcaagtcttctattgaatcttcccgtcgttcttctgacatagcggagcagttcatccgaaatggcatttctactatagacgacactttacgtaactgatgaccagttgagctaggaacaagattgctcccttcgtatctcaataagggcattgaccgttttccatgtagagattgtgaatgtggtgagttgttgcccttgtaatcaaagtttgatgataagtttgaactgattgaagacttcggttggggttgggcattccatgagatgcgggtaaaattgccgctacttgattctctattcttttgaggagcatgttgtgcaaaatcggtttctttttccaattctagtccacttagattaaaatcgtcataatcggtatctgttttttgatcactaaattgctccaagtgtgatcttttgaaggaagggctagtctttttcataccatcggttggttcttggtttactaagttacttctatactgtttactgtttgtgtaagctttcccttgaggatatttacccctctcactaacatgcctgctttcgacgtcgtcatgcaattgacgtccgtcagtttcactcttctttgtcgagtgacatcttaaagtgctaggttcatgtacctccaaactggatttcaaagtggcatatcgttcttcagaccaatcttcgatatattcgttcattccttatcaacgatttagtccaaaggagacgaacagcagttacttcaaatctctacactaagcgtctcaccttttgttttgtttatctactatcatttcgcgcatcggaagaagattggtctcacaggccacacactatatatcttcatctggtcaatggttttcaagtttctagatttcaatggaagactcaccgaaggtgtcaagtatgaccaacgattaaatcgtctgtattgggtggatatcattgctgtagagattcactttgtgcacttattggattctagtcccattgacgactactccgaagaggagtgttacagaattcaatctactcatcgagttttcaacttacaggactttacagattcaatcggattcatagggctgacaactaatcctggtattctaatcgttgctattagccagggttatgggctgtacgacttatcttcagaaacattaacatttaaggccgattatcctcaacacgatccgacaatgagatccaacgatggcatgattgatggaaatggcaatatgtggataggcacaatgtctgattttcatcaacaaacggtagagcccaaaggtaagctatacatgatagatggttcagctatcacagcaaagattgagaatgcgtatatctcaaatggcttgcgctggaataacggaaagttgtactggatagacagtctgacgtttaagctctggtgcttcgattgtaacgatttaaagacgctgtctaaccggaggccatttatcgacttcaagaaacttcttcctgaagtagactcaccagagccagatggatttactattgctgaaaacggagatttttttgtttcggtctataattcacagaaagtgctccattttgataggaatggacaactactagacgcgtacagttttccagcgaaacgaataacttgctgctgcattggtggtgttaatatggatgaacttttcgtcactagcgccaaccttaatattgaaagtcctcagaaatttaaatcaaatttcggtgatcagggtggcgccttatttagagtgaagttaaacattaaagggattccagagaactactatagcttaaatatgactgacgcttcaccgattcacggattctagaacatgtgcacaaaaatcttcgaccagcttattttcttcagaccctctgcgtcttaaattgactaactttttgtttgctatctctcgtctggcttcagccgacgtttcgttagtcaattgaggatgattaaggagttcatatatgactttgagatgaaatctcaaagtgggctctttcaaaagttttgcgagccgactatcatgcaatacggacttggtttcatccgttgcatttctagcagtgatcaaatctatagcagactttttgtcatggttttcaatggtgtggtgcttgtgactttttgatttgtagcaaagcatcgaacagctgacaatattagtatgtacttgagttttcgaaactattaacttactactgtacactacatcttggacatttgtattttgaatcttcgagttcacaaataccgcatttcattgaatgtatagtaagtttaaaagcgacaaataagttatacaattcgagaattttttttagcaagcgtttcaggatttcaagcacttaactacttttcgttttccctgatgaatctttttactgtttccctgaatttctgaggattatcacttataatccaatgcccagctttaatgtcctcaattttgtagtgcggaaatctcgcctgtatagcttcttcgtcggtatcttgaataaaatgagaatcagttcctcgaacaaagaggcaaggcccattaaaaacctcatgctgatacggaaactcgaatatcttattgatgttgcgatatattatatcgataggaatcctacaatagacgtcacctgagccatagtcttttttgatattgctcataagaaaggtccttattctttgtgagggttcgaccaactcaagtcgtgagtccacacttttcaaagatacccttgggtctgtaaacgcctctctcaacacgtttaagtatttcttgaacttagaaatttctgctgtcacatcatttcctgtgttaggttttggaacattgtctacacttattaacatcgagcatgttttcgcatctctcaaggcaagactcatggccacttttgctcccatggaatgtccaataacaataggctgcttaacgtgatggtcccttatgaaacactcaacgtcttgagccatcgatgggtagtcatgatttggattgtggggagagtctccatggtttcgaagatcaagacagtaaacgactttactcaatgtccgacttaaatgcttactcgtgcctctattgttcaacttatttccaagcagtccgtgaaggaaaatgataggtctacccgaggccattcctttaaatgtcctatactcatcgaaggcgagctttacagcactaccgcttgtagttttgttcattctctatgacttaacactgtttaggtttaggtgaaattcctattcgagcttctctttaatgaacgactcccagtgcaaacaaactcacgaccaaaaccactgtgctggagcatatctgtttccgtcacgaaggatctaaaacaatttgaattcctatcgcaatgtttgaaagaaaactgcgtcagcccacgatttacctacgacaaacatttttacttctgtgctgaagcctagctcgcccggccacttgaatatacctcccgaaagaacctagtagtactttcttccaggcaccgataagaatcccaaactgatgaacccaagtccaatcatacaaaaaagatgtctaacatcctcatcaaaaccaatcgtccgaaaacttttggaatcatttagtattgtagaaaaatgtcgggatcctacttttgatacgggctgtacatattgtaggccacaattcccgaagggtaaatcaatcgaatttgataaaccgctgaacaacaccaaacctaaagtatggaaacatcttcttgtctatacaactgatgttgacgggaacaaatggcctagtaggatagagctggctcccgatacatttgcttccaatatccatcctttgcgaaaacaaatacaatcaccgttgcatcctgttttgataagtaacgtcgctctagagagtcaccaagatcctaaccggtttaaagtggtactatttcctgacaatctaatttactatatccagaaagataagattcagatttttgcagaactttatttgaaacctggagccgattcccacgaagtggcaggcatagattgggagaaaaatatgaatgggcttatcttaatatgtggacatactcagcgagatgaaagatgtggaattatcgcccctcttttaaaaaaggagtttgaacttgtgttgaataaggaaggactactatacaataagtacaaaaatcctggaggaataaaagtgggtataatatcgcatgttggtggacatgcattcgcaggaaatgtaatatactttaacaccgctggtcaatcaatctggtacggcagagtttttcctgataaagttcagggtattgtgaatcaaacagttgaaaataagaccataattcaagagctatatagaggacagatttaaggtagaactataaagcatcgattttctagttgtagtattggatgctagttctatcgttagctacaacagaaacgggcagtaatcgttctgttgccattaaacattttattcgttcaattgccatatgcagtagcaattgtccagtaggttttcgtttttttttttttgagaccagcgcagcattgtttatatacaaccactcctccatcaacctacaatcaaacccgtcagtctacagaaagcaaatgacaagagctgtgtttctgaaagttgataattttggggctccagttgctggatcctcgtcaggtgtgattaccttaccatctgctccattggaccccaattacaaagaaggagacattttgctacaacttcatattataatagaagctggaagtaccatagccaataagggtgacttgtggcacaatgtcccatcatcttttgttaaaaaatttgaaagagacaagttttaccagcagaaaattacttgtagcctatacgaagatactgttattgctattccaatttacaaaccaggcagtttctcctacttcatttcttaccaggatgaagaattagatgttcagaaaacaacccgccaatattactttatttcgcctcccaatatctatataaacggttcctatctgcccttcaataatataagcctgcagtcggtagtgtctaagtggatgggtaatgatttagtggcatgggaacgaatattcgataagatttcaaaaaagggctacaatatgattcattttactccgttacaatcacgaggggaatcaaattcgccatattcaatatacgatcaacttcagtttgatccaacgattttcaattctgaaacagaagttgaacaaatggtatctcggttacatgaggagcacggtatcctttctatgactgacgtggtctggaaccacacagcaaataactcagcttggttgagatctcacccagaagctggttataatcgcgagacttctccacatcttatctcagcgattgagttagaccttcgcttgaaagaatttagtaacagtatggccaaccacgggtacccgactactataaaatccactgatgacatactaactatcatggatggaataaaagtacacgttctaggagatctcaaattgtggcagttttatgttcttgatgttagaagccacgttgctgagttaagagaacactgggaaacaagtctccagggaaacatcaaaattgggctaccacaggattcttatgaagactattctaaactagccgaattcgtcaaggatacatgtcttactcggccattccaccttgcagagcgcaatgccaaccgcctagatattagctcctttgcgtgcattttggcttccattctcgatacgaccgaatactcttcagaggtagaaaatagggctactagaattttaaatgagatcaacctcccacaatacaaaatctacgatgaagattctaacgaaattttagaacagttattcaataggattaagtaccttcgtcttgaggaacatgggcctcaacttggtgagataacaactaaaactcctcttaccgagccctattttacggttttcaaggacaagaatggtaaacagtgggaactggccaacaatggctggatttggggcggtaaccctttggtagattttgcttcgcgtcaaactaaatcatacttgcgaagagaggttattatctggggcgattgtgtcaaacttagatatgggagtggtccagacgattcgccttacttatggaataggatggttcaatacactcagaaatgtgctaaaatgtttgatggatttcgtattgacaactgtcactcgacccctttacatgttggagaagccctacttgatgctgcaagagaagtcaatccaaatctttatgttgttgcagaactcttttcgggaagtgaagagttggacatactctttgtagaacgactggctatttgctcattgataagggaagccatgcaagcttattcagtaggggaattatctagattgcttcatcgccatggaggagggcctatcggctctctccgttggttaccattagatgagttctcataccctgcaaccaaagagtcccaggttattactgctaatgcttttattgacaaagcgtccgagattcccgttcctcgtgtgtgttttaggaatgcgcctcatgctctttttatggactgtacacatgacaatgaggtgccgaaccaaaagagaaaagtcgaggacacgctgacaactgcggccttagtatcattctgttcgtgtgctgtgggtagcgtgtatggttatgacgaatgtttccctgaactacttgatctcgttaacgaaaaaaaactttacaatccttcaagtaacaacggaataccttatgtaaagtcgaggttgagttatattagggagtttctgtctcaccaatcattggaccattctgaaaacaacgaggtgcatgttcaccacgaagggcaatttgttacggtgcatcgaactaattcaaaaactggccggggttacttcctcattgcccgaactaagtttgaagagggcgcacatgaaacgttacccacaattaaccttagtgggaccagagtgaaccacgagttttcgttttccctcagacaaaagaaagattatgatatttcttttgatccgaagtacttacccgaagtcccagttgaccttgtagagttaagcccccctcaagtgagcttcaatgagtctaccaagaaatcttgtatcacactgcctgaattttttccacagggttcaataaccattctatctactctaatggaaagtgttgatgaggagttagagaaatttactactactggagcaattgaagctactgaagagttgtcgcttatagatctccaggcaatattataccgttgtgaatctgaggaaagagacgcaagcgctggaagggatggtacctatgatataccgggacatggtcgtctggtttatgcaggccttcagggctggatcagcgttttgaaggatgttatcaagaagaacgatctagcccatcctatttgcgagcatttgcgggaaggttcttgggcttgcgattatgttactaataggttgaacaaatttgtcgagttgagtcaaaatcctgatgccgtaaatcgctttagaaaatggcttcggttcagaatggatcgcatcaagcaagtgccctattttctactgccccgttatttttgcattgttatcggagtagcatacgaggcattgagatttcgggctctttccttaatgtctcccatgatccaaacaggtacacggtttctgcaaaatctttctttggtctcagttcaaatggtcggatgtatgaattcagcaagtctaaccccaaaagaaatgattccatcaatggcagctggtctaccgcattttagctatgattacatgcgatgttggggtagagatatttttctttccttgagagggcttcttttagctacaggaagatatgacgaggccaagtcgcatatagttaactgtggaaaaacacttaaacatgggttgataccaaatttaataggatcgggcgctgagccaagatttaatgctagagatgctgtatggttttatgcccaaagtattcaagattatgtgcgtgaggtcccaaatggtcatgaaattcttcaagagaaagtcgaaaggaggtttttaccgtttgacgactcttggtttccaatctccgaccagagagcttattcggtgacgtcaactattgaagaattactttacgaaattctttcgagacacgcttctgggatcagctatcgggaagccaatgcaggccccaacttagactctcagatgttgaatgagggtttcaatgtaagggtaaccgtggattggaataatggccttatctttggagggaaccagtataattgtggaacttggatggacaagatgggagaaagtgaatcagcaggcaataaaggaatacccggtaccccaagagatggagcagcaatagagatcataggattgttgaagagtacacttcagtttgttgttgacctgcaaaaaaggcggttgtttaaattcagtaaagttacgaaccagcacggaaacgaggtcacttttgagaactggaatgctttagtggccaaaaatttcgaacgttgtttttatgttcctgagaatccttctgatgatggcaactatgaccttgactcggctatcatcaacagaagagggatttataaggacttatatcggtctggaaaaccctatgaagattatcagttgagacccaacttttgcattgctatgtgtgttgctccagaactattcaccccgtcttttgcgctaaattctcttaagaaggcggatatacttattagaggccctataggcatgtcaacgctggatccttctgatttgaactatcgtccctactacaacaatagtgaagattcaacggattttgcaactgcgaaaggacggaactaccatcaaggacctgaatgggtttggttaaccggtttctttttgcgagctttcagatcttatcatcttaaggaggttgatttttgtaggaacgaaaaaggagatcaaagcactcatttagacttattactttcccagcggctgtctgcccataggagctggattgcagaaagcgtttgggcaggactcacagaattaaccaatagaggtggttcgtattgtccggactccagccccacgcaagcatggagtgcagccacgttgatcgaactttaccatgatatctatctgcatgaggattagagtattacttaaagtttttatgtcggaatgcatttaactaatgcctcgtaacctacttcttgtgagggatctaagaatatacccctttggatattgataacccttcccgttttaacagaagacctactgagagaagaactcgaagattttgaattataaaagacttcaagtgcaacgtcattatccaatttggaccaggttttgccatcatttgggaatagaaatgcaactttctgccatacattctctttaatgtccagtttacggttgattaaatggaccatttgtggtacatttctggagctgtctgcagctaattgatcaaaggatagtgatttaaggtcctcatttaccacaggaagtaaatcttcaagatcctcactaatagcaatagcacccatagttagggtaattggtaaggaagaatctcgtttctcgatatggttaaataattcttccattgctactgtctttgcatcctggttcccaaaagtgtgaaggatttgtgcaagcaagatgaccaatctataggaatccgaattttcgagacaaactttcagttgagacagtgcttttgaaagctggccattgaagaaataagaaagcgctatcactgatctagatgataagacgcatttcaagacatgtgaatttcgaggtagaacatcgtcttccgacatatccatcgccatctttgcagccataatcgcattgccgtactgtccggaccccaagtaaagtcttgcctgttgtgatttggctgctgtaagttgatacaatacacttacactccctctttctctgtaagttctttctagtgaactgaacaagtttttcgctaattctacaccaagttcaaacttttgagtgagttcgattaaacttaatgtcacgaataacgcaaactcgttctctgaatctaatttgaggtacctcaacatgaggccgcaagccaaactgatctcctgcctttcagtaatagtgtgtccgtaaaatttgttttgcattgcaaatttcttcaaaacttgaaatccgtacaagagttgtgcaaggggcgactttccattggagagcaccatggcatgtgcgaaaaggctaaacgtactagttgcatctggggtacgttcatttcttgatagggccaggccttcccaagccaaatattcgttcggttgcatacttaaggctctatgaaacgaaattttggctaaatcagtgtcgcccgcgattaaatatagtgctcccaaattaacaaacacggagtgattaattgaggatattgatgacgccttaatatagcagtgctgggcaactcgagcgttcttgagaatagtacaatttccgagagctatccaataatctgccaccaatggttcaatcaggattgctctctgtagaggcttaatcgaacatttcaaatagaggagcttattcgtcaatgtgaaagcgtgataatatattaaccccagattgtaatataaggaagctctcaacttatttgaggatttttgtgaaagaacctgaattgcggtcttcgcactttgaaccatgtaggatattgctcggtcaaaatgtgttgcactttctgcttcaactaagagtcctttcctatactccaaaccatcgcccatttcacagagatcacttcttgaaatggcaactcttttcgaaatagcagaaatcttgttcacatagtagcttggtaacgaatttttaaccttagtaaatatgagaatagcctcggaaagatatttccaagatttatagcaatgaatatcaacttctgagagctgaaaaacaaaatccaatgatattatgctggcttcaatgcaacgcccaacaaaccctctagataagtcatcttggcttttggtcaagaatgactcaatcaaagcggttaaaatacacttctctttaggcctagtagaatgcaatttctgaagaattgacataccctcagcaaactgacctccataagataaggataaagccaacatatacgaggtaaaccagttggagtctagattattcaagatatgattgaaaacttttatagaagcttccaatcgacctccgctcaaataagcttgacccaatccaacccaggactcagtatctttcgaatcgagccttaaggcagactgaaaacaggcaattgctttaacatcttcttgaacttctaataaggcgcaccctagacttcggtacggccatgccggatcaactgcgccttccaaaatacttctgctggtgtcagaatcaaccactcgctgtgcaagtactcgtacagattcccaatctggctccaaagcaaagttaaccactaatcgccttgcggactccagctgccttatatctaactcaaatgctttatagtagcacttattggcccttttcgagtcattaagatagtcttcataaactattcccaaagtcgtgtaagcaggtgcgtatgtagcatcctgctttaaacacacaaccaagtttgaataagcttctctaatgtttccttcgactaagtatcgatcatgtaaattcttaacttcttgaacttcttgtaaatacgaatgagccaacctccattgaatctcaactttcatttcttcatcttgaagactggtatcctttaaacaagaagtaagaagattcctaccgaattcgagattccctaaattaatttcgcaccagccaagataggccttagcttctaagtttgcatcgaagattgtttgaagtaattctttagccttattgaactcccctaattgaaggaaaattaacgatttcccgatcttagctttcgggttggaaggatttttttgcaaaatagactcatagagtttgaaagccctcggatgatcttttggagcatcatagtacgtataaatagatgccaaatccaatagtagggattctttcgtatgtggtaaactcaaaccataatctttcaatactttagttagtagattgatacctttacggcaatacattaatccaaatttgtactccttcagcgataagtagaattcacttacgattctacaagcaagcagagaggttgaagctttctcaatgcttttaacgtaaaaagacattagctctgcatcgttgagggctgtggatacagtgagatctgatttgaactggttgagcagttcttcatcattttgcacatcaacaaagtgcactgctctttttccttcgctgttttcttcgctatacgtttcttcagtcgtgaggtactttcttactttatcctcgctataatttgagtaatcagagtaaacaaagccgtataagatcgaacccaagccttccataccaaatagcctaatataatcacacagcaaccaaaggggcaaatcatcgacattttgcggatcaagccaattcaaataaatgtcccaagccagcctaacatcccttttgacagcaacaataccttcgcaggctacaaagatccttcgctgcaaaccagtcttagcatcaccgttgggtgcgcaggataggacatcgagctggtacgataaccacaggtgattgtattttttttgcaagtcatcatcctcacaaatttccaataatcgtgacatataatcgggtagcatggatttagaatacaccgcccacttgatagagtttaatttattctgaatctccaggggtatattattagctgtctttattttggccctttttatgtttgtagcaataactccttcttccttatgcttaagtttatcgattattaagatcaacgatctttcttctggaatgattgggtttcccaccagcctgcccaagaatccaaatgaagtagtactatcaagaacagcaatacataagtcttggttcttctcaaattttttcaagtaaatctcaacttcttttgcaatctcttgcaaagattcgttcttcttagttttaatttcagcgtaccctttcaaaatgctgagaaatgactcatagtcatctgattctcttgccaacaacaagagtcctttccatcctagttcgttcatgggatctatttcacaacaagtcttgtagtatttagtggcattcaatgcatcagaccgcaagtgataagcttttcccaaaaaaatatttgcgaaatagttgtcctgctccaagttcaatacttcctcagcatattctatacacgagtccggatcattggagactaaggcattttttgctgccttgagatgtttctttacagacatgttcaagatggagcattcaccatctggtaaactaatcaaccaacagttaatgagtacgacactacctgtataggaatcagagagcgttagggatcaagggccatagacggtgaagtattgatttttttgtgggttaccatatactttcactttcaaactcatgtcacacttatttgaaaccaataatgaaacagattcataccattcttcctagaaaattattgtgtactcacgttatttgattaaatgctgataaagcagcaggatgtacgattcgattcgctgttgtgaacaaactaaaattgccatggataacttgaatgaagagcagatagagaaactgcaggccatttttgagattatggatcaggattccgatggcaaaatttcaatcaatgacttaacgcaaatatttaacagccttggtgattcgaagacagagaaagacgtgattacaatgtttgaagaacaacatccagattcgaattctggcatatcgtttactatgttcttaaagttcatgagctcaaagattgagcggatgacagagacaagaaagatgagagaggctcttactgtgtttggagaggaagaaattggcaaacaagcatttagtgagactttggacgacactttggaagtgcaagaagttttgagtgagttttctaaggaaaaccacttgactggtgaaattgtctttcgaaatgaaaagtatcttaaaaagcagctgtaatatcaaccggaacgtagcaagagggattgtttctgaatagtggcttttagcaacgtttattataagtgtttcaacttttctgcacacaataactattttttctactaaggtttttttagtttcttgtgataacaatcaattatcaactattaattcgtcgcacccccaatcttcatatgagccatcgggcaaatacctgcggataactagtgggatttttctctgggaaagttctttcatggcaatttgtagtggatctgtttcgccttctatatcaaccaaaaccggggcgttcatggagatttgcaaggctctagtacccagaattcgtgcacgttcatattttgtcaggtaaggtgttgtggtcctttcttccttgagaatagcgagttctttattcgacctttttctatgtgcttttattgttccattaacttcctgaattccatctccgttaatgatttgccttccatctgcggtcacaccgaccgcataatcctccggttgcgtgcttctatcttcaaagttgtcatcgctgaaatgctcgtcctcaaaattttcaaaattctctgtttgttcattaaaagcttcgtcctctgacatcttctctagaaaactgtaggagattcacagcaggaaatgaaagaatgctgaaaagtctattagtactgggaattgctgatattggtcaggacactacaaccttggtttgttgaaatctttttcattcttgaatttaagcacgaagcacgaagcaggaaacacaaaaaacacaattgcttgtttcaccctaaaactataaattggtcttttgagatcatgttgtaccaatgtttagagtgtgataagacctacaagaaaccttcacttttagcgcaacatgccaggtcacataccaacaaccgaccattttcttgcttattgtgcaaggaaacttttttaaggaaagatcacttgaaaaggcatgcacttaagcacctacccaatgacgataaacctttccagtgcaaactttgtaaaaagggatttaatttatcccaacatctttctcgccatgaaaaaacacatgtaccaacgttccagtgtacctttgcggattgtaatgagacattctcctggccgcaatcgcttaaggctcatattaaatgggttcatcacaaagatgaacagaaatgtcatttttgctctaagcgttttactagaaaagaccgcctatctctgcatgttgatcgacaccatggtgatcaggttgtcaataggttttcatgtactcatcagggttgctttcagagttttaaggattgtcataagttgagagagcatgaaactcaagcacatggtgatgaaactttctcttttacattttcgaaaccatataggtactcatgcctacgggatcctacaaatagcgatgaagttccaccaatcatgaatgcttggcgttgtcgtaattgtgactcgaatgtattcagtgaaaaggaacacctattaaaccactataataaagtacacaattacgtaccatactggttagcggtcgaggatacggctgtgctggtgccgactcggagaattgtagttggaaaggaattcgcatttccagaagatgacaaaattactggggaaatattaacccagagaatgaatctggaggcacacatagttcgtcaacacaggtctaatcagttaatgaacattacttctgggaatcatctttcaacgctgatagcatccaactatgacgtaaggcccatacgatgtacctttaagcattgcaatcgatgtttcaggagacaatacgatttacgaagacatttaaaatggcattactattacaaagagaggatgggaatttctctgggccaagcggaaagttcatcggatacggcgaatagttgacagttgggcaggagataaaaaatttgatgacctgcaactacacaccatactgtggaaactcttcgcttagaaggagaccatcaccgatgctggtgacaatgctgccaacaaattgacctcagaagaacagaagggattcggccagagagtcttcgtagaaagcagaccggcgaagaatgagttagaatgagctttattgtactttaaaatcagctaagattcatgtcgctcattgtgaacaacaaatcgtcatcctcttctttgatcgtgatctctttgctttttttcgtatcttgaaggcgaagttttctgtacttcaatagatgattcaaatttctttgagtgatcatgtcttcctcctcctcatcatcatcaattattgcgtgctcttcataaacatgttctttagaagcctcatcagatatcgcactgtcaccagagcctagcccggatggtagtcctagtattgttccaggccttggcgactggccagatcctcgtctgttggaagaagagttacgtcggctcgaactctgcaaaatgtcacggatagaattggctgattgtgcggagtcctggtgatccattcgtgcgtaagttaaagattgagagattgaggctgtagatgagcctggccccatggttggaggtgatatggaataccttcgtgatggggacaatgagagaactccatgggcacttgtgggtaaacttgcatgtaccgaatcactcaagatatcatgagttttctgtaagagttgaaatcgattcagagatgacggtgaagtttcacgtgaccgtgctgaggaaagccttaaattcggcctggcatcaatcatacgcatgaggtcatttatatcttcatcgacgtagaattggtctgggtctatgtcagacgatgataagtcacttgaacgacgatcgaccgatgttcgggaatggagactccctctgcgtgctaacctaaaagaggaagagaattttgttgctggagagattgttgaatggtcctcaagcacggagtttattgacgttggaatgctatttcttggattccgaagaagttgtacaagggaagcgttagagcttgagcgatgatgaatttgaagagggataggctgtgactcagtccgggcacaaagtgtcgcagtgaagccatgaccgggactacgaccagggctggacgataaaacaccagtcttgaaaggttgtattccaacagcccgagaaagcccacctgtgaccgtgttatcacgcgcttttcgacgtgtgcttgcccaccgaaaggcagtatttctacggaagctgcaactgatcttcaaactacccattgaagtggttatagatcgaaattttttttggctcaaatgggaataatagcactgactttgatcttgctcttctgaattcttcgattcgcccaggaacgaatcacttaaaccaattcgatctttgctggagattggctcgctaccatctaatgttcgagtccctattttccagttcccctcttgaaagagcctaaatgcaggcatcaatcgtacaaatgtgtagagattgcgaaaaagaatgatcattttcttgtaaataccgtagatctcagtagaatttttgtccagggtagtcaaatcaaattctagtaaccatcgttctagaacaatctcgttgcgctcgtagttaccaacgttgatgacgacatcatcttggctcaatccatcggctcccccacgaaggaccagactatctgaatgctctgttggaactaccagaaaaacttctaaaaccatgggtgggatcgttagtaggtcattacctttccaacgagataatgcaatcttagcactagaggacagttctggaaccagtaagttgaaccatttattgggtttaacaaaatccagacctgaatcttcacttttagaaggttcggatgaaaaaaatcgtccgtgtgtaaccacattcgcacctttggaaaaaaatccgttcacagattgaactagtttgggccttccttttaccgtcgaatttgttttggacattgtaaaagattacgatcgataattgatagttcatagaacaagagacatgttagatagcgatttaataattcggactcttgaatgtcggatgcgacaaatgcccgcgatagggaaacacgagatgaagtaatcaacaattatctaggtacaaaattttaatgcatcaagggatgccaatatcctactcagctgaccataacttcttagttcatgttgatacacaaattccatttgtttcagttcagaaggttgtagaaactctagttctttgccctgaacatcatctcgactaaccttatcaagaagaattttgttgtcaattttaagagctgttaaactttccagtacttgagctgcgttgaacgccaaagactttaacattaaatttgttccaagatcaaagcggtggcgaaaagcaaaaactgagcgaagtgcattccgatcttgagttttcggaacttcttgtatttctataatctgaaattcaataagtttggccaaatttgttctgatttcacttgctttcatgagtaccttgtttgctaacattttctcatcaataagtctatgatcgatgatgcagttaagtattcttaggcaggaagcccccagaactgttccgatgcatgatttgtatacttgtatattgatcacaggggccaaatcagtaaaaggcacgaagaaagtgccatggtctccatgtgcaaggaatggaactgatgaatctttggctagaagttcaagcagcgcctgcaacttcggcatcctagctggatcttcttcagcgtaacgggctacattgacgggagcaagtaagttggaaccggagcaattatcttcgagtttgattttcttatgaaccgatgctgctgtgtgctctgaagaaacaatgggacgctttccagtcgaaaaagcttcactccaaatcgtggaatcaagagctcggcgatactcgggagataatttacttagaacatcactcgggtgaaacgtaacttcggggttacaatcattgtcacgttgcctctccaaagtttcacgaacagtagctggtgataatcctgtggtcgtagattgaccagatccggctactagtcgtagtaaaactgttacatgcatgttaagaggagattttgtatgacgttccacgatggaaagtgcagcctggtagacttgtcctgctacagaacctaaacgatgacgtgccaaattagtcaattgtaaggtacgcttgtgcttgagaaagcgatcgaaattaacagctagcgctacgttacgccttacttttgagatagaaggtgactcacttgttacattggagctgaccaggcccattcttagatgatccaaagactctgtcatttttctgataaaagcaatacaagtttcctctcgaacctgcgcggtacgctttacatcacttatcgtttgacctaagtgctctttatgataactagcctgggtggttctatagagatcatcccattgatcttgtaccccttgaaacccctctgatccagtaggaattaaccaatcatcttcaatcaaatgccgtgcagcattatggatctccacaccattgtcatcacgttctaggtcaccaagtctgacatgccctgaagtaatcacagcttgaaggagtgtagcagcatctggaccatgttcgtgccgcacaactgcaatcatttctcctccataaagaaggagaagaggaccggtttcatggaaataataccaggtttgcccggccgagttctttttagacttgtcgccatcattttcattagaatgactattagtttttttctcggtataatacaccacacaacttaactgaatcaaagctaccagagcagcgtgaaccttacgttgaggtatgcctaaagtgtttcctaaacgacccactgtcaagcggcctttcgccattagtagccctattacatcgctcgccacaggccctacgacctgtctgactaacgtcgtgtataggtatgactcaggagattggctcctgttatagtctttgtccatgggggaaaagagagagaaaatttgaaatagattatataatcagaatgccataaactgcagattatgtcagcgccttgctgatatttaccttacctaagccctcgaccaatcaaaaccaactctttctcttcattacatacactcaaaagccatgttgaagaacatcactagatcctacgccactgcacctgttaaggtcaccagtacttctagtaccctcctgtcggctccattggcatcggttcgtattgttgtcgcaaacgcaggttccaaagcatcccctgctggcttggctcacttattgtcaagatccaacgctgtggccgacacagactccaagtctgccctgcgccttcatagggaatctgagttactaggtgggcaagttcagtctaaggtaacccgagattctatcattttatctgccacatttcttaaggaacatgcaccgtttttcgtttcttctattgctgacttactcaccaagactgtatacaagccctatgagtatgcagaaattatcaagccagcagccttagcggattatatcattgctaatggctcttcatcatttgttgctctcgaggaattacattctatttccttccgccgtggcctgggaaaccctctattatatgacggagtaagccatttctctcacgagtcgttgaaggcctatgctgcgcaagtgtatacgcgggataatattcttgttacagggtccaatttgaatgaggcagatttgagctcatttgttgcagattcttcattttctgacctttctgttggcaatggtcctccttctattcctcaaaaacaatttttaggtgttgagtctcggattcgccgtgttggtgccaccacagctgtcttaggtgtccctttagacatttcaaatcttgcctcttatcaactggttgtttctaacctggttgctcgcggctttgattcgaaagtacttagttatgacaatggtgcgttgttttatgcttcagttagtggttctaccaaggaggtcaccgctcggttgagagatctcaagaaggctctttctgatatcactatgacctatgcccacttggccgctactcaagttgccaggcagagcttgtctgttaaaatagaaggaagttcagcagctaacctttctaagactaatctcgttgtcgttggtgatgtggacggtgttccttacttagacgaattgtagatacagtgccgttgattgtcctttaaatatattcacttatttaggttcaaaatactattcgataatttaccttaactttgctctaggtatgtatagaaaacactaaatctgttcaacaaacatgcgagcgaatactttcgcccactgaacaaaaaattaccttacacgctttttactacctttatgaagcacagatttatcaaaaaagtttagaaactctcggcgcgaactttgtttcttttccaaatgtcgtttaatccaataaacccgaaaccatttttgaagtccctaattaacagatctgtcattgtcaaactgaaatcatcaaatgtggaatatcatggctttctactcagtgtggacaactacatgaacctgtcactcgacagtagcactaaggagtttgatcctataacagaagagctaacgccacttggaagtgacctattcatacgctgcaataatgtgctatggatctccacgactgaagagcatgttcacaccagtaaagctcagtgagagatctaagatttaccgttcttatcgttcgtctttgtttctaggctgtcccaaagtcgttatttgtagtctttttggtgctaagttcagtccttaactattcaattcatctttctcgcgaaaattaattcaaatagttcatcgggcttcttatctatgataatctataccataaaatgtgaatttcactaatgaaacattaaaaaatcgagagcaaaacttgtgtttgctctagatacagtgtctgttggtttggtttttatattattgtttatatattgcttttacatcgtaatcagctcaaaattttttgtacactgtgtacgccagaaaattttcgcgagctactcctttgtaggtaaacctattcagtcgaaacgacttcattctcggtgaccttattcgttcaattgaggatatatggagttaacaggtggtcaaatttccaaggtagaacagcgtccaaacgcggtattcattagaggtgttggtcaactttctacctcagatataaagcattatcttgacgctcacctcaaagaaggttacactttttccactagacatctcttcgaagactttaaatatcgaattcaatgggttaatgacgaaagcgtggttattaactttatctcaagtgagggtgccctaaaagcgttaaggttactttcaactcaagatctacccctccacgaggaacgtttggcccaaccttatcgacgcaaatccaaggatgatggtcgagatactgacgatgataaggtaatacttcatgtaagacaggctcgtaccgatgataagaaagagctcaatgcaaaagcaaaatcccgctattatttactccatggtgagcctgagttctcatctggagcaagaaaaggtagataccgagaaagagattcagtggtttcgaaaccgatacaaacaactgaagatttaataacaggggaactagttactggaagggaccaggaagtacggcgtagcgatgccaatatgctatttcataggctaggttctagtaaggcattcaagacaagaaatgaggaggatctatttcctcagtatgctaatggtcagcaaatcgtttcaaatgatgaggaggatcttttccctcaataccttcgtgataggtctccaaagagatgatggattatattatatctgtagaaacgtaagttggcaccattttcactacagtaagtggctctgtcagagctcgaatacctaactctctggtataagaaactaagaatttcgcctcttcgtcttcactaaacgaaaaagtttcttgtcacctcttagcatgtttatgttgccagcacttttccttcgactggctttatttctgactatacctgctgatattgaaagcatcatacaagattcagtcttgttttcaacgccaaccaattcttacaagcagctgcaagaggagttttttcttcaacacatcaggcacacagtaacaaccagtccacttctgattacaatcttgaacttgattaataatgatcagtttttgacaaacttgatctactctgttgtggacatttctatagcatatcttttggtatctacaattgggagatttacaaaggtcgatagggagagaatattgaagctctacttgttcaatcctttggtgttactctcgttggtcagcaaaactaccacaattttcaacaacttgttcatagttgcggccctcaatgcactcacagtttcatgctattgtctttcagccatatttattgccacatctgcctatttcacgtactactcttggtacctcatggtgcctatactaacttatatctacaaagaaacgcagtgtactttaattgtgattaaaacactattagtctttgcggctaccacagttgcaataatgttattaaccacacaaagtaaggaagagttcttcacgtactacagggaactctcaagtttcactactataactccgaatttaggtttgtggtggtactttttcacagagatattcgaatttttccacaatttctttatcgtaatgttcaatctttacacatttgtttatgtgataccactaactctcaaattccaaggaagacaagattatcgcaagggacttattttttccatttgggttattcttgctcttgaagctatcttcaaaccatatccagttattgcggatcatatacttgttcactcttatgtacctctctggagtctatgctttcatgacttgaagtttccgttactattaagttatcttgcgaatatggtacttttattaatgctgcctacattttactttatgtggattaatctgtcatcaggaaacgcaaactttttttatgcaattggtttggtgttcagctttatacaggtggctgtgctcatggatttcatatgggcgatgattcaaaatagtcaccgagcatgttatgggttctctagaaagaggctgactcagatttagcaataatgcattcatacttcgttaaaggagcacttatgatcataaagagatgaaacgaaaaaacaaataatgcgtgggctccatagcaggatggtatcttcaaagctatcataagggatcgaaggacggacagtactgtgatgcgatggcgagagcaaataatccgaaaggaatttcatccctaagtacacatggtgaacgtctttgagccaaagcacgttgctaaactggcctaagtttgatcatcgtgcaaattcagttatatgatgagtctagttccttgatttcttttgtttgattcaattatgagatgggaaattgacagtcccgcaagttctagcagtgataccgttcttgttcttctcttcgtgctatcacatggccctggagtgagtttatagtggcggcagaatacatgccaggtttcaattgagctgctccgagccattttgactttttcagattgcgcttcgaaggacatcccaagcctcagtggcgtaagtaaagaatataactcatattgaactatatatcacccgctatcacgttattacttcatcgctcttccggtgtcctcaattgcagaacataggtatttgtgttatttaatgttaacgtgaataaatcagtttttttttctgagccagtattcaatagtctgaaggaaattgccacctgaaaaagacacctttcagttcatttgcagaggtgaacataggtactaggtcaagttctatttcccgtttgcggaatcattttttatttaatcttgccctaaggtgagtatcatttatttttcccaagatcaaaccaattcggttcgattgtttttcttgtaaacatgttaatcttgaaacctcgtctttcagactggacagttcttcgtctttatctaacttgccatgcggacggtaattcaaccctgacacacacatactttccattcgtaggttagcatgtagcacctctagtttttggtgcgaatcattggttgatttgatggcttcatcgatctgctctttcagatatgtactttcatttatcaaattggtttttcgatgtctcatacccttaaccaaggcttgaaaattgtagaactcagaatacacagttacctgtgagttgttcacaggtagagaaaccacttcattctttaagcacgtgaagatcccttcaaaagattttgcaatcttactggctttacctatcctagcatctaagtagttcattttcctttgtattacattgatatcatccgcaattttggacatttgctgatagactgtcaaaacgtccgtatttctaattttggtgatgcagtcaaatgtccgcagatggtcatttcttgttcttaaaaccatagaatggactccaaattgatgtatcaacgtatgggttagaagtctcgactgcaaagggcttgcgtcattcatattgtgtattccaataacgaaagctacgtttcgaatcttcaacgggtttgttaaataatcctgcacaagacgtttgagctcatagtacagtatgtgttgttgctctcgttgttttttaaccatatttcttaatacaagttccacatcgtcatgttcgttcactttttgatcttcctcaggatcatatcgaacctcagtcaataaagacatttctacatccagcgatgtgaattctggaatcgaaggcaattggggtaaaggccagtccagtattttgtctgtatccaaagatgatagccagtcatttaaataagacaagttggtagcatatatcggtcgtaattcgctaggtataacaccaaccctgtctcgtaatacgacgattgcagcaatcatcggctttaaatatcgagttaaggaatcacggttggaattgctcttctctctgaaataaattgcaatatggtccaccgtgttaatgggaactagcctcaccatgggtgctggtgaacttctagcttcccttttgttgaacagtaatgcaaggatgaaatcattcatatcttggtcttgtccactattattaaggcacgtaatgtcaaataggaagcaaacggagatacggttttccagcagctctttcatcatctctttgttcatttcttccttcttggaaggtatcagatggacagtcacgttgtgtaattttctattcatatctctaggtttagtaccgtggtatttccgaatgttaaccttgaagctagttagaaacccttccaacaaatctacagtttttccaggacgggagaccacaacaatgtgggtttcggggggtgaactggttgcgcttcctgcaccattagttcggcgttttttgtctttgtatagtttatttctgcactcgatgtaactctccatcaagtatcccagtattttaaacttaccacttgtggcactcaataattgtgaaatatctcttgtcaccaaagattttggcatgtagtgtgttatcagtaaataaggatggttgactactagttgagtatttaatagtagagtctctaaactgtctaagattacttgatcctgggtactttctaattgattcttttcatcttgaccaattcgctcatagaacttcagaatatcactataatgcaaggacactatctgatcaattaattctttctggaaatcacttagtggagtgattaatctgtaatctccatttctgacatcatactcaagattgaaatggcttggatcgataatcggaggttcgggagtggtatccagtattcgcaaaaggtccatcccgatgatgaagtaattgtagatgcagtcaaatcagcttttggtccagtcaggattattgcttgaacagcttagttatgttaaccccaagtattggtgtagtgatgcacaaacaagtttccacctcacgaaactctctgtgagtgttaacaaaaacgaaagggaaatactacacttgaaaaaaaaaaaagaaaaactcaagagacatttaaaggagaattgagtacctgccagactatcaatcgaatcattatagtcgtaattatttacatgttcagtgatgatttgattagtgttatggtttgtcacgtgatagttctgtttttcagagtcgagaataaaaatatggtcacaactcaacactattgataatggtaaaccttacgaaaggtacgttccttgggactattcaaatattgcacaagattacagcaattgtactgactgactgttaggtgaaattgccctttatgataggcaaattaggctatggggcttcgaagcgcagcatcggattcgaagtagccatattcttgtaatcaacttctcttgtgttggagcagaaatagttaaaaatctagtgctgggagggctgggatttctcaccattattgattcggggaagattttagaacaagacttgagtggaaattttttctttgacgtttcattgctgggatgttcaaaactggatagcactgtcaaagaacgaattcaggaacttaatcctcgtgttgatattgttacagatacttgtacatgggcagaaaaatcacaagcatggtttaatcgatttgatataattatttgcaccgaatttgatgctactcagatcgaaagtataagccgcacatctcgatcgttgaatatacctctctacgttgtcaatacacatggtctatatggaatgatctttgtcgatctaatagaccacagttctcatctacgacttgcgaaaaatagaatcagaaggaagcctggtcgttcaaactcagtcagagaaattgtgcatgttgaagaaaaaactgagaatgatgtggagtacgaagattgcctcattcaaaactattacacttctttcgacagaatcttggagaaacctaaattaaaggagttttttccgaccatgaaaaaattaaacaagattgacagcactctaatcgttcttctaggatgcctgaaaatcccaacctcatacaactatccaattggaaccgttcaggttactaaattggaacttctagaatttgctaatgaaattgctcgtaaattgggtctcacgagtctagatctcaacgatttaattcttcaagatgttgcaaggcaatttggttgtgagttccaacccgtggcggctatattagccggatgtttgtctcaggatgtaattaacatgctcagcaagagggaaaatcctattaacaatctacttatatttaacggaaagaaagcagaaatgcctatctatactatttagtactcttttgctgatttatacagcttaattgttctatcccatcctgagctgaaaattgactggccacttttcgtgatgtcacaactcatcaccttgtctgtatggcccttgatagttttaatcttgacccagttatcactgctgaatatattgatagtattatcgtaactggaactaatcattacattatctagcaacctgacatctgaaataagtttggagtgagcaggaatggatactttttctttttgcattcgcatatcccagattttaatgctgccatcactcgaggctgtggctaattcatatccattgtacctccaagatgaaccgtaaatagaccccatgtgaccctctaggttcgaaatacactttcccaacctcaaatcccatattttaacaataccgtctagccctgccgatgatatcaaagatccatttggttggtgctctactgtgaacactggttttgtgtggccttcttgaagaagtaattgttgctgtgtttctacatcccagtaccgccatgttgaatcgaatgaagcactcgctaagtaacgacccataggatggaaagagagtcttgcaacacggtcgttgtggccctgtagtttcgaatctctggagttattggtctcagtatttttagtatctgtgtctgtgttgtactgaaataggttgatagtaccatcgctttggctagtcgctatgatcctgctgtcatagtaccaatcaatgccacctattttgctattgtttccatataaaactcttcgcaggcttaggtcttgagaattcaagatgtacgtattaccatcccaagaacctgcagcgactgcttggtcatccggtgatactcttacaatagagatacatcgacctgttagagactgggaattatttaaacaaaatgtggaatacagtgcattaaccctgcgtttctccattaaaatctcattcaaactattgttttttacaaacagtctaaagcctttgtgcatccttgaagtctgttttaatgaccacttggcaattctcatgcgacaatggtataaattctcggatcctggtgtgtagaattcctcattttcatctgattcttctatagacacattggggtaggatgaaagcttaggctcataaaagcgatctgcagatgttgcttctgataccctttgcttattctcatcatattcgctgtggctcataatttgttcatttaattcccttggacttctggaagcactccgattcttggtgaacgtttgcatttgcaaattgttttcttatctgggtttcgtggagttgatactgcaaaatgtcaagtttgggcagatttaacaatttaatgtaaagcaaaagccaaaacttccgcgctaaatttccattctctttgcagagttcggtgtctaaaagcgaagagaatcctccaatgcgtccttaacaccctcctagtcgttacttaattgacaaagcgattttgaaaatacaattctttgttattagctttttttcttatgcagaacctacaccacactattcgacgattaaaccatataataacgagaatcgatcaataccagggccagacactccctccacaagaaacgtgatccttgctttaaagttgaagctaacgccacgaacataggatttttagttttctggtcatcatctagtatggttgaaaaataactgaatatatctagtagtcagcgaaactgtaccttaacgaatttacaggattacattccgtcactatcaaggttgggcatgttatcagaaatcaatccaagctcgtagcttgggtcaattgtcgggcagtttcaaagttgcgaaatttgccactgtcttaggaaaataggaacttcaatgtcgatgaatggatactgcatagctatcccaatgagtcattgaagctaccaactacaaaaatgcgttctgataagctttggaaatttgtagatagcacaattgtccggcttgcaaattactgttatagaatcgatgtgatcaatatgatcagggacagttgcccatagctcgtacttgtttgttatcggagaaactgaacttaaaacagtacctttatatcagatagaaatcggatgcccacatatcgaaaggtgcggtgttatagcaggattaaatagagttagtaaatttacaagatacgccttccttgtcccccttcgatactcaaagtgaatattctcccaaaaattcgtgctcgccatttctttgagttcaggtctacaattattagcagttatttccccttcaatgtcgatcaaaattgcgatagacagaggaggaacttttacagattgtatagggaatccggggacaggtaaggctgaagatgacgttattttgaaaattttatcggtaaatccaaataattatccagatgcccctttggaagggattaggcgactcttagaaatatttcgcaagaagaagatacccagaggccagcctttggatatgagtgatgttcgggtcattttgatgggtaccacagtagccaccaatgctcttttggaaagaaaaggagaaagatgcgtcttagtaaccacgaaaggtttcaaagattgtctaattataggggatcaaacaagacccaaaatctttgacttgtcaattacaaaaccagatgtgctttacgactcggttatagaaattgatgaaagaatcacactggaagactatactgaagatcccgatcctcgtgctgtgtctccacccaacaatgattatctagtcaagggtcgcacaggagaaactgtgagactaatcaagaaggttaacgaagctgaagtagcgagtcttcttcggcttgtatacaaacgaggggtgagatctatcggtgtctgccttgttcactcttatctttaccctgagcacgaagcaataatcggtcgaattgcaaaggaaattggatttactcaaatttctttatcttcgtcattgtctcctatcatcaagtttgtttcacgagctaattcatgtattgctgatgcttacttgacgcccgagataaaaaagtacttagcgggattccaacttggtttacaaaatggaatttacgatgaatctcaatccaattactctggagtgagaacgcaatttatgcaatcagatggcggtctagtagacgcactgtcattctctggacttagggctattttgtctggaccagctggcggtgttgtgggttatcttaagacttgttacaatccaaaactgaagattcctttgattggttttgatatgggtggcacttcgacggatgtttctcgtattggtgccgatggtgaatttgaacatgtttttgaaaccgtaactgcaggtatcactattcaagctccccaattagatatcaacacagttgctgctggaggcggttcaatattgtcctttcgtaatggattgtttaaagcaggtcctgaatccgcatcttcagatcctggaccactttgctatcgtaggaatggaccgttaaccataactgacgccaatttgtttttgggaagactagtacctgaatatttccccaaggtctttggtacctcagaggaccaaactttggatttagatggtgtcacaaaagcatttgttgaactcacaaataaaatcaatgacagtgtttctcaaaaaatgtcaacagaaaaagtagctctagggtttattgaagttgccaatgaaactatggcaaagccgatcagggcgataacagaggcaaaaggttttaatttattacaacatagactggtgtcatttggaggagtaggagggcagcatgctgttgctgtagctgagagtttgggtattcgcactgtaattatccatagatattcatctgttctttctgcttacgggatggctctagcagatgttgttgaagaagccagacaaccaacatcgatggtattgcttgatgacgaaagctaccttctactgccttttgaggagttgaaagatcaggtaaagcgaaagttaatcaaagaaggctttactgagagaactattgaactgcagctatatttgaatttgaggtataaaggaacagagtcgtctttgatgattccgaatgttgaagagacgacttttttggccacgtttgaagaacaccacaaacgagaatttggtttcatttgtcgagataaagaagtcttgattgatgacctcagagtccgaggaattggtaggaatgattctacagtgagcaagaacagctttctagatgatgagtttgagagtttgagggcttctggtagaattcaactggttgattcatgtctctcagatttgagtaagaacactttatttggtaccaaaaggctaaaaactcctgtatataggttggaaaagcttcttattggcagtagaattaagggaccgtctattattgctgatcaaactcaaacaaatgtcattcctcccaattatgaagctgttgttctgactaaccatcttctggtcagtaaggcagaaagtacttacagctatgaaaagccattacatgaagtaggcattccaattgatccaattctactttcaatatttagccatcgatttatggatattgcagaacagatgggagtatctcttcaaaagacttcagtttccacaaatgttaaagagaggctggatttttcatgtgctctttttgatgatgaaggcaatttagttgctaatgctcctcatgttccggtccatttggggtcaatgtctacttgtatatctaggcaatctgaactttggaaaggaaagttgaagaagggagatgtgctgttcaccaatcacccttcaaagaagacgggtggaacgcatttacccgatatcactgttatcactccagtttttgacgatcaggactccaaaattattttctatgtggcttcaagagcacatttctctgatattggtggtaaaatgaactctcctggatctatgcctccagactcgaaggaactatatgaggaaggtgctatagtttactcagagctactggttgaaaatggagagtttcgagaaggccatgttgtaaacttgtttgtagaccaaccgtcgaagtaccctggatgccatggatcaagaagtatttccgataatttgtctgacctcaaagctgagattgctgcaaatcaaaaaggtattagtttgctcatgaacctaatacaagaatttggcttacctgtcgtctccaaatatatgaaagctatacaggataacgctcaagaaaccgttaaaaacatgctgagagacctttttaccagaaaacttgttgacgatgtagagacgcgtaatggcatcctttatgcagagggctctgaatttttagacgatggttctcagattcatttacgaatctcttataacttaaagacagaagaaaccatttttgatttttcgggaacttcgcatcaagtttatggaaacttgaacgcaccggagtctattacctattccgcaattatatattgtcttcgttgcttggtggatgacaacattccgttgaatcaaggatgtcttaagccagttcgggtcaacattccgccaagcagtatactttgccctgatgatggatgtgctgtagtagcagggaacgtcatcacttcacagagggtcacagatgtgatattgaaaacattaagagttatggccgcctctcaaggtgactgtaacaatttcacctttgggtcgagctacaatcttcctcaaggagcaaggaagactaattcatattacgaaactattgccggtgggcacggagctgggcctggttggaacggtactgatgcagttcataccaatatgactaacactaggatgactgatgttgagatctttgagaagcgctaccctgctattgttcatgaatttagtgtcaggccaggttccggagggcaaggccttcatgtgggaggttgtggagtggtccgagagattgaattccgtataccagtgaaggcttctattttgtcggaacgacgagtcaatgccccatttggcttgaaaggaggtggctgcggtgcaagaggtctgaacattttaaagagacaaagtttggatcttcaagggaacattatgggatacaaaaattacaacttaggaggaaaaaatactgttgatatgattccaggagatcgaattgtgctgatgactccaggaggtggagggtgggggagcattcatgacacgaatcctcacaaagtgactaataagtctcaaggggaagatttgtttgttggaaagggttctctctcgagtaggtacgctgctcagcatgctgtttgaactcattcttaagcaacttctagccattaggtcctttattgttaagtatgattttcgattgaaaagtaaaaaccattctagctctattaatttttctttcctattcatttttcttagaataaaatgcaattctggacttcattttatcatctggtgatattaatgttttcgtgatgaatggcgcttttaagaagcaagataaaagagtcataagcattgttcgtcattacatggcgctgatacagatttaaataactaacagcaataattgagctatctaatcgcccccacaaaatcgcgagatctttcattatcacaaagatccacatatacatcgacgaaaaactcaccgtaattatcattcactgagatgtcccaacagcatcttcaaaactcagatcatgttaaattagaaatatccggccgtcgtccaagcaactctttaggctcacgcttttcctgggtaaagagactgatgaacagtaaacagaatagcccttcttattcagcaattccacttgccacaagaaatagtagaaagagggctgatatgacctcgatggagctaccgatgtcacggaagacacataataagacgcaagagaaacagtcaacacttaccactgacgttcaggatagtattacggataatagtagtaccgttcctattctatctctttcatcagcatcgttgggaactagctctttgcttgtggatgataacaaatctcagggaagctcattgactacatcactttcggcctctgcccaactgggtagtatgagcctcagtctgaacggtacccctgccagtaatgcatgggttctcagtaaccatgatgccgcgagcattgttaccttggcaagctcaaccaggaatagagctcgtagaccgagttttgacactaatgcatccacttctggtattgcaccgtcttctcttaacgaacgaatctcagttgcggcagcaacaggcaatcatgaaagcacacaaaatccctcaatagatgggattatcaatgagaatgatctgtcccatttgcacacatgtaggtcaagagaaaattcgtctgtcaggagcataaaatctcatgcgacagcacgcactgggaaaagctgatggcaatcatcccacttctttttatacttctctacgaattttgaactagagatgagtaatcatttgtatgcatgacgtactgtattttttggactataattctactcacatactaaaagcgagtaaataacagaatagacggatatgcaatagattgaaagtgcccagccattaacaagtatgtaagtcatactaaggcgacaatacttattgctttgaaatacgaatataaatagagtaggcttgaacgaatagtttcaaaaatgaacacaacttgacaatagctggagtcgtgtcccaaccataacttgaaagcactttctctgtttacatagcatcccatcttggagtcaaaaaaaaaacatccagattttgtcacaacaccagctaattgttctgctaagccaaacaggatgcgcagaaaaacctgtgatggtgattcatacgtgcttaatttggctatatttctaagaactcacgagaggcagctagcaaatgcactcttaggactgaaacgctcggagaagctttcttatcacccctcgagtgttggtatgtcaaagccaatccgactatcattaacgccgcatcatctgttctatcttttagaacggttacaagaacttggcatcgctgtgggccccatgaatcgaagacttcagagcattgatactagtgacgcacagttgaactacgtctcatttttatcggatcaccaaagccattatcataacaaaatgacttcagatactcaatcggttcattcgatttccagtgtgaaaagtgtgatgtccagtgtcagtgcattgtggaataatttcggcatgagtttagccggacacgatcatagtaaaactcaactaatctgtgacctcaagtacattctttccgccttgagcaaacttccttgtcttcgaatagctccagattcaagggctcttttagttgccggttatgaagagtacccatttgatactcgagtcccacttaaggttttcaaaaacttgaccgttctcgaagtgtgtgggctggatccacgggaagtgtgtggctgggcagtactcagtgagcagctgcggttcttgattgtaaaaaatgccaatttgaaacgggcttcagatattttgtatgacttggtagattctgatacggaagatgctgaggagacatgcaatcaggaactggacagcccaatcccaatgtcattttctcgtgctagctcacattcatcgccagcacttcattcttcgtcttttgagaatcaacacacccctcccgatgatcgaaaaggtaccagaagctcattttattgtcatcgtacaagccatggctacacatactcaactttatctccgatggccactagcagaatgcggcgatccaactcggtaagcagctgcgatcataagaccttgagagatccaaaaggaaatttgccaacagttcaatcttcaacttcatctcctccacctgaaacttgcacaaccaagattattaactcgaattccctttacccacatcgttgggccaagctgaaacatttgtcgttagctgagaataagatcccttacatcgaagaccactcattctcacgtctagttaaccttacttctttggatctatcaagtaatcgactgaaggaagttcccaaagaagttttgagcttgcaggggctcaaatcgctcaacctctcctacaatcaaatatcatgcacacaaacgttcacggtacgaaagctcaaacacttgacgttgttgaatttgcgaaataatgtcatttctagtttagaaggattggaggatttagactcattgtctaaactagacctaagggggaacaaaatttgccagtttgcagatgtaaagccattactgttgaacaaatccgtctctttgggcgctttatacttaatcggtaacccaatagccaaaatacggggctatagggtaactctattcaacttatttaatggtgtagagtatggctgcaagttaaaaattgacggttcgagtccaggtatttttgaatcacgactactagccgatgctgatttggccaagcagaagttgaatgagctcattgaccaaacaatcatcagtaggatgacaaaaagtgtctccaaaatgaacgttacctacaagagcactaaaaccatgaaacatacccttggaagcccttttacggaagaatccgagaccccagatgatataaaagagacattgtcagtattgacacttaacaattctattctgaattcgaatgtgcctctccgagataatgaacaggagttatcgttactcccaccttcaaaaccatttacacaatccagctccagatttcctgtttctgtcaaaactcccctatcaggcgctaaatcagcttctggtatctcgcccctttttttcaaagatgataaaaatgctcctgtaaactccaatcacagaaactcgactgagaatccgattcgaaaggtctctatcgcttctccagcggtgccagtgataaccacaacaacaacaacaactattcaaaacagtctttgtgtggacatggaccaagctgaataccatggcacaaagttttgttgaatcaaattccaatcatgtatatgtattgtacaatatatttcgctacctattaggtagcaattaatttcaaatgggcattagaataatgttctacaataacccacgttcttttttgaagctaacatttaacctgatccgcttgttcgcgattggttgagttgttttcaagttcaggtcgcacctgtcattcattgcattgacccctttcaatatagaccataatatcgatgacatcaaggtaggtagtttctggtctattgaacaacctattagcttaactaactacttcttaggtatcgagttgaatgtaaggagctgttatcacacatttgctagttatcaggcggactaactttttgtatgtagacgctctgaaacaacaccgcagagatgaattcatagagtggctgaaggggctgttggccgtaagtttttgtatctatcctgctgattaatgcagctactaaattttttttttttacaaggttccttttgttctccatgcggtcaaatcaaatggaataacatccgtggatgaaataaaatcaacttcggaggcaaaacggaggtatgcggaaatattattggatgttgaacacatgatcaacgactacagaaactcgatgaatactggtaggttatctcgattgaaacagttggtaccaaacgtaggtttgttttttacgaggttacctttagagaaagccttttatatcgaagatgaaagaagatccataagtaaaagaagactggtggctcccagtttcaacgatatccgtgttatcttaaacactgctcagatattagaacttggtacaaattttcattcatccagctccaatgacagactcaaacttgtcacttttgacggtgacgtaacattgtacgaagatggacattctatagaaaggaactcccccattattcccgaagtaattcagctgctcaagaagggactgtacattggcattgtcactgcagctggctatagtaatccttcgggggataaatattacacaaggcttaagggtcttcttgattgtgtcaatgagtctgaggagctcaaagaagagcagaaatccaacattcttgtaatgggtggtgaagcaaattttttgttccggctccagggtactaggttgcattttatcgatccgaaggattggattttgaatgagatgagtacctgggatcctcaatctattttggaaactctggatttcggcgccaaagtcttgactgatcttaaaatcaagctagggcttccagcattggtgatccgaaaggagcggggtgtgggattggtacctgagcctggagtcgaactacaccgagagcagttggaagaagtggtattgacgtgtgattacaagttacgtgagttcccacctgcttgtaggatcacatattgcgccttcaatggaggaagtgatgtttggattgatattggtgacaaatctttgggggtcaaagtgttacaaaaatttctttctacaaaagagtgtaatgttcagcctcataacaccctgcatgtaggtgaccagttcgcagctataggggctaacgactaccgcgctcgattgagtggatccacctgttggatagccaaccctgaggagacgaagaattgtcttatagatcttaacgtgtatattgatcaatgggcaactatttagaagtcgtgtagtagaatggtcaaagatatttttttctttcaaaattattgcgattgaactggtagcgctatggctggctagctagcttttatatttcttagtccataactcgaaaaacaaaactaaggccaatggaaagcgctaagcaggcagctatacaccgtggtcctaattgatcatcgtaccggatagcccttttcctacgaatattgaccactctccatagatacacgcccatggagtaaagaattgtgactgtggcagtaataaaaaaaccaatgcttgcaataaaagatactttatcaccatagctcaacaagagtgtcgctgttccccctataatcatggcgatggatagccacgaaagatacgttctctctgttgcaaaatagaccttaggctccacgcgtattggtacagcaatcttttttccagggggggctgaaaaactcacgtcaaaaactgtacctgacggcactttgcgaaaagagtcatcaacagctctaacctcacgccaccattttttgaagctagcaatgcagttggttgtagtgctattcgcagaatatgggtgagatgctggatgggatgactggaatgcaccgttagctagaggtaactgcggtataccagtcgattcctcctcatcaaggtcatttccggatccaatcccattctcattcccaagattctcgcggtgcttgataccaaatctctgattgttgcggggctttcgaatgtcaatatccatttgaggcaaccagaatggtatcaagtccactttttcgggtaaaagtgttgcgcacccatgtataaacttagaaaacttcggaaccgcctccacaaggtgagaaccaaccatttccttgacccaagcaggaggctcctgacctaactgagtctgcaatttaacttccaagacggcatagggaaaacggcaaacatccttctcaggaagctggctaaatggataatcgattccaatatccatacgcctccagttgttctgagttctgtcaattccatcaaaattatcctctctaaccaaactcaactcagtatctaatgaaatacgcacacgggcgtctccgggaagctggaatgcagttcgattataaaaagacctcatgacaggtctcattttgtccttgatgacacgatattgaacttcattggctaacctttccaaagactcaatctcctgtggggactttttaccctctttccggattttatcaaaagcatcgtggacagtgaaatctccacgaagaaagtcgttgacatttttctccttcaaggaaaaccgagctttaacagatttttctccagtccaatcctccctgtgagtttttctttcgacaaaaatattgtccgaagacatccctccgtaccaacgcaatcgaatggcttcggcaccctcattcttcagcagtctaccgtagtacaaatccatgtctttgtcgtcaaagtagatagaagttattgcagaatcttccttttcgaactccttggatgaattgaacaccaaaacaggcaagtgtttcagaatgataagttttaactcagtgatattgtctggatgtacccaatacttagttgtctgccttacaaaattctgtgttcgacctcccgaagagctgtctcctttgacaggattaccccgagttctaaccagatcatacagtttactcaatttaaccaccaaactatcgtagttgtctttgtaaaaggctttgctattcaaacgggccaaaaaaatgggtttgagaatataattttggtttgtctgcttgtcatgtttctttagtattttttgaaatccaatatagttcagccttgtaaatttcgccaaatcatgaacatctgcaatcacgtcgctgagttcttcttccaagtcttcaaaatcttgctcgtatagctctctttcattatcactagacacattccttgacccatcaactgtggcacttacaagactctcaacatccttgattctacgaagaatttcttgatgtttcaatttgacaaaactgtaaaccttgtcgagctcctgttctagagcatcaacgaatttttcctctaggtcattcgaccactcgtcttgtgtctgttgaagccctttcttcagtttgtacttcagttcgtcatattgtatatagtagtagttgtagtcctgaatcaaagaagactttaatgtctcaccgaacttcatttgatatggtcaactttggagatgttcagaatgagagaaaaacttgtggttgcaaccagacttctttaatagtgaaattggaaccacgtgcactaaaaaaaaaataggcatcgcgcaagagaattagatacagatttgcaaaattcaccacggtcgagaactcagttcaacttgcctaaaaatgctagacatccgcatccacatatttacaataagtgacaacaaagtcttgttctataaagccgatacaaatcttttcactctgttgttaaatttacatctcaaactttgcagagtgcttcttgggaactactttggtctcttctacaagtgtcaaaggcgacagctgtgttgttgcagcatctggatcgacagccgaattattccattcctctagctcttttgagtgttctcgctcaatcgcaaacttaacagcctcaagtacattttcacaaatatgcttgggcttatacttgggaatcgagccttcctggtataccccagtcttgactagaattgagtaccacgattcgtcgtgcgagtttgcaaacctaatgtcagactcaggtgtatcaccaacaaaatacactgttgaagcaggtggaaggtcgagcgtcagtttcgaaagtttttccactgttaaaccttcattatcagaatcggactctgattctgattctgtcgccaataaagttggtttggagtttctattcatattctgagacggatcattcaataaagggtcacctggtgattgttcctccatatctgatgttccctcttcagttgtcaattcttccacatgctcttctaacacgtcttttcgccattgagaaagaacctttgaagcaaatttgaaggtgcccctttgtggctttccaaatcgagtgacttgcagttcctttcctgtgtgttctctatagagggctgcaatggatacttgtagtgcccccataccatatcgagataaattgtagttggttgcccaaacgaaatctgaatgcgcaaagtaaagtgcaggaccttcttcgaaggaatctgacactgttcccatgaaaccgctcttggataaaagaagttctaaaatgatttgctgatctgcggcccagttacgagaatcggcaaacaccaaaatagcgtcaatgcctgtattgctgaagtcaacatcacgggccactgccagttcttcctctgtcagattatgataaggtgtgactgatgggttccatttcatcacatccaaaggtgtaaatacattcttaaatccatatttctcagccactttacggcaggcatccccaacaccaccgataacaagcacgttattgtaaacgctgaccaactcccgcatgggagtatggccctgaatgacttggtcttcggttacttcaatatcaagtctcttagagagttcttcagctctagcctgttcagcccttccgcctccattggtaacaaatatatacggaacctttatgttatattcgttggcaccatttaacagtttaagggcttcttttgcttcggggatagtctctggacccttaacaataactccatcaatgtcaaaggcaaatgcatatgacgccaccctgacatgatcgatgactgtctttttgacacgcactgcattcaatccattattaattgacaatttggaagaacctatacgctttaaattcccagtggatccagttgttggagtcatctgaagggatccggcccattggtcagataaagatagcgaggatactctttttctccgagtcatcggggtcaactcatctattccatcgttgttcaaatatgagttagaggccggagaagcctggtttccgatttggtctgtcatcatcgtccgtaagtttgtaatgacacggtgaagtggcggttagaaaaaaaaagaggtgggctcattagatttatatagtaaatagaatcagaagcgtctctaccatcatcgtgcagcaacatacgtcagaaaaaaggatactgcacgaccttatatgcatctctgggatactagtgctgatattgaaactgtatagcgggctcttggagctaccactgcgacattttccgccaaatgtaaccataaggcatgagtattaaaaattgttaacgctgctgtccacctggtattgttgtaactatgtacctcatacactatagcttgtaactactgtttacgcgcgacgatgacgacaataaagttatacaataacagaccatatctccactccatactggtgtctagaggtacagaagttgaatcacaatagtatcctgtttgtcacttcgctgagcttttatcagcctcacaatagtactggtaggataaataagttttgtgaaatagtcaaacatgctaaggaaatcgagtgctcttaactctaaagctgaatagttgctctaatttctttatgatttcattattctcatcacggcattattcatggctgggaattttaaatatggacgtataggtgatgacttttctgaacgataagtttaaacatgacattgagaacaactacgtatctggtttctatggcctcaagttcggaaagttgaccgattcgttttttttaggcaattacgtcatacgcgagctgtgagaactgtttcaccctttttaactaacccttcatataatctcaagctgagagtctaaacgcatgaaaaaccaagtgcagaataagaaacgaactagctcctggaaacaggtctagctttcgcaagggtcaccttttaccaccgaagagaaacttgcgactagatagcactctttctgtctaccgcgttagaattatcaaagcacaaaagtgacaattttatcttcatagataataattaccttttctttgtttgttccggcaattcccttccattattaccaataaacagactttcatttgctgtttttgctcggatgaccattctttgacggtgaccagttgcctttgtttccctttttgagttagaaattagaaatgctttcttgttgtatcaacctccggtcatgagaaaagtttaaccgtagaatctgttaatgactttatagaataatctccaaagcggagtgcctttataaccatccgtgatagtttagtggtagaaccaccgcttgtcgcgcggtagaccggggttcaattccccgtcgcggagttttgtttttgtcaactaacttaaaagaccaagttaaaagtaaggcattgatcaattttttgaaatgtgcgtagttcgcaaaagcatcgatgtgactcaaaagaggctaatgggaatgagatgactacttaaaaacgtttaagcttggacactcgactgggattggtacgggtttgcctgctttttaaattacccttaaccttgcccttcttttcatcattcaaaaatgagcttggttatgatatagcctgacatctttttgatttgaatggtcgcagacattccgttttgtgggtcttagtagctagtagctgttaatcaaatttgaatctcactatattgccccagaataatccttacccaaacaagagaggacttgtgcagtgtattatgtacatactatcttcaaagatatttaattatgattacacacattcgcaatcatagatcttgcagtttcacaaattggttctgctgaaacgaagctaacgatgtcattgacgagtatctattgttagcttgcctgatgtttctgagttgcaattcaagaggactcaatttagttcttttcaaaacagattgaatgcccctactctcttgatttacgttctccgaggggttttgtttggctaagtagccccttttgttggaggaagagtaaaatactatgtccctcctcgaaatcggccttgcacagaggggaagatagcctttgcttttgataaaccatgaaggagcgtggtgagctttgtaactgagcttgccatagtacctagaaacaaaggaaccattgtttctctctatggctctaattgcaggatttgaggctttggtagcttcaacattaagagggaaatcaaatttttctttaccgtttcccaatattgtgacaccatctttcattggtccagatatcaacccacattgtttcatttttttaatcgttagcgtctcatcgatatcaagtagtccccgtctgtaccaatcaacgattttaactaacttcaactcattcaaatccaaacgattgaaacggataaaaccacgcttagggaacagcttatatattggtgtttgtccaccttcaaaccaaggtttgatattctcacgagctttttggcccttttgacctcttccagaagttttacctaggccgctgcccggacctcgtcctactcttttttgagactttgaagaaccttcactaggatggagattgctaaggagtgactgaaaccttttctgactgtatcgaaacaatcttgcatcagtgaacacaggcataatcctaaacgctgtatgtgacaaaagcttgaaaacgaaaaatgctggtgccggaaaatagtgagactctgattgtaacacgaccaccaatattatcaccgactttcaaaagtttgcaagcctatatatcgcagacagctgaaacaatgcgttccttatcgaaaagcgtataggaaattgggatttggccaagtggagaatctgtttcatagcatcgactttccatgattgcagaaacttcatttgcctgcaatcgatctaggtcaggttttttttttcttctttctatctcttctcatattaattaatatgcctcctatttccattctcaccaacaatagcaatggtaacgttgattaaatggtgacaaacatagcgcgtcgcatataacgacactaattgtcatttgtgccaagcagggagtacaagcatgcttaaactactcaccatctaactttgttcttgtatgaagtctttgaaagcgtcttgtctgtacagctaagtctttccatcaattgattgctacttctttactacaggtgaacaatcccgacactacgtatagatccaagttcagggtcgataaattcaatcagacaaaagcgaataacaagtgaaattcatgaattatctgcaaaaattcatctatggtctaggtggatagaagaattgcgtcaaatgaatatctccagcgattcaaaagtgcaataacctattctcaagtgaagtcactggttccaggtgacagtcgctagtcaagatgaatactatttcctttgattaatcagcatagagacccaactcctgaaagagccggcaaacttgaaaatcaccttgttacacttttcaaagtatttaaaacatgaccagtaaaaatgaatttttgtgaagagacagatatttgcgtaggccaattcgaaacatgaattatgaaaaaagaagattatacgactgtttactaaaaatacagcagtttgcaaaaacatataattagaacattttccataataaacaccttctctttgaactaaagctgaagtttgatcattcctttgaatgaaagtactcgtaaattacattaagttcaaatcaatctaggcgttctagtgttcactcaagcgcgcacatagtggatattgcgtttgtttactaatttgaacaaaagctaaggtatactactgtgcacaccacgttcaccatgcctatgacacctaatggccgtaaacgacgtagattgataactacagagaacgactctgttgcagaatttgagcttcactattttgacaaggaaaataataatggaaataaagaagatatgagatcccgcttgatgaaaactaaaattaaagttcccctatctacgactcttgagaatgctcacatgctccacaataatgcccacaggattggatcggggttgtttgagagatttagacaggctgaaatactaaatgaggacggtaatattaaaggtattgaagagcctgtactaccaagaggcaccgagtacacgtacgacgaccattgcccaatgaaatatcaggaaaaaggcgaagagcaagaagaagaagaggaaaaagggcgagagaagggagaaaataaagaaaagggagaagagggaggaaaacgaaaagagaacgagggaaaaagagacgccaaaaatatgcaagcttcctcaggattaccagttttgccccgaagcgaagacgatcaaggagaaccccgacttggtttctccaatgatgttgaccaagattttgatatcggagtaaatgaaagaaatgcaattcttgaactacctcagtcaccaagtgctgagctggttcaaccgttatcaggtgagctgccagcattagaatattctgaaaaaaaggggtcaactccaagacttgttatcgataaactagtattaacaaacttcaaatcttacgcgggaaagcaaactattggaccttttaacccttctttcagtgcaatagttggtcctaatggaagcgggaagtcaaatgtgattgacgcattgcttttcgtctttggatttagggccaccaaaatgcgacagagtaaaatcaaggaactcattcacaactcagaggaatttcctaatttagattcatgctctgtcgatgttttgttccataatgttaatgatgaatctgatggttcatgttcgagtctaaaaaatagtgaactgacagttagtagacaggcttttagaaataattcctcaaagtacttcattaatgggaaagagagttcgtactcgagtgtcacagagctgcttaaatcgaaagatattgatctaacacataaaagatttttaattttgcagggtgaagtcgaatccattgcacagatgaaacccaaagcagagaaagaaaacgatgatggcttactagaatatctcgaggacatcatcggtacgactaattataaacttgaaattgaaaaactaatgaaacttatcgaggacctcaatgagatctgcattcaaaaggaggaacgctttgaattggtggagagagacaaaaaggctttggaaagcaaaaaagaagcctgctttgaatttttgagaaaggagaaactacttgtttccaaaaagaacaccatgtttcaggcagtggtgatgagtgatggaagaaaaatcaatgagcttcagactgtggtggacgaactaaatgagtcattggaactagaaaggtcacagaatcaaactgttatgaacgagattcaagatttggagactgaaagcaaaaagctcgttcgacatgcagatgatctgaatcagcagcgcatagctcttacaaagagagaaaaacaaatccagaaagaaaccgtatctgttcatgagaaattgatccatcttgaaaaaaccaagcaaaaatcagaagatattattgtctctaataaatctcaacaaaaacatcacacagatttgatttgtgatttggagcttctaatgtcagaaaacgatcgtaggttgaaagaactgactaattctttaatgaacaagaaggacgaagttcaggcaataaaagtatcattagcagacaaaacgaaagactgcaacattcagctggagattctcgcaaacaaacttgaaccttttaagatcagaaatgacgcgaaggaaaaggaaataaaggttgtggaatctaagatagagatactaaagaaaagcaaactcgcagcattagaggagatttcggattcacaaaagcacatacaagacttggagactaaatatgcagaacttttagccagcttgcaagaaaagaatgagaaattgcgagaaatctctctagaattggtccaaggagaagcgcaggtaaacaaatatgatgaagctcttaagaaaatcaaaacttctcttaatgagaaacaaaatctatatctagaggcgaagtcgacactaaatgaacaatccagtgaaaatacagtgctttgcaagctaatgaacttacgaaagcaagggatattgaaaggcttccatggacgtttgggagacctcggcgaaattgactcgaagtacgatatcgccatctccacagctgcaactttgaatgatcttgttgttgaggacgtagaaactgctcagcttgcgatcgagtacctaagaaaacataaattaggttttgctcgttttattgtcctcaataagttgaagagcaatatgaaatccattgacactccttacaatgtgcccaggctgttcgatcttattagggcaaaagactcgaggtttctaccagctttctacagcgttttgcgggatactttggtggtaagctcgatagagcaagctaataatatttttgcaagtaagagatctcggattataactttgaaaggagaactggttgaaatgtcaggcactctcacaggtggtggtaggcacatcaggagtggtggcatgaaggtttcaaagagtgtgagctacgatgaagtaagacaactagaggcagaatatttgactaaggagcaagcatataagaaagctgaagagcacttcctcaaaatgcagaatctactaagtgattttaggcagaagctacctagtcttgaaggtgagatcaaggaactcaaagtggaaactgaaattgtaaagaatgaattgcagaatgttcaacagaatcatgaaaatcttgtgagaaggagcaatattactgttcctaaagttgagatggaaattctggcggagggtcatacacgagagaccctcctggatgaatttaaaaaccttaagtccatgtctgcttctttggagaaccaaataaaggagattgagagcagaatcctcgaaattggaggattagagttgcaacaaaaacatagccaagtcgaatcaattattgaacagattgaagctatacatgagcaaaattcatcttcgaaacttaaaacgaaacgactagagaatgaaaattctagatttgataaatctgttagacaacatacagaaatgattcaaaagtgcaaattggagattatggatgtaaataaaagtgctggttcaagtaaggaattgctcaatctacttcgtaatgatatcgatgagctgaatactttgtccaatgacaatagtactaagttagaacagattgaaattgatctggaacacagaagaaacaaagtcacaaaatttagatcgaccgaagtcgagttgcagaatagtattgaaaagcatggatcaataatcaaggcaactaaaagaagggtagaggagttgagaaaaacgcatagctgcatcaaacttagagatgtttccgaacttttatcatggatggaacccggagaaacaaaggatgacctaatccaggatgaagctatcctaaaggaactttctcctgaagaactgaagaatgtagatttagatcaagtaaggcatgatcttcatgcccttgaggagttcatggtatccagtaaagttgacgtcgaggtgctcttagattatgcaaagcgttatcgtgagtctcaagataggaaagcagacctaaattcctccgtcttgaaacgtgattctttgaaaatcaagtgcgaagaactaaagatcaagaggctggacgaatttatgttgggatttaataccatttccattactcttaaagaaatgtatcagctgataaccatgggaggaaatgccgagctcgagttagtggactctttagatccttttagtgagggtattttattcagcgtgatgcctcctaagaaatcttggaaaaacatatctaacttatcaggcggtgagaagactctttcatcattagctttggttttcgctttacatcgatacaagcctacgccattgtatgtaatggatgaaatagatgctgccttagattttcgaaatgtgagcattgtcgccaactacatcaaggagcgtactaaaaatgctcagtttattgttatttcattgagaaataacatgtttgagttatcaaagcaattggttggaatctacaaggtgaataatatgacaaggagcatcagtctacagaatatagatattgtccactagtgtcaaggctttataaaagccctttttgttgctattggctgtttaacatagttacgtgtttacgcccaattgcctcgggtatccccgatctcactgtaattagtgcttctgcttttttcgtcttttcgacttccttcaatcgttacattcccttcatcgtcatcgtcttcatcgtcttcatcgtcttcatcgtcttcatcgtcttcatcgtcttcatcgtcttcatcgtcttcatcctcttccgcctgctcctcctcttcttcttcatcatcatcaccatcatctcgatcataatcaccgtcatcatcatcatttccactattttcattggagctgcttgcactataatcttcaacgctatcgctgctgaaaaattcatccaaagttttaatctttaacgactttgacgattgtaatttgttttgacgactgaactgaggttgaccggaaccaactgtaaaagaattatggctctccaatgcaggttcattcgtgttggatttattatactcgtttgatagccagctggtgttctgcgagtaattcttgatgtcaagatcaagactacgcttttccgtaaatcgggctaactcgtttgcggacaagacattccattcaaccattttaagatagtccagtatcaatttggatatcaacctttcacacttcttggtgcttatctttggtggctttttgaaaacttggaaaactaatactccgatctcgattcttcgtagcttccgggtcaaggagatatgttgcgtttcaatgagccgctctaaattcacaattttcacactgttttcctcatcaataactaagtttggtaataaagagcttataaatcgtgccctgtctctaatatccaccgatttgtcatacttgcagtagttcaaaactagattaaagcacttgaatagaggagaattgaaactgaaatcggagttgttgttgttgctggttttaaagttgtaaatatcctttgccaataattttgctgccaggtacaaaatgttcagtttaacttcaggaccctcagagggaaaattttgaagcatgatccttaaaatatcaacaataaaactagtgtcaacatgaggattggacagattagcaaattctcccagaagccagataatggatccctttgttggcccctcaaccttatgctcaattagtttggcgacaagaattccaagggtcctctcattagaaatcaagttttcctggatgaatagtctaattccattgaaatattccggtaaaagagaaggttgtatacactggtcaagcttactcaaataccaactcaaaatggtagatatttggctctcaaacaggtgtgggctactgtagagttcattgacaagtttcagaatctcaactttcgattcatcctcaacatagctggactcatgtagatagtactttaactcgttaaaaataggtccaaaagtgtcagcattcagaagttgcaccaaaatcgctacttttagatgaatagttcggctatcatcactgggaagaacaaaaaattctttaatatgggaagagaacaagctgggctcgtacattgtgaaaactaaaattagctgcagaacatagggtttcaggcctgatggctcaactaacgaaaccatgtttaatagcatcgcatctatcttgtacgtctttatagttgtagcacatgagagacacaaaaaacttttagccacagaaaaaagaacacatgagtctaatgaatgaattaaatttttttgggcatctaagaagagaattaaatctgggtcataatgcacatcagtggatgaatccacatttgaacatttatgtggatagcagtcaaaatatattttctcattatcatccaagactacatgagtcttttggagaaattttcggctgtaaattgtcagtagttgaatagctaaggattgggcaactggttccaaagctgttaaattggaacaaatatgcctgaagactttatgtagcagtttgtatccatgaggaaatagctcatgaaacgctatcaaagctgtaccaatgaccatgggatcggaatcggctaaaagtttactcaaaaatgtgtagagctgtgttgtgatcgagtcgttatctgcttcttgtatcacatgctcgtcatcctccgcctgatacagactagaaccgtttaaaacatggcatttcctgatcgcaatggctgaggaagctcttacaagagcactgacatcaacaattgtttttttcaaacttagtatcaaaataggaacaatcgcttttatttgtaccccacccaaaacccgtatcgcaagacttcgaatcactggatctctatcagccagggacttttggatagcattgattgaaagaagggcaatatcaggttgcttatggttgtatcgaagcaaaaagataaatacaagcttctttattgtcaagtttggagagttgattcctttcagtacgtggggaaagtatactaacacttcgtcatcccgaacagactcggtagacatcagtttcatgatgtacttgagcgcaatgagcttactcccttcacgtgtagaatttaatttgtggatgatctcttcagtcgaaagtggcttttgatcgataccagcgtcaacaaatgaggtattaaatgcggagaggctatttgcattcaatatctcttttagagcagatgaatcaaaattaccactatttccagctgattgacgaagaacctgactcaggcctttggctgattccaaaagtgagctgaagttctttgataaatctgacatacggatgaatgtactgttaaatcgcagtcaaagttcatgggcgagcaagcgcgccattagaaggtgcgaaaaggaaggctgtcaatgagccttgactaactaaatccattaaaaccgttgttttgaatgttttatatactgacctagaatacgttgctttctaagcaaaagggttgatacaacgaacagtcagacaaggcaatgccataccaatctcagctctcaatagaacagggacagagtgaagctctcggatctcctgaatattattttcttcctctgttcgggtgatacaagcctcgagatatggggctagaggattgtcatcatttccacgataagagtcagaaaccgaatcctcctctgtaccataagctgaaaaactggtgactgggaatgtaaaagatccattgtgggggtccaacgaagatttcttactatcttcattactactgataatcattttcttggattgattcctagccgcatctgcagttgaagaacggtagctatttttaattgaagctctgtaagaaaggggttcattttcatcttcggggataaacgtggcagaatccacgcccttttcccagtaaagctccaatacacgtttgtccttatcgaattctgcctttattagaggtagttggtccccatgaacccgtttctctatgccaaactctggtaagaatacatcgaaagcactctcatatacctggacaactatccccatgctcaggatctgtccgctttcttcactcatggattttattgtttgggaaagcaacaagtgaattgcttgctcttgagcagcttttgcacagtcttttttgaaattacagtagtcagcattcatctttaagtaatgtggatctaggtccttcgcaaaaggatgctgtgatccaactaaattaggatcacattctttggccaaagcaaatttcagttgcctatgaactataaggtctgagtatcttctggaaggtgctgtaaaatgtgtatacaaaggcaaattatgcaaataatgagagtagttttcagggtcagttttcccggcaataaagtacttacctcttggcatacacttgtgaagaattgtttccgccactttacgtgtgttttcatccttaatctgtagcagagaatcttgaagagttcctccatcagtggtattcaattttatggatagattattgacctttttgacataagtttccaacttttggagggtaggatgcggctgccttctcaaaaaagccacttctccaagcaaactgaaaattctatgcgcaacaacagaattaactttatgaaagatttcattgatcatagcttccgcaggaattggatcataaatattgagtgataatttcactcgttcgtcgtctagctggtccattaacgtcaaaaccggtccattctccaaaatagggtcatgtaatcttttccgtctaaactcacgagcaatgaagtaaaaagtcttgatgtaatcagtagttgcatttgcactagtagtctcgtcgttcagtatcagatctatagcagagtaagaaattagttgtttaggtatcacaactgaaggaccaatccaaacatcatccacttcaaaagtcaaagtattaatcttgaatacaaccgaaatagccagattctttgagttttctttcattgaaattgcatcattaacaattttagggtataggtgagtttctctttgtggtaaaaaaactgaatgagacctcttcttagctttcttatccaagttggagccaggtttaacgtagtgtgatatgtcagaaatatgaattccaaattctattgtcgtatcttcaagcctcttgacatgcaaagcatgatcataacaagcaccagttggagatgcagcgattatgtattgatcttcaaaaatctttcttgactcctcaaggttaacggtagatgtgatgtctgatataaactcatccggattgtcatattcatcacaaagaaaattattatctcgcaaaatagcatcaacttccgtattatcatcattcatattacccaactcagatatgagtgtaccaaagggatgcagagatgtgataggccatcttttgatagatgcaacaaacagcttctcaacgtaactatcgtgattatcaacaaagtccttcggcgcctgttctgtaggtatggctattaaaggaaccttcttgtccgttggcttgaaccaaactatctttggcttcacattaatgtccttgttaagattagaagcctgagagggcctcaagagaccaagtgtacccgaaaataactgaccgggaatacgatcaataacggcaacaacatggccagcataaagaggtttatattcatcattgatttcctcttcctcaacaagtagtaaagattgaccctcaacttctaaatcgtcattcttcttttgtgttggtctttgcttaagagagcctcttctttgtaagccattatccaaaacttggtaatcaccagtctcattggacactgaagaataactattggtagaagcatcgttgtggatatcagcattattggagttgcgacttcttggtctgtcctttctccttttcttttcttccttttcccgcttcgcattccagacttcgtcaaccgcgagtaactcaacagccaccaaatcaccctccagtgctctgttacgatcctttgaaccacaaataaaaatatcagcgtccaatagtccatccgtagacacataagcatcagatcggtttttcttattaacacggagaattccggcaaccagccttccctcatttaaaagatcgggtaaagatgcctgggtcaagtagggtgcaaacaaagattttctatttccaccattattaacattagtaaagttcgtaattgaagaaatggagttactgttgagggaggatttagaacggtgaccgggaaaaaatgcttgaggatcagaagaaagcgagctggtactagtgtgcttccgccaggagctgttgttgcttccagaatggcgtctgctgtgtgaaggagaagaatcatatgcaaaggatggaactggagggcttaagttggtcttatctcgaggtgggaactgaaaagagtgttgcggagaacgagatctttcacatgaaggaacagcggatttagatctcgtatgagatggttttctctcaacggtatcctgaggcttcaaagtgggggaagctgggaatttgaaagccggtgcgggagtagccgtagaggatgagattgacaactttgaaggtgatctctgttgttgagcaatagccgcttgttttttcgcctcgtcaagtcctaaggagtgtctcctggagtgtccaagcgttctagaattggaggggcttcttctatggttataatcctgattgctgctacttgaaggaggatatccatgagtcacggcagagttgctcttgggtttttgaggggataaatattgctgttgttgctgttgcaatatttgttgttgttgatgttgaacagcttccaattgacactgaaggttgaactgttcgactgttggggttgttagtacgagaagctaagcctaaaacaagaaaataagtgaacacatgtgatgatcacaaattttcagtgtaaaaagaataataacttacccataagcgaagtcaactcacttggggatcgtctatgcgcaatgtgcaatattttcggcttgttgcctttagtagcagttgtggttatcaccttgttggattgaactccagaatcgttcgactcagcggtagttataattgacggcatttcggcttcgttagaacgggagttagaggaggagctcatattggcgttaatcaattatcaaggtggttaggtgaatcttgaaaggatcagatggcaaaaaagcaacaacggaaaaaaaagtctcaaaggtggtgtagtaagaagcaataaatgaattcaagcggtaaaatcaaaaaagtgaaagtcacaaaagatcaactcgtcttaccttctcttagaaagaccagcaacttttaactatcaaccttataaggaaggaaggcgaagatcctgatttaatcgaatggaccattactgtgttgtcgcgcacacgacctaaatactacctaaacaggggaatagtaaggaccgggttcagttgactactgtttgcttgtgagttgagcaagtttattatacgaggagggtgtagcttaaaaacattaattgcagatgctttgaaaacggttgaaagaggccatgttcagttttttttttctttgaatactgttatgggaacctcgtgttagaatgatctttggcattgctcattgtcacatagttacagtgaccgtgaaaattgatatttgttcctctagaggttcgacttcttagaatgttaatcctcgttcagtgttttcagaggttaaaaagagaattaaggaagggcaagattgttggaacattggtagttacagctgctaacaactgctaacgaacatcgtaagtgaggcaggtcttgctccatatggggtcgattgccgaagagagaaggtatatacatttatctatctactactgcttcaattggactcgacgtatttgttgacatatgataagacatctaaaacgcaacgacaagcttttttcttttttgtattgacaaaatgggtcttacttatttttcaagttcggtcgtttatctagtaaagttttagcttcgttgatcttggtagctaaaaatggagagcctcctttatctggatggtttagcaacattatacggcggtgactctctttcagtttgggtctagtcagtgtactctccctaagattcaaaattctcaaagcctctttgtcgtccattttacgttggaatccgcctttgaaaaaactcttgcctccaactccgggctgctttgacttgaaaatacctgcaatgacatacgtaaatgccagtccaccaagggtgcatattactggatgttgagcgacgtaatcagaagctgtattgaagtaatattcactgtctttacgtttgcttcctgagttagcttctaatggatttactagtgtttgattagacatcctaggtccttataagaagaaagataaaaactaatgagtgcggaaagattgaaatttcgtggagcaaaagttatcgaaatgtagacaaacgacgaaagccataacattgcacggaatttactacctccataaatctaactacattcttcattgacttccagaaaccagcagcttgtttttacggcaaagagaacaagtgtagtgtttgtttttaacacctacaaagtgaacaatacttggcggactcactttcctactttgtcagttcatgtcaccgcaagatgctggttggtcaaaagaaaaaaaaaaaactacgaaagatcgatccgggtaacctcatcatgaaaaatttaacatagaaagaggtagaaattttatcaactaccatcttccagaatacaacaacgctatgagaatttatagttgtcatttctgctcatcacctgtctatcctggacatggaataatgtttgtgcgtaatgatgctaaggagtttcggttttgtcgttcgaagtgccacaagttgttcaagcaacgtcgaaatccaagaaaactcaaatggaccaaagcctttagaaaagctgctggtaaagaattggcggtggactctactctcacatttgcaacaaaaaggaatattccagttagatacaatagggaattggtcgcaacaacgctgaaggcaatggctaggattgaacagatcagacagaaaagagaacgagcattctacaagaacagaatgaaaggaaacaaagacaaagagttatcactggataggaaacttgtagagaataatgcggtacttcttagaatgagagaagttgaacttcgtacgaaggaggaaaagcgtgtccaaaaactgcaaaaggcgcagaatgcacaagatgaaatggacatctctacggactctgaagcggaatttagtgagcaagaggagtcaagtgaagaggagggagctcaaaaaatagtcttgaccaacaagaaaaagctcagacaaaaggcatgaccctttttcctgacggtgtgtatagcaaaatttttaggatatgtatcacttatagatttataggttgatttgatggtgtctcagttggctctgaccttgccgttaaaggaagctttttgaaaactccaacgaaacctccgcctgagatctttgtgcctactctgggcctacaaacaaccccttctttgttggtattccgaatgtctgaaactcgaacgtcccattctcttagagacccacctgaagtacaaggctcaaattcaatacatctggagaaagctagtttgattgacctatcatggtgaaccgtttgtactgcgttcaatatttgagtgacagaggggcaaaaaataatcaaggcatggtcgacttttagatggatcgacaagtctttaaattgggcctctggatcaggcatatctagaaatatgccactaagaaaacttgaggaatggtcatagacagggtcattattcttcgaactattcttgatccattcttttgttgaaggtgactgcagccaatggatgggagaatctgccaagcaaaattgaacatcatcctcatacattcctctttgataatttttgaggtttttttgccctgtagctaaatgattcgggttcttatcaatactatggagaaccgctcctagtagccgtgaagaccctagcccgttcaaattcttgtaacagtttcccagaatggatggatttggcaattgccaacgtaagcgatccatgacccgttccacactccaagaactggagaggttcgtccttcaaacagtactctccattttgttttctttccaattcggggtaatccacatttaaatcggcgagttgaacaattgtagctgcgttaaaaggatagattggttgagcatcccgttttgtaaggttgacgtattcttccaaactaggcttatagcacatgaatttaaattgaccttttgaagtctcaaaaactttgcatcgactacgcgttccaattatgtcatcatgggaaatgcttccactcttgactccctgaaagttccctggtttcaagggtttcgacaaccacaccttatctggacgcgtaacttgtcgcaatattgcaatatctcctacttgaaaaacggagtacttacgagcaaacatgcgaaggtgcgaagaacgctttaaaggtccaaggatagtgattgatgcattgtaaatcgaagcatccggagaagaactgaggtaatggttatcgcgcactttatctggaagtactgaagtattagtattattcatcacttcactaccaagtcttatcatatgcataaactaaacaacaatagtaaaatctgaaatcacctatttcatccgagaatgtcacaaatcatcacggatataaaccaactagaattgctatcagcttcacctcgttttccgacgagagttcggataatagcagtcatcaccagatatacaacgaacggtcttctctatttccacccagcttttaaaacggaagaacaggaagtcttcgttaaaattgataccccaacattagctgcccttccccacgaatgtgtaaggaaaggcacctacgttaatatcgatgcatactacaaaggcgatcaaaaggaactacagtgtattgccgttgaaccgctactggatccacagacgcttaatgaaattaacactgttcagattctaaatcatatttcttccttgaacgaactgtcattcgtgatatgacttcagatacattgagtaacaaacgttagggtggtgttgcgaaaaactgttcccaaatgaactctgagggaacttgtgagatcatcttatacatcgctccggaatctgcctggtcctgacattccgtataaaacgtctcactatcgagggcaagcacgtcttcaggtgtccctggaaatgataagaatgcaactggagatgagtcttttttgttcaaacaatcgattggtgttgcacaattttcagttttgggctccagattctgtgaagcgaaatttgaagacaaactacttgaggaggcttcatacaggtgctgaaaaaatctattgaggtcaatttcatcagtaaaccattcgaattgcgacgactgaaactgtggaattagtcctgagttcaaacgatcataaaaggtattagatatgcgcggagctccctcccatattttcagttcgtcaagcacagatgttccttgttgcattttcattatatgtttagtaaatcgtagccgtatggctgcagccgtcagaatctcaaaaattttgaggcatggaagagccgcatcacaacttgcacgcaacgagttaagaatatgggcacagtcttgtgaaatttgttggatttcctccagggaagttttggaacatacttctgacgaatgatatagggcgtataagaaagatacaccgcccatgaataagttgtgcaccccggcccatgtatagttaattgtcctactatcaagaagttccttatagcattcaatgattcctcttgatgatttaaatatttgaaagtaatcatttacagcaaactttgagttcaacatcgagaagccatataacgctagcatagtatgatggtagttaagggtgaaaaagacaaccttgaagtcgcagttcattcttcgttgagtcttgggcacgatctttttccaattttctaacctcgtatgaacatcatctttccattcttgcaaagtgggaaactttctaggaagttctgctttataatacaagatttcttgaatctccgcttgcagttttcttacttgaatgatggccagcgagacggatttgtaactggaaagtccgctggcactcttagaatactcttcaactgaagattcttgtacaatcaatgcatcgtcgagctcagagaaaagttcagttgaaatgctggattcagggataccaaatggccttcccaaataaaagcatatctgtctatccagcgagtatacgcaccagaaaagccgtcgtctcatgtccatggtgaagacatcaaattcatcgtttttcaagtagttttcgttatgtagaccaagttcagatgacagtcgaagagcgcttcctaacacataccatacacccggagttgcaggtctcattagtgaataaatggtaagcagtaaaagtccttggagtgattctaatcgatcagaactgccgtagacatgatcaatgtgaaacagtgcacttgttttaaatttagcagaggtttcacttttatactgtaaaagatgtactgaagatgcaatagcaaatactatattaagaaaatatagcgctttcctaactctctggggtggctgaatcgtttcagccacttcttcgggagaaatttcaccacttgtttcctttaactttgtttgcaactgctttttatactcactataccaagtttgagtaggagggatcctgctgtctacaactttttgattaattgaagtatatttggaagcaagattgacattgggagatagagatccgtataccggctcaaaatatctaatcacaaactgttctctgtgtagtattggtaactgcgaattagattgtgcaaaatatatttcgagaaacctttctgcatcttctttcgttggcaaaagagttggatcaacttctgaatccctacgttttgatccgctggcacaagggttcattgctattgagtgggcagtttcttttgtgtcggattgaagacttacagcagttcgcatcaaactgccaaaagatattccagttgtttcttttatactcccattgacagctgtgcctgcggtagatgtcggtatttggagcttaggcacttcctcattcgtagaattacactgaggttgcttatcattagaacttgtcaatggttggtcgttttcatttaatccggagggttcttggttgatagttgtcggttcaatgccggcagaccttaattgggtttccaggacttttacccgctcttctaaatacacgatataggatcttggaatatttcgacctgtggcaggatcgacaccgatacattcagcaccgaacctggcacatcgtccacatttgggaaacttttgatcacacttagttttttttattcggcatcgcttacaagtgactattgttctagttacacctagtggcccagctgaatgctcactggaattgttttcattcatttcggttctccttttccttgacatttcaatttagttgacttaaagataggcaaatgattgcagttttaaagaagcaaaatcgcgcatgataagtcccgattgattgagagagctgattgtttaccatacaaacatacaaacaattaaaacagtatttgctaattacaatgactaatcaaagttagagggatacttgtagtccttgagttcgtagaaattctccttgacattacgaacggagacaaaacgagaaaggatattggctgagccagccttgtcgttagtaccactcattctagcaccaccgaaccattgctgaccaacaactgcaccagtggacttgtcgttaatataaaagtttccggcagcataacgaagagtttcctctgcttccacaatagcattgcgatcgcgggcaaaaattgagcctgtcagtccgtacttggtcgaagaatcaatcttatgcaaaatagctgagaattcagcttcaggataaacataagctgttactataggtccaaaaaattctgtttttaagtattcatgatccgcatttgaggttcttaatagtgttggctggacaaaaaatccgatactgtcgctatgcttaccgccagaaacgatttccaattcaggatcagttacggcgtcttcaatcacctttgagagtttgtcataagactgctggtgaatgacggggcccacaaacccgtggaagccgctggatgatgaaatgttagtctgttggatctgattcatgttgtcgctcaatattgccttgaattgttcccatttactctcagggataaagactcgagacgtggcagagcatttctgtccttgatattcgaatgatcccctaagtgttgataaagctgcatgttcaatgttggcacttgggtgaatgatatggaaattttttcccccagtttctcccactaatcttgggaactccctatagatatccttattaacattgaaagaaatttttgagtaaagagatttgaacacattggtcgacccggtgaagtgtagtgcagaaaaacaagggtcgtccaaaacttcatccgtaactaattttggttctccaggaacaaagtttattacccccgcgggtagtcctgcttcttcaagcacttccagaagtacataattggaaagaatagctgaggcggaaggcttccacaccacagtatttcccattaatgctggagcgcctatcaaattggcagcaatggcagtgaagttgaatggcgttacggcatatacaaatccttccaacggtctatattcagctctgttccaaacacctggtgcactttctaatggttgctgcgaatataattctgaggcatatgttacattgaatttgaagaaatcaattaattctgccaccgcatcaatctcagcttgaaatacattttttccctgccccagcatagtagctgcaagcattttatatctgtactttgtcgatattagatcggcggctttcaagaagactgcagatctttcatgcagaggcatggacatccacttattcttagcatccttggcagctatgattgcaccttgcacatcatctttcgttgcttgtcgagtgtttgccaacacctgtttcttgttacttggattaacctgaggaacaatttctctgtcatatatcttctgacctccaattactagaggaacatcaataggtccattatctgtaagttgaaggataccttctttgagatagtcccattccagtgatcctttgctgaattcaagggtcggttcgttcttgataggtgggggcttgaaactagctaattgactgaagttcacaaagtttttgactcttgatatagaagtagagctttgtggactcaacggtagcagtgttcgacgtaagaccgagattcttgcaactgcaggtgagctaaacattgaggaatggatgaaagtaggaaagaagtagaattaagactaatgaatttataggatatatctccactcaccaactagttatcgtgagaggtatagtgaagcgagcaatcgcttcagttctccaaaagtcacctcgatgtctctcgctagaacattccaatatcattctggcgcaccgacccaccgaaccgacaaagctattcatacacgatcgcctggtcccacacagagtaaagtgggggtgaaagtttatccaggagaatgccaacccgaggaaacaaagtgtctttccaaatttggatcgctaggatacgaacactatatattagagaggatggtaggaaaaaccaacctcttaaaaactctggactttaaatgttaaaagctaattgaagaagccattattttactgcttttctcgtttcttggatataagccgcaaagccagctctaattcaacattttagatttgtttcggcctatgaggtttcgcccaaagcaggttcagttcttgatgtaagaaaaaagacatcaagattagttaaatttatagactatgtacactaaaactctatttcttacctttcttgttgtgttcttcgatcagctgcctttgcaattgaggcggacatggctggtattctttgaactccatagagaactcacccttaccttgggtgactgcacgaagagaagaagcaaacccgaaaagttcattcaacgaacaatccgctgtcaccgtaaactcttcagctgaattctcagtatcctgaataatggcctgaagcttgttcagtaaactgataatagagccttgaaactctgcaggggctgtgacagccgtgttcatgattggctccagaatgactgggttgctgttttggaaggcttgtttaaaagcagcttgggttgccgtcttgaaagacatttcattagaatcaaccacgtgtgtagcaccgtcgttgattagcatattcactcctatgaccctgtgaccaatcaaaggtcccttttcacaggcctcttcgaaccctcgggcgcacgcttgcaaaaacttttcagagattcttcctccaacaaccttggtttcaaatacatttcttggttgtgtttcagcagtcatttcaccaataactcgagcaaattgaccagcaccacctgattgtttcttgtgcgtgtagtcaaatgaagaagatccttgtatagactctcgataagacacttgaggccttcctgtcgagcattcaacgttatactctctcttcattctttccacataaatttccaggtgcaactcacccatacctgatatgatagtctccttagattcagagtcaaatttcacacgaaaagttggatcctctttttgaaatctattcattgctttggaaaagtttgctacatctttagtctttggcgaaattgaaagcgacacaacagcatctggaacatacatagaactcatagcgtactttaatgagccatcggtgaaagtgtcacctgatgcacagtctataccaaatgtggcgcaaatttcaccagcaccaatagaatctacatcttccatgtcatcggcatgcattcgcacaagacgagcaactttaatcttctttccatccttcacattgctaatatacccaccctttttaagttttccttgatacacacgaaggtaggttagctgcccatactttccctcctccagtttgaaagccaagcctacgaaaggctctttggaagatggtactagattcactttcatttcattgttggaaatatctaaaccagtattcaaaacttcagcggggttaggcaaataatcaacgacagcatccaaaaccggctgaattcccgtattagccaaggctgaacccatgagaaccggagtgaactttcttgaaattgttgaacgacgaattgcattcttgatctgctcgacagtgggatcaacttcctcaataaaacattcagcaatctcatcatctacgtctgccaatgtctcaatcaatattttacgcttttcctctaccaaatttttcaactcaggagggatgtcagacacccttagagtctcaccttgatttccttcattatagagggccaggcgatcaattatattaaccacacctttcaaatctttttcgtttcctatagggacttgaatagctgctgcagggatttttagctttgaattaatttggtcaatagctttgaaagggtctgcacccatgcgatccattttgttaataaatgttattcgaggaatatcataacggcgcatctgacgatctacagtaacagtttgtgattgtacaccagcaacagcacatacaaccaacactgcgccatcaagaaccctcagcgctctttcaacttcaatagtaaagtcaatgtggccaggagtgtcaattaaattaaaatggtagttcttgtcttctttctgccagttgcaataagttgcagctgactgtatcgtaatacctttttccctttccaattccattgaatccatggttgcaccgactttgtccctgcctctgacctcatgaatcgaattaattcttccagtataaaacaagaccctctcagtgaaggtagtcttaccagagtctatatgggccgaaataccaatgtttctcattcggactaaggactcagtatctgccgatgagatactcttagaaatttcactgagaacaacactatcttcttcataagattttgaaatacgaccacatgtaaaactacgcctgattggcgaatcaaacattttcgtaactacaccaccatagctcgacacaactctacgaacaaacatcataaactaaagtgaaaattttgaatagaaataggacacttggttccttaactagattcgcgggagtagtagatatgatcacgtgatagtataaaagaattctcaagcgagagatatcgcgaactcatgaaggtcttcgaaagtagtgcttgaccctccacatacaataataactacagcatcatcgggttgcaaattcaagcctagatggtccagcttgctgaagtaaattgaggccaaacaagctccacacgctggttcaactatcacattatgatcaaaactaaatttgatgcaacttgtcaccgcctgtttatcagaaacaagaactgatctaatatcataattctgacaatactcaagcgtcttctgaggcacgtacttacatgccaatgaagtagcgacagtatcaaatgtttccaggtgagtcacttgattcttctccatagtcttctgaagagtaggagcgccttcagtttctattcctattacgggaattgtcaatccatttcttaaaagtccttgaacaattccattaaggagacctcctcctcctacactgcatgcaactgctcgcagtttagatatgtttatatctgcatcaataatctcatcaacaatggttgaatgcccctcccagatcacggggttgtcaaaaggatggcaatacacacaattgaaatcatcctcttcttttcgtttgtttaaaagccctcttagatataagtctgcctcttgaatgttgttcccatggagaattaccttagctcccgttgccttgattttttgctgcattattttttttgatatgactggcatcaccacagtacaaggagcgtcgtagagagtacatgcgagagctgttgcatatcctgcatttccaccggaggatgaataaaaatgagggcgttgttcgtatcccagtttctttgcttcgttgacagaatggtgcactaacatacccagtcctcttgatttgaatgagcctgaaggctgtgagcattcgtatttgagaaatactctacagccagccagcctgctgagtgaaactgattccactaatggagttcgtaagtaggggttgatatccgcttgcaagggatgtgcgtaagtcattgcttgatttaaagtgcttcaagctttctttaaggaatcagtagcaaagagaaaagtaattcgagagatatagccatctatatatactacttatagctgctgtagttggcatttataggggcaaggctaaatgttccacaactagtgacagcctcacgatatcaacaaccttatctaaattgcaacgatttatagttggaatatactttggttgatcttcagggactttcagaataggctgagtatgtgttcagtccatgttctgctcttctgtgtgaaacattagctgactacgctttgaagttttggggattgcttcattatcttgttatctggttatcagatttagctaagtgaagtaacagttctcaaaacaattgactccgttttttgagtggagtcagaagcgagtcatttttgtttcacccacacctggtgaattactagaagctaaaagtgcttaagagttgaaaagtttggtttttgcacaatccattttcgcgcaaatttgcgacctgaatctgaactccgaaacacccccactctcattattatgtccctcccacctttcttcgcgaagaggggatgaccgcgaagattggatagagtgtccacttaaataagtgtacagttctgcaacatctttttactgaagataccagaaagtttcccaacctcaactcccttataaaaccatgtaccgattattcaatcgatctgtgataagaccttttgctcagcaaagacgttgcttatcaattcatgagtatcgttctgctgacttgcttcgtgcttatgatgtaccagttcctcgtggaggtgctgccgatagcccagaggaggcatataaaatcgcccagaacttgcattcagatggtctagtaataaaggctcaagcattgactggtggtcgtggaaaaggtcattttgattctggtctacaaggcggtgtcaagttggtttcgactccagaagaagtacgtgacttggcaggccagatgttgcagcacaatctgatcactaaacaatccggcgccgcaggtaaacttgtttccgctgtgtatgttgttgaacgtaaggatgcagttcatgaggcttacttggctattctggtggacagggtttctcagaagcctgcaattgttgtttcatcgcagggtggtatggatatagaaggtgttgctgctaaagatcctagcgctatcaaaactttcccaattgacttgaaaactggtgtcaccgattcattggcggccgaaattgcctccaacctaggtttttctcctgaggcacaggtcaatgcccaagattccattaagaaattgtaccaaatcttcatggagaaagatgctactcagatcgaaattaatccattgtcagaagtctcaggcaatgaagtactttgcatggatgctaagtttggatttgacgattccgcattatttagacattctgatgtggagtcgtggagggaccccacacaggaggacgctgatgaagtggaggctggcaaatggggccttaactttatcaagcttgatggtaatataggttgtctagtaaatggtgctggattggcaatggccacaatggatattatcaaactttatggaggtgaacctgctaactttttagattgcgggggaggtgctactccagagtctattgagaaggcctttcgcttgatcctcacggaagataaagtcaagggaatttttgtcaacatttttggcggtattgttcgttgtgattatgttgcgcagggtctgattgcagccacaaagtcgctcgatttaagtatccctgttgttgtcagacttaatggtaccaatctttctcaagctgaaaaattgattgaagagtcgggtcttaaactgtattctttcaaagatttagatcctgctgctgagaaaattgttgaactaacaaaatgaacgagtacgactgaacttataatagaaaagaaagaagaagaccagattggatatagacgtagaaactaattatgcactgtgttactttgctttagtcattgtcgtagcgcacatataataaccactaattatatgtacagtatcatattgttcttgaaactacatatgaggacccagatttaggtccgagttctcttccgctttcacctcctcccagtcttgggcctctagcttttcggtagtttctatctgggtgctataatagagagctcccaaagtggccaatcctccaaacctgaataccatacccaagctgtcacttttgaaaaacttgaaaactaagctgcttcctaaagaactaataacttggggagcggctacaaaaacattatgaatgcccaatatcacaccaggctcatgctccaccgcctggtatttcttaataatcaaccggtgaggtgtgagctcagttacttccattggttgtaagtcagaagtagcatcaaaatccttgatgtctctgatgcgtcccagctcctcacttatcattgcaaatggcacccataacgcacatccccagggtatccccataagtccaaacataacaatagcctggccagatgttgatatgaacaaagtcgatagagtacaactcataaataccacatgtgatataatccaaatatttgcaattgaacatcgatgtgcaaggttgactctgagatattttatccaagctggagcatgagattcatggatttggctctttctcatatttttcagccgccaatcaactagcaagggcaacaataaatcgaccaacaaagtgatgattccatgggccagcaaggctacactgccgcgtctcacgctatcgtcgagcagggcttgccgttcgttaataggtaatttggccaagtcatcgcttgtatagcccttttcggagagaaatagctccccgacataagtggttgtatagaaaagcatgggaaaatatcctatccaggcaaagaattcagcgacacataccaaacgcacttgtttgggaagtctgttaatactctgaatagtttgtagatagagagatcgcaatactccaaaaaatcctaaagaatcagggtgcaagcccagtctactaagtcgctccattcggcgattcctttcggctatgattccaacatcgatattgggatctctctcactcacactaagacacgacgccagcgtcgctgcaaatagtgtggcagctgcaatagttgctagagtcttgaactgagaattggcaccaaaataccgagtaagatcggtggagcttagccaaaatccaaaaatattgaagagtccaatcatgcgagcagcccaagcattggcaatttgttgctggtctgtatttacagaatccacaataaatgctcttgaggaagcttgaatcacactgatgctaaaatctaacatatacaccccacatgcagcaaatgggatagcagcttgtcgcagtcgtttctctgaaccttcgctgccgtttgaacctccaaatagaaagcctgcaatttctacagtatgggataagaaccataatgaaaaacatgttgcaaggcatcctccgacaataaaaggttttcgacgacccaatgggttcctacaattatcactgtagattccaacaattggttgaccaatagtgccacttagaggtccagcaatccaaatcagggccagcattgctttgcttatgcccagtgataacaagaagggggtaccctcactaaactcagttgcccaagacaactgaagagctccaattatagaagtaagcacggcaatataaagctttgatcttttcggtgttgataccggcacatactgaccgacttccatgtctattatcttatcgtatctactttctttttttgagaatgagttagaatggggactaaactttagaccttttgaagattagataagcacctaagtgtccaaaaacctagtttgaaattcgtagggaacgaccaaatcaacagacttggtgctaagatgttatgttacgcgtcttgtagatttcaacttgcactagccactcaccattgatatcgttgcattgaagatagtatcatatggtagaaaataaccaattctccaagaaacggtctttcagctgtaatcagactacaacaagaaagcgtatacagcagaaacgtatattctctgagactcatatgcgaacagttgcacttttgatggaagcgcagaaacgtttgagcttgcaagcgagccaaaactcaggtgtcactaattcctcaccacttgtggatgaggatcataataatcaacaggttggggttactgaaatatccgaaaatcaacactatactcaaaaaccgtactggcccgacactcgtctgggaaatagacagtacattcaagatgaatccaagtattaatttacgagcgagcttgacctacgttgacatccataagcacatccgttgatctggtatcataattcaattcaatgtcaagtaattaatataccccaatcagtagcccgaataagaatttgttaacgccccttttcccaaacaggtcgtgcgaaaaaacacctggcccgaaacctccataccgagcctccaactttcatcgcccaaactaaagctatcctatcatcaacgaccagtacttctctacggttatcattagcttacagcactatgaccacttacgaaaaaattgtcaaggtaagtacacaaaatttataacgagaagaattggagcccctgggattctttctgtcttaccaccattgaagcttcaaaacaactcatctaacatctcactgaagggtgctacgaaactcaaggtagcagcaccaaaacccaaatatattgagcccatacttttggctacttctagtcggtatgatggaagaaatgatgatttgaaatctgttctgtccgccttggctggtcgcattcaggatccatcctggtcagtagtatacaagtcgctcatcgtattgcatataatgatacgagaaggcgaagaaaatgttactttgaaatacttgagcagacatgtatcaatgttagaacctcgaaaattatcccgagatggacactatggtgccagatcaatagtacagtattcgaaatacctggcagctagggcccgagagttctctaaaactcaggttgattttgttcgggacgaaaaatcatccaatagttccagcagttctaactcagagaaaaaggggggcattttgcgtactctttccgtcgataaaggtctactaagagaagttgaaagtgtgcagcgtcaaattgagagtctattaaaatgtgaatttgcagagagtgaagtcaacaacgacatcgttctgacaagtttccgtatgctggtttatgaccttcttgcactttaccaatgcttgaacgaaggagtgattaatattttggaacattactttgaaatgagtaaagttgatgctgagagagcattaggtatctataaagattttgtagaccagacggtggatgtggtgaagtatcttaaagtggcaaaacatctagagcatagtacgaagctccacgttccaactatcaaacatgcaccaactgaacttgccggatctttggaagattatttgaatgataaagactttgaaatcaaccgacgccagtatttggctgagaagcaaacaaaatctaacaagtctcactcccctgtgcgaaggacttcctcaactcttcccgcatctcaacgaggtactgcgcaacaaacttctctgaatgttcaaacgaccgggaccaacccatggggaaccacaccgcaagcatttgcttaccaacctatacagaatgtccaaagctcttcgcagcagcagatgacagctgtgttaccatatcaactgacgtctgttaatgaagagtcattatcgttctcgcaatctcacgcccccactggcaacgcacggcctccacttcctccaactaccagtttctatcaaccttcaatccagccagtatttactggggtggggtttggaggatacactggtggtaatcaagttgctgttcagacgactggaaaccctttttttcaaagctcatctgccgctaatcagataggtgcacaaccgcagaatattggtacgcctggtcaaaatcaaacttactttcagggcgaccacttcaatcagcaaagcaatcaatttggcaaccaacatttaaacaatcaggcagttgggcagtcttatggaaatagtcattcaacgaacaagataggagcaaacaatccccttaagcgagccaacactaacccctttgcctttcagtcaactggttcgcaacctgttgctctgaataatagtaggtccaatccattttcaaccgtttctcaacctgcagctagtacaggtaacccatttgcttcctcctcttcgccacatgtccagctttctcatcagccaactgccgggggtttagaaaaggtaccaactgtatcagttttccctgaaactaggcagcagcaacaacagtcgcagcaccaaatgccaaattatgcaacttattcgtcttataatggccctagtctcatttgagcgaattaatccaagacctaaactccaggaattagactacaaaacttgaaactgctagatatcaatccattaaatcattcattcattgttataatatagttgttgcttacatactcgctaggtggtgtactacaacttagcaaatctttttagactttcatcactgagagtaatgttagggttgaatttatccgcatcccggcgacttgcttgcttttcctcaatctccattcgtttagcaaccagatttgagaatgttggcctagcaaaagtggcagatagtatgaatggcgttatggcgattccaagggcaccgattgtctttgggactgtaactccggacattttgatatatagttagatgtttggttgctttagtggggttgagtaagtttctcaaaaaaacagagaagtcaagagtagggcaatttgagtttatatagagcattgagtaggtctgggtcatccatatgtatcgtaccactactaaaagtcggctgacctaatcttaacagtggttcgattttgataaactgaatcataccacgactagcacgtgactaatccttgttccagaattcgagagtttgaagatgtggagtaaacatttggaagatgcacctcacatgtggcgcaaaataaattcttgcgacaccagaggtaatcaacttacagtttatgcaatttctacaaaacagattttcaatgcgtatgtgataatattatatttataaaggataactgatgattctttggtatgccataggtcttgaaacccttagtaaaatactaacttctcgtcgaagtctcccatttttttgctaccgatgcttggacgacgagatatttcatgggtgtttacaacagaacttcgtctgctttcgctccagcgactgtcattcgaagtcatagagtcgattgaacttcttctgcttggctcttccactggtgagaccacagtctgctgcggagcggctctagccatcatcattcgggggcctttaatttcgtttattaaagacttggatccattggccatagaatcaccttcattccgaatatagcgagccagaaagttaagtttccaatccattggcgagcctgtagttttggctttaatatcgttaccgctgttatcgttactcattggtttcttgtggggagggagaagagacgaaagtgcctctatttatagaggtatcgatagtgaggctgaaaactcagtaaatacaacatgcttgaagttgtcgcgtcatgcattttcggagatgcttatcaagagcggtggtgtggggatgtgcgggggttggttaacctcgttaaagtagcaaggaaaatatagttacattcacttacattcgtaagagatgattgtaaggtctagccttgtttgacatgccaatgacgaacatctagtcaaacacagatgaccttatcgagacagttgagggacaaataacaaatgaaatatgagattggctgcagtattctccgttggagttcactccgcagttttacggagtccgatcggagactagaaccgaaatgattaggatcaaaatatgggttggtcatgattccgatatcgcatatttaccagtggagtccgggtggagaggaactttcttagttttcccataaatgacaatgcataaacaatagaaatgctgccagctgcaggtggggcttgaaatagtgacaaaaatcctttcgacttctattttcatcccgatgagagaaatgacatcattatcaaaattagaaagttcctttggttgtagcaccatatgggcccttttgcaccaaatttggtggtaatttaacgaagctgactaaaagcgtctagtaatattgatcctcctccgctttgtcgtgacttctcgaaacagttccaaaatcttaaagtttcgtctccagcccccgttacgactgtagttccatcaggtgacatggaaaggtaaaggactcgataagtatgaccagtcaaagatgctagttgcttcatttgcggatatttccaaataacgacttggtttcgagaatatccatgagtacttaccaattcattagaattgcgagaccacaagagattacaaacttgagatccagtatcaacatcgtgcagcttggatcctgttaaagtattccacaccttgatacgtctgtcagcagtacctccacccgaagccagtattccacgttgatgaggtgaccatgccaacgccttaacagccgcagtatgctcttcaactttcataaggggctgttctacacgcagtgcatcccataccatcatacggttatcattggaaccactggccagcttgttttcatccacgttccaacgtaagccacaaacctcttggcggtgttcaacaatgcgacttgtatagtgagctgctgcacgtacatcccgatgtaagatactgcgatctcttgaaccagaactcaaaacatgacggttccaactcagcgctgaggttcgggccgaatgcccagtcattgatcttgtacatttggacgtcgtggcgtcccatatttcaactaaaccagattgtgttcctactgccaaatgtgtaccagcctgtatccatgacacagaggttactgcctcacgcggagacagctcacataaccgtgaaactgagccgctagcagcatcccaaagatagacgcttgaccctaggcccactgctaaaatgtcttgagctccccaatcaactaagttcaagtaatagtcatcagcgagttctggtgcatccaatacacggtaggctaccttagatatagcccttgttttcttttgaggtgacaatagtagtctttgagattcctggcgcacaggagatactgaatacagttcactgctgtgggcaacaccacttttagtgcccataccgatccctggaccacgacgacctggtgatttatacgagaagagatttcggacatcttttccttttccatttccgctagttgaggttatcctatctatgtctccaagagtatcttcattgtccgaatccattcttgtgtgtcttgggggtgtttgaggggaaacgattgttgtgttgagctgggcagagtttgggtctgaattttgtatggacagctgatctccaaaaagttcagtcttcaaaatccggttgaacgttctatcagcctccagctgccgtatatagttaagatcattagtatccgtagtctcagcggcggtctcccttcttatttcttctgcatcatgggtaaccgtgccctgtaaactaaaagctgcctgtaggtcgatgccagtgcgtgttggtatgtatcgatctccataaaccgtttggggagttgacctacgtcttgatggagagtggctcatactaaaagtatgtcgccttctttcaggagttcccggtggagttttgtcacttgcctgccgactttggggctctgacatcgagatgttgacggagatgggaaaaatgtcagaataattcgagcctagtcgttgaacaatcgaagacttgggtataaaaagtggtctattataggagtactatctactgctaggaaaactatgaggaattgacttcattcaggttgacgcctcactccacttacaatatcatctactctcaataacaagcaagcactttcaattgcagtcttaacactttgtaacttgatcgctgccggttcccagatgccatattcgtccatgttaacaaccttcccttgctctccgtcaataccccaattgtattcaccagtagcatgtttggcacgtagttgtgataaaactcggatagagtggcctccgcaattctgtatcaaagttcttggaataacttcaaaggcatctgctactgcttgatacggccattgttgaacaccctccaaagatcgtgcatgctcagcaagagccacagaaactgccatctctgtagcaccaccacctggagcaaggcgaggttccaaaaaaacgttacgtgctacggacattgcatcctgcaagttccgttcaacttcgttcaaaatatcctttgatgcacctctcaaaacaactgtacatgcctgaggatctctgcatcgggacattgaagcataatattcatcaccgataagatccacagaaaaaagaccacaacgagtaccgatatctgactctttcaagtcttctagcctattgacaatggttgctcctgtaactcgagcaacacgattattatcagattttttgagtcttcgaagagcactgcagccacctttcaataagtagtgttgggctaaatcagagacacctttctcagttataacaacatctggtttcagagataaaatctgttcgcacatcaagcgcacctgttcttcttcaatttctagaatacgagcccaatcttcttccttggtgatctcaatgttcgtctgagattcccctttcttgtattccaaaggtgaatctaatagtaagactcttggattctcgatacgtcttcgcatcttgggatgcacaacgtctttattgaacataactccgtcaagaacgtaagagtcagacacttctcctccgggaattttttccaccttagcgtagcgcttgatatcaatttcagagcgcccgtcaggttgtagcactttaacagtcgttactgccttcagggccaaatggcacatatgatctgaccactgagccacatacttcgttccaatggaagcagctatcagttttaccatagatttctcatcgttggtatcaatcggtttggataccctttcaatggttgccagggcgtcagacagtgcttgcttcagagcctggataataactactgggtgaatatttttctcgatataggggaaagtctgtgcaaggatctctgcagcaaggataatcactgtagtcgtaccatcgccaacttcctcatcttgagttctactgagttcaatcatagacttagctgcagggtgagcaacatcgatttctctcagtattgcatgaccatcattagtcagtacaatacctcccattggatccagcaacattttcagcatcgctttaggaccaagacatgtacgaataatatctgcaactgccttggcagcagtgatgttggaaatttgagcttgacggccggtctggcgaacagtcgacgtgtctattgaaaatgttaatatagaggcactcaaaaaaaaaaacttggcagatagacccaaaaaggtgactcctgtcaattggagcttcaaaaagagataacatactcataaataccacaggtgcttgcatttgtgattagataaagaaaagatgctacactttgttggaaatttttgatgttttcgaatcgcgaaggtcttctgctggacgggagaattgttaaactggtgagtaatgggacaacattatacttacaacacgtacttacgaggaggttttactggcactataacgataaaacttcaaatattcttattctatttattgcgatgtagcctataagttgtgtgcaattccggttgctattacttcatgctgatgtttgctaccaaatttatattattagttagattacatttgccttccagtcgagcaacatcaaaaatcctcctacgtcaacaaatcacgttgcacacctcataatggcttccagaaagtctccaagaaaaagggtacgagatcaagaagaaagtgataactcttcggtccagacaattaaggtagttagtgacgtacctactaagcggcctaaactttcccgtaagacaagcgacgaattggcgtttgcggaaaatgaacgaaaactcgacgaacaacttcctgctgatcttcgaaaattcaggccgacaggctttaagttcaacttgcctccagaaggacgctcaattcgtatttatgcagacggagtcttcgacttgtttcatttaggtcacatgaaacaattggaacaatgtaagaaagctttccccaatgttaccttggtttgtggaattcctaatgataaagaaacacacaaacgtaagggattgacggtccttacagataagcaacgctatgagactattaaacattgccgttgggtggatgaggtgattcctgatgctccttgggtagttgatgtgggttttcttgagaaacacaaaattgactatgttgcacatgatgaccttccatacgcctcgtctggttccgatgatatatacagacctatcaaggaaatcggaatgtttttagtgacacaaaggacagaaggtgtttctacctctgacataatcactaaagtaattagggattacgacaaatacctgatgcgaaacttcgcacggggagcaactaggaaagagttaaacgtcagttggttgaaaaaaaatgaattggatttgaagaaacatatcaacgattttcgtagctattttaagaaagctaacatcaatctcaatgcttcgtccaaggacctatactttgaggttagggaatatctaagaggaaacaacaactccaatgggaacgaaagtagccccaacaagtctgattccgactctaattctgtgaatagtagcactgcaagcactagtggcacaatggatgatttgatgaatatagtacaatctcgatctcccgcaacagactttgctgcaaaatataacagcaatgaaaatctgaagagaaatcgatcattcatcaacaatttgaaagactactggaaaagaagatccgaatccggtgaagagaaccaaagtaactgaaaagtatctaactactttggtagttgattgtttttacgtttgcgtcatttccgtggccgattccacgagtttataagcatagaacattgagatttcatgaaatctcctcatttattttctataaacctgcaaagaatgaacctaaaacaaggtttcctgaatttttaataacttttcgcctttttttcttttgtattgattcagatggattatctatatctcccaaaagagcagatctgtccgataccaccctagaatcatcgttactgtttatggatgatttattttcgtcatattcagaactaatatccttaggcaagtcaatttcgacatcatttgtggagtctgaagagtcacttggatcttcttcttctgtcgttgcttcctcctcctcctgctcctcttcatcctcctccttttctacatcctgcaattctccccatagtctcacacgatcggtgccgcaagtaatcaatcggtactcgtagtctaggtcaagaaaggtaacatcgtccgttttactgtgctccctagtttcaagaatctttccattctttgaatgaataagatgaactagtccaccgcttgtgcctgcccaaacacaggaatcgcccttcaaagtcccaattacactgtccacgctgtcttcgccggtctttgtttttcttatcatggaatcaaagttgttagaattcttattccatactgatacgcctccttcactcatgccgcacataagtacttcacaattatcggggtctactactgtaacactcattatttcatcttcttgatcttcagactctgcaattataccacttttcacgttgaaatgtgtcaacgatgaagacccacacgatacaaactcattctcgttggtcgacgctaacgatacaatcccgttgacagcatcaccatgacagttctcaataaaatgtagctttttgagtgttctttgatcataaacatgaacatttccagattcatctccaattagaataagaggtttggttggggctacaatcattttcgaaatgcgtgacttaatatctagaacgaccttgtataaaactttccccgtgacgctatttgcacatttcaaaacattgtcagacccagctgtaaaaagcttgctaccactaggatcaaagcaaagtgctctgcaacttcctttatgtcttttggttttccattggattagggaatctttggtggcgtgaattttgagtttgtctactctccaccattttctatcagtgttcattacacttttagtctgacctttatagtcgctcctgaacgctttaaataagttccttgcctcttcttttaaagtttttggatcgtaggtgatcatttgtacgtggcccgtagcaaacccaagcgcgatcaaactcttcgaagggtgagccgccatagcaaaaattggcatctcctcaaaatttatctctaatagggggtatacattggattcttgctttcggagctttgattgaaggatttgagtctttgttttagccattcactctactatcttaatcggcagagttcttttttttttttttttactgccgcgagaaagtatcgatgaggatgtttgggccattgtgataacctcagagttatacttagtgtgaaccaccccatattgtacgttgctccatggtcattcagtagtactaccaccatgcagtaaaagatgtgaaacctatcatcttatcagacatgtgtacagtgtgaggcttaactgactttagaatatcgttttccaagattttatggcatcagatcttcatactaactattggaagatgtatccttaatctggtgttaatactttgttggaacgatatacatgattgaacttcttagaaaagtttgaataaaagtcgcgataactcatagtgcaataattttagggttgtgttgtaaaactctcaagaattaccttccaatttcaacatgaaaaaggagtccacaaatcagaaatcatcaaaatagtgcagttagttcactgtaatttgttcagtaccggttctgtggtctagttggttatggcatatgcttaacacgcataacgtccccagttcgatcctgggcagaatcatcatttttactcactttagcttacagtttttttttttgctcaattttcattggagttgtgataaaaacgctgacaaagtactcaaacaagttgaattacatatgaagtggtacaccatgataataaggtgcattcattaatcacttttttcagatgttgtgctacgtcaattttgaatttttgcgacaagaataactcggtggctcttttaatagcggatcgcaaatcagaaagcaaatctactgaaaaaacgattctttgcactcttgaaattagaaaaaaaggaaaaagttgtgaatattatagtatgtgtacaagtgtcccaataccacacgaaaaaaatctcctcggttgtttctctgcctccttgaaccaataggtgtttaagaagtaagtctagctcaaagttttcatgcgtgttgcctatttgattccaaaatgggctaggttgttctctcataattaagcaataagcaaaagaagatcttgaccatgcttattttcaatgtatgccccgggtcctctctattcataaacgtttgacttgggttcgctgggttcaaaccttgtaggaatcaatcaattctcttttgagaaagaacttacaaatgcaggcatcaataacaatccagaatcctgttcttcacatgacctatggctgagatggtcattgttatgcagaaagttcgcttgttgatccgttgggaaattcacttcggtctcccagtggcccattcctaattctgcccgaagattccagaagtgtactgtcattctgtggtggggaaactaccccaccatcgccgctggcattttcgtttgtgataaggcctattcttggcctttcaagagatattgtgtccaagcgggttagttcgtgttcagtcgttccgtagatgtcgtcgtaattgggattgtctggggggtagaggtcttgtaatggagtttcttgaaaccagacgtattcatcattggttacagagcttcctctagagctattggagatatacgtctgcagccgcatcaaacttgtacttcccccgttgtagttcttcaaatgagtttttcttgagctgacagttcttcgcatgatgcaaaaaatggttcctgtaaatgccaaaaatacagtacttaccaacatcaaccaacctccaaacgcaacgtgtggcacaaatagtaacacgtctaccaggaaggagaataatgtaaaaaaaaaagaagcacaagtccatactagacacgttaataagaaccataatgatctgtgaaatctatccatattcaacatgagacttagaacccataaaataaaggtgcaaacacagccaatcaaatgaaccaccaacaagcttgatatagagcttcttgcattacttggtaatgaaaagcctctcaattcgtctattgaatttcgatgataaccgattcctatcgttgtgcagatattattctcggtgcaatatccaaacacgccaaacttatatccttgataagaacaaagttggatatgcttggtgattggcacgcttaaaacagagagaagttcaaacgtaaaggttattgccaataatccatttaggaataccaccacctttgacatatattctcgtctatatttgctgcacagtacagggaaaacctagataaagttcgcgggtgatgttaaactctccaagctatctccccgagagttcttggaggtatatttagctgtagtattctaaaagaagaataaaatggcatcatttacaaacattaattatttgaacaagtgaaaaacgtctacgtaaaagccaactatttcttttttgtgccaaacaactttttcatgaaacctgccttcttggttgaagcagtcgaggagcttgagccaacgctcttgctacgaggtttcaaggcattgtttgaagcggcacttaggttcgtgctagatctccgcctgtcctgatcactgttaatactcagtcgagtatttatcctggaaatttcatttgtagaatttgcacctgagccactggaggtcattggaccagagagtagagatttcaccttatagacgttaggtgacatgtcatcaaattcaaactgtaccgctcgagatatccccgggctggatgacatattcgcaccactgtaatctgtaacttctgaattttcagagagaactgaacctcttttagaaatagcttgaagtgtgttataagatcccttctcggtagctttaattaactgctgaacaaacaaagagctgggtgaaacgtttttatcgagactgtcctcatcgatagatatggtaggtgtcgaatagtcatctttggctagagccgatttacttgcgaattcaatagattgatcattcttggaatctttaaatggttgcttgaatacaattccattcttagtgtcgtcttgtgcagattcttttacatatatgactggaacaggtgatttttcaatcgcaaaggaagaaaacttcatgatgctacgatcaccaaccttatatttcccattcagccccggaccgagtacgctcgtaactgaagctgttcgcttttttccaagcacataactattctgacgagactgagtgtattccttaatccccaaaactgttagcacgggctgatacagtttgtacatatccttcaaacattgttttgagcttttgcaattgagaagctcaacagaaactctgattttggctggattatgggactctcgcaaagtctctagacaataccgctggatattttcacatacagctttcgtgcgatcaagatcaacatcgaaagcttttggcgtttggtaaagacctttgtcgttgcgattctctattgtagagttgatcttaactttattcgaagattctctgactggcaaagaagcaactaccaccacatggtcattgtcttgaacaagatcacgtaaaatgtaatctaagctactccatgtatgttttctgccactaattacggttaaaatgaccctatatttgggggtgctttccaacactgaggcattaacccgttgcaaataacgtgatatttccttcttagcatttgattctggcacagatatggatggataactttctacaggctttggggtgtctacacctacatggctcatggttaaaccgtatgaccctaatgagatcacaggtctggtaggatactctcttgaataacctgtctttccatatgtggtctttgttgaggctgatccggattgataatacgacgatggtttcgataattgggatgtgaagctgaagctatccagatccaaagaagcatgtgcgaattgtttatcaagggccagtacttcctcgtccgtcataccagcatatgactttctgcgtccctgtgccatatttgaacctgaaggaatggtctcatgcttgaggtcgtcttgctcattgtagacgtctttatagtcgtgatctataggtgtctgacaagcactattcttaagaattgagcgagatgcgggtggcagacgaaaccgttgtcttttgaatttatttctgggttgtgatttaacagtcgagaagtagtcgccagaatccaagtcggtagcgccgtcatgcttgccatatccgtaccgttgtttgtccttgagaatttgtttcagcgtattggagttgacaatgtagttgtcactatcatctccatattgagggggtatattaacaggatgttctggatcaatgaaacagggaacaatgttgttaaatgatacccgtgtttgaaagtctaccataagaaagatatgagattctatggggaataccagatggaaagaagagaggaggaagcaaatcacttgacagcagtcgattcaaaggaggaacaggtctcgaattatcatagtgcggcgataatgatttcatgcacccagggttttcaggccacatttgggagaaagaggcttaagcattaaggagatgtatttctggcccacgacctacgaacacagagagaatatgactaacacagaaaagaagaaagttagagtgttacaaaactttcagtatcccgctggcggtcaattatcagagagcagaggccctcgtgtcatgcgtctcggaaaattccgccaagccactctagaagataagacgtctaagccagtcagcccttggagccgttacggatacttgcttcccttctgaaggtaaccagcgtacaaatatggcttccaaagttgttcaaatcacctagtgatatgtaaaagattaaggttgagaataacaaggacctatcatttgctacttccatttgggtcatgaacatctctcatttctgaaaatgtcccatgtgtttgtatatatatgccagcgcgacttggtgaccccacaaggacagacgaataggactgtcagtaaggtagtttttaggtcgcgaagatagactgataccctttagaaccaaatcatggttggaaaagtaacctagatagaaggctagcaaacctgccaacaacaggtacggttatttgaattcaaacgagatagtattaaataaagatataacgagatcatttttttcttgaggaacacgaaagacctttaatttagcctcaactttgcaccctcgatttttcattttgtctttttttttacccttctctcctccatatggataagtcaaccttcaaaacccttcttcgttccgtagggagggatgttgaaaggctgacgaaccctgttctttacaaacaaaaattaccagtacctcgtgatgctttaaatcgaagcaagatcttctcacctttcacacgacacaacttcaatgaacttctcataggagggctcaccaagccaaatatcagattgatggaacttcaggaagcaaggcttgctgaaccgctgaagatgcaccatgccaaagttgaagttcacgacttgactttgagcaaatctcaacaagatatatatcgcacgaattgtgatagcgattttgaccaactgctatcaagactaaatggattagggaaatacaaactgggaatcgaccacttggtcaactatgcggcccagcaagtatccgatcctgtatcgatggaacagcttgctagtaaagttgtggctcgagaagatttgaatgtcaagcagaaagcctgttttttgactcgactactaagctatggcggacacatggttcaacatggcagtcacttttcttcgctagaccatcttgttgagcaagtcacatatatagccgatgaagcgctccaagggctcatcttgaggtattatctgaagcgtggacagtctcgtgcatttataaatttattggaagaatgtttgaaccaaagctacttaccatcaccagatataatagttgactacattcagctcgtagcatctcaatcagctccggggagtctccgttccaggaagcagttaactccattggccccaataatagccagagtatccacacctcagttagtgacagaactatcgaaccaactttcaacagcaaaggaatttgagacgtatctcactattttgacccgtcttcccaattggcatcaactaatcagtgtgggtctttcaaatctaaccaaagctgccattcgcacatcatcaaagacaaatggttcaaatgaggcctatgcaagcgcactattgtcccaacagctgctacgcctcgagtccaaagcagggagcactctgtctgctaaaacagaattggtactgtcgttagtacaagcccacatctcgctaggtgatttttcacgtgcagcaaagtacttgcgggactctggctggtctgtccccttagatcaagtgctcaggagaattgtgaacacaacctgtcattcaattcctaatcgggacactgcgcctggatctagggttgtggacaagtcatttttcttttttgggcttattcagcccatgttacgtgagtttatacattatgagttattcattcaagcgttgctggcattcgatttggatgctagtgcttttgttgagcaacagaaatcttctttcgataacaccaagcttaaacgacttcaggaacttctgatgaacccataatatagcgaacacgattttaatctatgacaatgcggataacgacgtagggtaatgtcttgatgtctcttgcttcgagggggggtgcaggagtatcctatttgtatatattaaagccgaaccccaatctttagacccaagcaaagcaattcagacaacttggtaattatgacatcaaattcacaggaatcattggagattgttaaaccctcttataatgctgcggctgggccgacttactcgaagaagatctctacgaaagaggatatgcagagatcctttgctttcgagtgggatcaccctgagtctggtgcttacggttcactcgtggacaatctgggccagttttttggggtactggggctggttccctgctgttgttgctctaacccctacaaatctgttcagcaaggtactgttggtttagtcacgaagtttggagagctgtataaggctgtggaccctggtctcgttaagatcaacattctaagtgaaaagctacacattgtgagtgtcaaaattagaatgattgagatacctaagcaaacctgcatcacaaaggataatgtgaacgtagaccttacaagtgtcacttatttcagtatcgtggagcccgaaaaggccgtgtttaacattgacaatgttgatggtgcacttgctgagcgtacgaagactactttaagacaagtggtaggtaccagaaacttgcaggatgttattgagcgccgtgaagaattagctgaggcaattcaagaggttatttctcaaactgtgcagaactggggtgtcacttgccatgacatcctaattaaggatttgaaccttccagtaactgtatctcacgcgctttcgatggctgctgaagccaagagaattggtgagagtaaaattattactgccaaggccgaggttgagagtgctaaactgatgcgaaaagctgctgacattttagcttctaagccagctatgcaaatcagatacttagatgcaatgcagcagatggctaagtccgccaactctaaggttatctttatgccaggtagtggtgaaatagagagacaagcgggtgataaagtgctagaggaagccggtcagggatcgagtctttctaatcgagttacggactttgttggcctgcaggagagtaccaactaacttttcgttaccttcttttggtttatctttgtttcgaacttatggcctatgtaattaattttgaggtaacaagatggtaatgggatttacttttatagggcttacatatatttataggttttctccagtaattgactggtgatattcatcggagcaactacgggtcgatctgatctacgtatttgagggctattagtgaaagctatgtcatgctgaaagacaggttagtaggaacctggcaaaggggaaaagcatcattggtggttagcgtaggcatttgggatatgccaggacggtagtgggtatttaagtacaatactcattatttcgggaatgtgtttactcatttgttcaaccaactagcgaaccataaattccatcgatgctatagtagaacatcgcgaatttagtaagttccttccttcaaatcaccgtcaggttatatgtactctcaaggtgatcagctaatccgccagctgagaatctatgattccacagctggtgaattagaacaatacgaggagcctcaagatgagttcacttctctcaaaattttagatcggtgtcctgaatttgttcccccaatcaattttgctatagtagaggatggtatctacaggtcaggtcatcctcaagcattcaattttccgtatttacaaaaactgaacctaaaaacaatcatatatttgggtgacaagacggacaactatgactattaccggtggctccgcgatcaaggtatagattttcattacctaaatatgcaaagctgtgtagagccgtttatgttcaaggatgactcggttattcagcaggctctgaagctaattgttcacaaagaaaactacccaatgttaattcattcgaataagggcaaacatagggtgggggtattagtgggtatcatgagaaaactgcttcaggggtggtgtatttctggcatatttgatgagtatggacgttttgccgggggaaaaggggagggcgatgtggagtacatcgagacattcaaaaccgatttactgatcgacaagaacaccaaaccagagttcgtccgagtggggtaatcagaagtacgctagacatagcagcaatatacgagtactcatcatattactaatttttcatctttaaaaaacttgctacctagaacgcttaagcagagaaagaaagagatacacctagcttatgagtggcctcgttcaacttgagaacgtcaatagcagctcctaaacctaacttaacaccctttcttaaatcttgggagtaggcaaatgaggcaataccagaatcagctattttggctttaacgaaagctgtcgaatcaacctgatacttagttgctacttccaaagcaactgggtttgcaatagaggacttagagtcgtaagtagctttaccacctacctcgacgagaggagaaactttgtggtaataaccggcagaaaacagtttgacgttatccaaagcagaaagagaaatggagtagtctggggccttgtatccgacagcgaaagcatatttggtgacggaagcggcattaatgtcataggaagcagttccacccaaagtgacaccgtctttaccagcggtaaagtcagcattcactgtagggccctttaacaaatccaagaatgttcgggcagtgaatgcttggtgagcataggtcaaattcagcttagcgtccttcttcttgtcgggaacaacagatccgacaacctcagctttcaaaccgggagtcaaagtgtcagccagctcaaccttggtgtctagggcattggcagtgttccagccctgagtcaaagtcaaaccgttctttttgtcggcgtacttggtctccaggtttccagatagcttgtcaccggcagatttacctttggcagtgaaagttacaccgttggcagcaacagtcttcacgtccaaagagactggggtcaagtgataaaagtccttgcctagtacatcattagatgcttttgagatgtcggaaaatgctggtacggccattttgatagttcaggttaagtgatgaagcaaacgaaacaggggggagggttaagagggctttttatacgtgatgggtttatgttggaggcattgagacccaacaaaatcgcggggcatcacgtggaggcattattctacacatcgaagatcgatctaaaaacactagacatgcgggttgcaaatgtcgacataattttatgtttgctaagacaaatgctaactcataaacacaactttttgcttaatacattacataagcattagaatacactaaatatcatctctatatttactctactgcttctcagattcgttggtctcattagtcacattctggtcactgctgaaatcattaaccggaactacctgatccagaacttccggctccttgaagccattgtttgggcctgatccccaagccaaaaaatcacgacgtacttccacgtagtcataagcgaactctccaatctgatcctcatccatacctttctcctcagcctcttctgaagctcgcagttgcaaaaatggaatacggttgaggatgaaacagataagagcggtgatggccatcgagtatccaatacaagcaaaaatgaatgcaatctgtttgtacaactgtttccagttgtggtctatccaaccaccttcgtgctcggtaaggccatcataaccaatgacagtagccgacccaaataatgcgttgaagacgagaccaataacaccagcgataccgtgctctgctagaacatccatggaatcatcgactcgacaaatgactttaatcttggttgcgtagttacaaaccactcctgatacaataccaagaataacactggcccaaagaggaatgatacctgaggctggagttgctgccacgaggcccgaaatggcaccggagcatagagcaacagtactgaaacggcgctccaaacgccagtctaatagacaccaggaaatagcaccaaatgcacctgtgatatttgtgttcacgatggcataaacagatttaagagatgggttcaaacaagtaaaaccgttgaaagccatccatccaaaccacaggaaaccagtacccaaggctaccattgaaacattgtggggacgaaaattgataagcaatcgctcccttctacgtcccagaaagtaggaatagacgaaacccgaaaaaccagaaacgatctcaacaggtccacctccagcgtaatcaaggacaccccattcagctgcccatccactaggattccaaacccaacatgcaattggacaataacatagggtagcccaaaagaagacaaaaatcatacaaaccataacacgtccacgctcggcaacagcaccaacaaagatggctgtggtcacgcataggaacattgcctggaagttagcaaaagccatctcagggtaatctccctgcagagtcagagagccgtaagtgttctgataaccgaagttgtgtaaatttccaatgaacttattagtcgccgtgggactaaaagccaacgagtaaccccagaaataccattgaaagaaaataacacaacacgacatataacatacccaaatcatagatagagcagaattacgcctggttaatccagaataaaggtaggccagacctataaccatcatgaaaaccatggcagaaccgatagtcagttgaacgattacggcacggtcgtagttaacatcctcctcccatacagatctcttcgccagtaggtcaccaatcgttgattgtatcattgttttatcttcctcaacgagttttctgaaatacgaacaacctaaacagaggcagttatcgctgacactttatatactgtatgcactggaagcagtatttttggtttttcttttttttcggaaggttgttatctcatgcataatttattgataagaaattacaacaacaaggaagcattctgattcttccaaagggtcctgccaccgatgctggccaaagcgttattcgtgcaagcgcaaccgctgcaggaagttgtattcgtttcctagctctcctttagtgttctttgctttgatggtttgttgatcaacttgctgggcaagctcacatcctgattggtcaaagacaagtgtcgccgctcggtgtgcggcgtcaatgcagttttttcgttttggaataaatctgtacaatttggggttgcgggttcatttcccaggagcccccccgaaaagtagccaagcatcagatatctcattggcctctacaacgttattggttattaatttccccgatctttgtgttctgtgcttgattcagttgattgtttgcctattaacctctttcttcttctgctctacgtggtggtgctaggatttttcggcccgctcctacagaaagaaataccctcctcccccattaccttgcatagtcgtgtgatgcccagttgacccagtttccatgtttagaaatagattgggcaacaatgtatatgtactgctaggctatttgatggtcattaatccatctagcgaataagaaaggtgtacctgtaaaccgctgtagcacagctaggtgatgtgaaggtttatgatacatttatagtgttgaaaagttttaaagatgagataagagcaggtccatgcaactttgaaacaaaagaaggaggaagtagtcatctaatttaatcataaaaagggaaatcgatgcgtgcagtggaaaaactacgcttgaaaattctttactgaagttgtcaatacgaaaaattaaacaaacacaatcaagagtatataatagagggatgagaatagagtaaactcttatggataggtgccccatctaattgctaaggatgaaaaatatgctcatatgcggagatcattttaaaatcatcgtagtcatgaaatttgagtacgttgacaaatgacgtgcctgtttaaaatgcgtagaaggatctaaaattgaaaaatcaacgttagataagattaggaattatttaggagatgtgtagtgctgctttttttcaatagaaatactgcataatagtataagaataataagctgaaattttttcgtggggaattttcaagttgggaagcatgtcaatttttatgaggatgaactattcatcactttcatgatctaaacagaataagaaacggcttgttgtttctcttttgactgagtgaaaagtaagcgcatgttttttgttcagatggtattttgatgcgttccaaagtatgtcaagcttcatcctagaaagcaagtggggaaggttgtactcactacgtgcatcctggggtaaaatcatcgtctttccctttccggggaatgcttttcttttacttaaacaccttcgccgaccaaaccttttaatttttcttcgataattcccttctgtcttctaagtagatgaaggtgatctggctcttcctactcagtgctagcttgaaagcgcttactaagctcttaagtattatattgcacaagtctcgaatatgctacgcaagctgtttctgctaaatctggagacagtgtccgacggaacttcacttcgtacaacctcttcgaggctttcttccaatcaatcaatcccacctgtatagcactttcttcagtttcctgttagtttctagacacagccagtaccaatatcaaattttaaccaaatgctactggccacccaacgcttacctgctgcggatcatgttgctttgggcgagtcaagtttgagtccagtgtcatccttcgacaactctcatcgagcaattttagctctggaagaacaaatggagaatatctactcccgagcattcactgaaaataataactcaaggccagacccaacatcagcgatatggcaagatcttgctctcactatagctagatatgtgtatgctatacatcgttttgttgagaaacaattgaccatcgaggcacttcagttatgcacccctagtaatagcatctggaaaagttgcaccaatgccttaacacgggtttttccttacctgaacttcatcatagaaaaccaaattcagtcagtgaacttttccttggcctttttccatgagatgagtgtggctactgactgctcatttcagtacttaataatctttaaggatctagtggaacataaggtatcacagttagatctcattaatcactctttattattgagagttgtcatatatattcatgacaagctagacaatgttgaaatggagatcttgaactacaggaaatctttgaaagtttttaacgaagttttgctctgttattattttgcaatttttcaatacaaggacaacaatgttggtgttgccatcggattagtaaattacgggctattgttacttcaggcaaaacataccattgatttggaatcatctatgcttcctgaactgggcccaaaggaaagtgctgataagcttaatacgctcaaatccaaactgaatatcagttccaaactccaacagaaacgaaaccaactcaaatcatccaaaattaacaaatcaaactctaataccgaaaatttagagtccaatattgtagcttcatccaaaattcataacagacttttgttatctcttccgcagtcttttcagatgcctttgcgtcaaattttcgattcttttaactctttgaatctaacatttcacaaagagaacaagtgtctccatttccaacaaattccgtcctctgactctattgctacctctcacctttacaactcagagcgtttgccgaatggaaggaatgttcctcttttcaatcaacaggaagtatggactccgacagtattacaaagcaagcatgacagcaatcagtcatatatagggaagggaacttactactaataactaataaacgtacttttatttcttttactttgtataatgtgacactccaaatctggcaatcatcttcaggcaaagcactattgtaagaggttagaggaaatagaacagacacttcttgctttattgagttggcagaggcatgcgagccatgacatcaaaaataccagtcccaactttactcagtttcccgactacaagtcgtgcagaaggtgactctagttcttccctatcgttgtccaaaactgccttggttaaaaattggcaagtagtctcataagacatcttcatgaatgatgaagttgagttttcgataccttgtcggttgaaggctagataagtcccttgacgagtcatcatgtcggcaatcaaatccaaatgacgactggaaactgcaattgcatacctaccaaacacattgttgatttcattaacaatggtattccttgcagcctccacaccataagtgcgtaaaacagcataggtatcatttgatctgatagcatccacatccacaaaagcgtcttgctcccacatggcttggaagttaacaccttctgtaataaaatgtcttctctgcccggcttcgggctgaggtagaacacatctaccgatattaggtatttcccttacgaccacattctgacatagctcctcaataatgttcaccatcaacaatttataattttgaccaaccatcttgatttgaaattcacaccaggttccattcttgtcatcaaaattgaaagctgagatcatactatgggcactgattactgcagtctgacgttcaagtgccatcttgtcaaggatattctccgcaggtggtctatgagcattaatctcttcgtcatccgattcatcgtcacaagaagatttctcttcctctgaagacatgaagtcttcttcctcttcatctgaggactttgcagctcggttcatagcctcaagttcctgttcatctggttcatcataagaaactggttccttgccttgttcattttcgttattgtccaactcatcaccatcaccatcattgatcgacttcttcactgcttcacttgtttcaaaagctctatcggattttggaactgcctctcctatttcttcatcgggcactactgcctgatcccgacttttcttcagttgctttcgaatagcgacttctagcttgcttaagaagcttctaactagtacctccgccaactcagctcgtgtaacgtcatattcttgctcgtaatcctctgcagagaagaagttcaggcgtatgttatactgcttggaaccaactccagcatctgaccccgaagtttcagtcactgtaacgtagtctatgaactccgacagaacaactcgtgcaacagacctgcaaaatgcttgcgcctgctcatccaaaacatcatccagaatcggtagcatcatttgtggggtcttaatgttcaaagaagctgtcatgatgatctctctcatacggggaatacctaaggtcacatttgcagcaccatgtccagcgaaatggaacgtgttcaaggtcatttgagtagatggttcacctactgactgagaggcaattattccaacagcttcacctgggttaatcagagatctcatgtattttagttgcatcaatgcacggaatttcttttcggtaagagaacgcttggattttttatcgaacagttggggattattgtcaatgaagttatccagcgcatcttgaaagtgctcagatacagctccaagatatttggcaggattgaacttatttataacaggcatatatttgtcttcgaactggtagtgcattttgttggattgttttttcaagttctttctacatttcttagcatacttcaaagcagattcagcatcaaggttgtgtaccaactggcctggattatacctttccagcaatgaatcatagttttcggcgcaaaattgaaatttatacatatgtgactccttgacaacatcaacagagtcaccaccgtataagaactgaatgagagatccatcaccatctctaacagagttatcgtatcctatgtgtgctccctctaattgcttcgtcaaacaacgctgcaaatagccagatctagaggtcttaacagcggtatcaatcaggccctctcttccagccatacaatgaaagtaatattcctgtgggcgaattccagagtaaaatcggcctttgatatatccaccagcacgagcgtctgtatcaaatggtttgaatgatggtaatgtcttaccgcttaccataacaggtacacggcgtccttctaaagcttgctggccgagaagacacatgatctgagaaacgttgacgttggatcccttggctccagacaaagccattgcttgcattgaattctcgggaaatctcttcattgtaccctcaggaatacaagatgaaacgactttggaagtaacaacattgacttttgattgcgttacagcatccagtatacccaatttgccgtcatcacgtaatatttcttctagacgacgcatgaattctttgtcgccaggcttggtatctttaggaaggttggtgacttcagctgctgcaactctacccaagtccacagattcttgcagaatttctgacctttgtttgttaccctcagcagttaaacgtaaatcatccataccacatgtgaaaccaatcatcatgatatagtttgtgaaaagacgacctaaaacagacagggctttactggaaacagaaggtccatatacctcatgcaaagagtgtataagaccaaaattggaagcaccatattgagatttatcaagtattccgactaatagttccccatttcgaattatgacccggtcttcaatagagtcgccaccccaataagaagcctttatcttatttttggatttcaagttaagtcctggcattttgataggtttgatgttcagtagaatagtggtaatgatttgttttccagtccataaaggaacaggtttcaaaactgttgggggtagtgtctgaatcctggatttcacagtgtgaccatcttcaggacggaggcacccgtaaatcaactgttgatacttctctctagtgaaaaaactgtctttattggttagccaaacacctgcagaaatatgatcttgaatcaaacccctgacaggagaacctgaggtgggtgttaaatactgagagtcagtgttagccaaattatatgcctctgctctagcattttcattctggggcaaatgcatattcatttcgtcaccatcaaaatcggcattgtaagcgccagtattggcgtaatgcaatcgcaatgttttctcacctggtaacactcttaccttgtgacccatcattgaagccttatgcaatgtgggttgacgattcatgatgacaatgtcattgtttttgatatgtctatagacttttttattgacaactgtagctccatttgagggagtcaatagctgattagcaatcgcttttctttgctctaaggtcatccctattaaagatacatgcctgccatcttcgttttgaatttggatagcaccaggccaaacatctggtccatttatgatggcttgtcgcaaagaagcagcattgtaagctgtgactggttctgggtatgtcaacttctttgcgaacacaggaggaaccccaatctcgttcgtttccaacattgggtctggcgagatgactgaacgagctgcatagttgactcttttccccatcatatgtttcctgaaaagcccctctttcttttctaatgcttgtttaataccaggattggcttgagcattttgagatttggtagaatcaataaaactattgacgtcatcctgtattgtgacaaatgcattcatcaatcgattaaatataatctttctctcttctgcagtaatctggtctttctgtactgttattatactctcattaagatctctaatagtcagtgctgttgttaatattttggaaagctgctcgttctgactgttttcatgtatttcatctcctaacttggatggaagtctgaatctagtgggaggaacaattagtgcttgaatgaaaaacatatcggcggagattatgttatttgagttgggtctggcattgaacacatacttgagtacatccttttcagtaataaatagctttcgtacaatcgttcgaacctctgttgacaatatgtacttgaaggaagactttgtcttaattggaggaaaattatcagcaggagtggcatcatcggaatgcgcactctcttcattttgtttaaacttagtttcacgtgttaagcctttcactctgttatgagagatttgttttggagttaatgcattctcaaatagttttatagacccgtcctttctaaaactgggggaatacatcccacaattatcacatttaggtcgggataaaagtcgggagttaaacgaacggatgatggcctttctttcattcgcaattgttgatgtggtcataccctgctcagtagttcttccttcactgagggctgtagcaattgcagtttcaacaaattcgtttctgagcctttttaaggaggcatcgtccccgttgccctgatcattaccatcatcaatatcgtctacgtcaatatcttccaactttgttccggtactgacgccatccaactcttcacactcgagcattagcccatactgcaacaacctcaatttgcaggcgaagaaattaacttcactttgtttcagcttgaatctgttacagtagacacaagcactacgaagaaatagacaaagttggttgaaaaaaagaggattatagcaaggaactggcaattcaatatgaccttgatgcccaggacagaatcgctcatccagaccacaagtcccacataagtttcttaaaaaggcaccgagtgctaagtcgtacaaacctcctgcaatgggatggcccaggttgtcaaatacttgtggattaacgacttgctttgcagaaagctttctaatttcctcagttgtaagaatctcaaaatcaacagagttaatttcggaccctactggtctcgcaatatccataacttgagtaattcagatggtggtgtttatccacaaactgtatgtgttttaggtaggtctaaaatttttctttttgcctagtcttttttttttttaggccttcacaaaattttctttcatgctggaaaaataaaatagagaaataacatgacagttacccgatcgagcgaaagtggctttatttgaaactcaagatgaagtgtttgacggagaagagaagaatagaaaatagtcattttgataactgagatgaacccaatttctagattacattgattagattgtctgagggcaggcaagttcacacccatcattcaattcagttgctggctccttaagctaaaacgaaattaagctagctatttgttatttcttttgccccacatggtaggcgcaagaagcagcaacctttgataaaatctgcagaacttctggacctacaattagcaactctttgtattcttcgttaccatcgtagaaccatctaccagcaaatctcaaagaaatggtgtttgaaggcattcacctaaacaatacatccgtacaccacacagatatttcttcaagaagattcatccattacacttggtaaacatacactcaagttgaaaaacaactgctatagcttaatactgactaatcttctacaaagcagaaatctttattatagcgatcaattgatatagcccaaagccctaacgactgagcaaacctctaaggtgcaatgtttggatttggaaaccaaaactcaaatacagttggaaagacgggtagcttgtttggaaacaatgcttcatcaagtacttttggagggccttcacaagtcaacaataatataggatttcagaatcctgctccagtaacatcaaatacttccaccaacttttcatttggaaacaggaatccttccaactccaatagtctatttggtggatctggaaaccagcaatccaacgctacatccggaggaatatttggaaccaacactacatcaggtggaggcttatttggtaatagtgcatccacgggatccaatccttctgttggtcttttcgggaacaaaggctccagtaacaataatgataataccggtagtttgttcggggtatcaaataataccactaaaagtggaggcttgttttcaaatgcaaattcagggctctcattgacgcaaggaaataacaaattgcaaagtacacagtcaaattccgtgaatggtaatgaaaatccatatggtcttgtgctgggctctctcttgtccacaaaggacatgccaaaatcgctaactagttcaaattcaccaactctttctcataggcaagaagctaacaatttgaaatttacttaccagccgcattcctccacctcaaaaagttcgattttagctaatcttgggaagtcttttcatgtcaccaattcttcaaaatcaagagttcagttcggcacttcaattcacaataaagatgatagacaaccagccaagagaaatgcggaacaaacctctgttcaacaaagctttcaatcaccaggtcatgatttcaagaggcttgtagtagctcgtattagcgatactccttcaaatttttatgaggtgaatttagacgatattctcagaaaacggagaaaattggctataaagcatgatgatacgatgtttcgaaaaacaattctttctcagaactttgatggcgaaaatcttccgcataaaccaagaaggatcgctactattacgtcggaagttgagagaaaagataacaaggcacagaacatcaaagaagatgggtactggtcctcgccaagtattgaggtattgtctcaactggacacagaagagcttgcatctgtcgagaacctcattattggcagaatcggttatggtcaagttgcatttgaacagccggttgacctgagagacttcaaatatgacctccaaggatcactatttggaaaggctgtcattttcaaacggaaagtgatacaggtatactcagactgggaggagaagccacagattggttctggtttgaatgttcctgctattattactcttgttatccattagatcctgttactaggaagccaaatactgacccctcaaatttggatatttcttctttcatcacgaagctcaaatccttcaatggaatgaattatatcagttacagtccaatttctggaacatgggtctttggggttgagcattttagtatttggggtatagttgaggaagatgatctagagattgaacctgatcttaagctgaagtttcaaaagcaacaggaagctgagaatcttaatgcaataaaaaacaaaaagtgccaaacaatcaattttttggaactaagtttcaccctgaggattctttggattctttagatcactataaatcacctctagaactaggtactgacaaccattctgacagtgatggattacttaataccacggaggatgagctgaatgagccaaatgagtttccggatggacttgtctctgttaaaccttacgaaccttctgtcgaagatgttgatctaaagctcatagatgtaacacctgactttcagacatccaaggactgggaaagacaatttgagctagcttttgatacacacagcgcattcagttactcatctaccaaaggtaatcaactgccaaacaatctgacgcacgcccgcctagatgctttgctttttggggatccggaaaaggctcaggcttataagacagaaattcaatccaacctaaagtttaacaacggttaccctcgctttattgaatggaccgatgatggtaagattcttaccaacaataatgacaacagtttcgttgccgagctggttgatgtttcctctcatttttcatttgaccacaataaagcaactgctcaggctttgcgaagcatgatctcgcattccaatataactacgaaagatggattacctcagtttacgaccaatgactctttcacttttgcagaattaaacaaaggtttctatacaacttccggtgtggagaaccttttgtggaacctttgctcaaatctttttgacaattgcaatcttgaggcgccaaagaaggtaattgataataaacgccgtgaagatttgattagttggcttcgggaaattaatggaatcgagattgagcgattaatgttagcttccaataatgatcctttagagaaagtatttgtccatgttgttggtggagatattgaatctgctatcatggaaagtgtcagacatggaaacaatcatttagcctctctaattacattattaggatcttttgattttgaggtgtgtcagctcgcaacagaacaactgagagactggtggagatcttcttcttggaagttgattccccagcctatattgaaaatttaccagcttctttctggaaggcttttggaagataatctggagttttttgttgattgctttgaggggctgtcatggtcactagccttgcagatgtttctaagttatggtgatctgaataagacattggcggaatctttagcacattttaattccgcctatacaaacgttccaagcaaagatattttttatagcatactgaaactttacagccaattgaatggtaccgagggggatcaattgaactcaatctattgttcgtttaatgatagcattcccaaaaagcttgatgctaaaattccctggttcatatatgaggtattgatccgttcgaagggtaagcgtgattgtttataccaaggcgatgtaattacgttagcttttgcggaacaattacatattagtgggcagattcaagagtctatttttgttttactacatttggagaatttcaaagagcttcagctcttaatagaagaggttataacaaagacgatcggaaatttgaaactgaaggaaggttcatcatcggcttttgaacgtaccttactagagacttatcacttgccgtcttatctgataggtagagcgtctgcgacttattacagttatagaggtgatcatttgaaccaggttacttcactgcttgccgctaattcgtccaatgaagctcacgacgttttgctaacttacgttgcacctaatgctataatacaagggggagaccagctcgctcagctctctaccattcttgctaagtttagagatcttgacgttgatagatggcatattgggggtgaagtatatcagatctacctgaaacttctcaatacctctgaagggaatgatgttcaagactacatggtagtattactggagcgcttaccccaaatggaaacccataatttcagtatgaaagttgctttagctatcatctcaaaagcaattggtcatatgattctaaaactgaagcctaatttggcgagagagaagctacttaatcttccgtttcaccctagtgatttaagctacttcaggaagagtgtaggccattagtaggattcgatagatctttagttagctgtattccaattagttctctacgtagagattatatcctgatatctatgttccattccctgttcttactgaggtgctagcactcttttgattaaatttatgacccttcgactgaatctcgcaaggcatccactacgtctaatattgcagttgaagcaggagaatcaggatagagatctaagaaagactctccattgtctgccgactttccaatgcgagggtccaacggaacagaacccaagaacggcaagccaagttcatctgcaagagctttgcctcctccagtagtaggcttaaatatttgaaattcattcttgcaaccgggacaaataaatccactcatattttcaacaataccaagaattttgatgttggccttcttgcagaaatcgatctcttttcgtacatctagtaacgcaacctcctgaggtgtggttactatcaatgcaccatcaattccggattccttcatataagttgtaacagataagtgctcgtctgatgttccaggtggcgtgtcaacgatcaaataatccagttttccccagttaacatcttttaggaactgtttaatcaaaccatttttcttggcacctctccatatgaccgccgaatcttggtcaggtaacataaaaccgacactcatcatacccaagttttcggtcacgtatacaggcgaccacccagagtttgacgaatgaacagattctagttctgagcccagcattttcggcaaagaagggccacaaatatccagatccattacgccaacttctaaatcttcatctgcggctaacgcccacgaaaggatgctactaaatgttgacttgcccacaccgcctttaccacttagaaccagtatcttgtgcgttatattgctcaaacggtcatttatgaagtctacatcggggtcaggacctttgggaatttgagatgagcatattgattggttggcacatcctgcacaagactcttcctttcctgcattctccgactcaggacctggacaatgttcaggttctggcgctgttaatgaggggtttggttttggaaccactatcatgtttagttcaaaaggaagaaatcttgaaagaatcactatagtttgatgagtaagcgaatcaacttaataccttatcaaggcataggctcgattttctgtcagcgatattttttcttttactcgaaattgaatcaacagctaggcgcgttcttctaacattacattcaactgaccaactcagattccatccactcacgcataagcaatatgactttggaagagctccccgctaaagctcaggttggaaatgatattaatcaagaattgaacactactgtggctactgcccacaactcagattacgatacttcccagtatgggacacctgcccccagagatcagaaatcctactttgttgaagattccaagttgaaatttgatgttgaggagacggctaaaagattcaattacttgttgggcttaacaggtctttttagacattttattgacaataaggccaaaggcgatcctaattttgctcaggtgttgcatttgttggagacgaagtacaaacatcacaggtccagaagcgatggaaagtattcagacaatagaagacgtaaaacagagaaggaagaggacgctgaattgattaatgagcaagacaaatcttcatttatggaattcactgagtctccaggatatgttaacggtaaacttagaccatatcaaattcaaggtttaaactggttggtacaactatatgaaaacaaactctctggaatactggccgacgaaatgggacttggtaagacgctacagacgatctcgtttttagggtacttaaggtatttaaagggtataaatgggcctcatttagtagtagtacccaaatccaccttagacaactgggccagagaattcaaacggtggactccagaggtgaaaactgttcttttacagggagataaggatcagaggacaaccataattcaggatgaattgatgacatgcaattttgacgtgctgatttccagttatgaaatagttattcgggagaaaagtagcctccgcaaattcaactgggactatattgtcatagatgaggcccaccgaattaagaatgaagaatctcttttatctcagatcataaggatgtttcattccaaaagccgattactaattaccggtactcctttacagaacaatttgcatgagctatgggctcttctcaactttatcttgccagatatctttagtgactctgacacttttgatcaatggtttgggagagggggtgatggcgatgaaaatgatgacaaatctgagaaaaatgaccagggtagtgtggtacagcaactacataaagtcttacagccttttctattacgaagaatcaaatcagacgtggagaaatctttacttccaaaaaaagaagttaatgtgtacgttggtatgtctgacatgcaacgacagtggtatcaaaaaattcttgagaaagatattgatgcagttgtctcttccagcggtaaaaaggagtctaagaccagactactaaatattgtcatgcagctgaggaaatgttgtaaccatccctacttatttgagggtgcagaaccgggccctcctttcactacggatgaacatttggttttcaacgcacagaaaatgaaggttttagataagttgctgaaacgaaagaaagaacaaggatctcgcgttctaatattttctcaaatgagccgaatgcttgatattctggaagattattgtaactttcgtgaatatggttactgtagaattgatggacaaactgatcacagcgatcgtattgatgccattgatgactacaataggaaggattctgataagtttgtgtttttgctgactacgcgagcaggtggactgggtattaatttgacatctgctgacacagttatactttatgattctgactggaaccctcaggctgatttacaggcaatggatagggctcatcgtatcggtcaaacaaagcaggtttatgtttaccgattagtcacagaaaatgcaatcgaagagaaagtattggaacgggctcagcaaaagcttcgattggatcagctagtgatacaacagggacgtaatattgaagacaagaagagcaatgccaccagtaaagacgaattgctatcaatgattcaacatggggctgcttctttgtttcagaaaggtagcgaggactcctccactggaggagacaaagcggaagactttgatattgatgacttattgagtaagtcagaggcaaaaacccaagaattgagtcaaaagtatagcaaactgggattagacgacctacaaaattttagcagtaatggcaattcggtctatgactgggatggtaagaactttcagaagaaggcattaggtcctaaactgaatttagatatgatacctcttgcggaacggaaaattaaaaaaaactacaacattgatgggtattacaaagatgtgttacaaacgggaactaaaatgggaaagaaagacgttttgaaaatacctagacagttgaatctttacgatcaccagttttatccagaatctttgtatgtactatgcgaactagaaaaagcgttgttcaagaaagaatcgaactacaaggttcctgaatcttcatcaaagtccgaagaggataggctgaacagagaattggaattatgggaagtagaacgtgctcgggaacttactgcggacgagattaaagacaagaatgaatacttgcaacaaggatttggcagctggaccaggaaagatttttttcattttatttctctgaccacaaaatatggtcggagaaacattaagacaattgctcaagaatttgaagataaaacctttgaagaagttttaacgtttgcaacacagttctggactcattatgatcagattgatggcatagaaagatatttggcccaaatcgaaactggagagttgaaaaacgttcgagtgaagatccagaaggagtgcttgagaagactgatggtcaaatttccaaatgtcattcaaggattgaaacttaaacagtccacaggaagcagcactaaacgcatattttcagaagaacaagaccgttacttgatcctacagatgttcctcatcggagtggaagcggaggatttggcagatgaaataaagaatcgtatatcacagtcggagtttttcaagtacgattatttttttcaaactcgcaatgcaatggaaatttccagaagatgcagtactttattgtctgcaattatgaaagagtttgaaaaaagttattctatgtatctacaggagaactctagaaaaaggaaaagaacggatgatgttgagagtgacgagctagaggaagaagacaacgaagatgacgaggatgatctggaggagatggatattgagaatgcagatgaagaagaggatgatgaataaggtcattcgagtgtatagcctacaaaatttagaagtatatcaaataataactataaagaagttaactacacacctatttctttaatagttcttcaatcttggactcgatcgatgagggcttagtcaaggacgaatatctctcaataacgtttccttgcttatcgatcaagaatttttcaaagttccacttaatacctttgaatccgaggagaccagacttttttgacttgagaaattcgtaaacaggatcagcttccgaaccgttgacatcaatcttttttagaattgggaaagttacaccaaaattcaactggcaaaactgtccaatttcttcatcatttcctggttcctgatgaccaaactggttacagggaaatccgacaatagtcaatccctcgtccttgtggtctttgtagagcttttccaactcggtatattgtggagtaaacccacacttagaagcaacattcacaatcaacaccactttgccttttaattgttcgaaaggaaaaggttcgcctttcttatctaatggggccagatcataaaatgaagacattgttcttatttgctttgaggaatgcgtgaagaagagaagatttcttagagcaaatggtctggttaagagtattcttgacattagtaattttcgaatctagaattcgaggctggtggcttaagaattcaattagtgagagatcttgtgatgctaaattaacgtagcatgacaaatacatttaacggattaccgaggaattggacaattaaaatatcaaaaactcatcaatctgagtatttctataacaaggaaacacaagaatcttcctgggagcccccttctggaactaacttagaagcactgggcgagtacatcaagaaacgccttcatgacccagaacaagttcggtgtgctcatcttctggtgaaacacaagaactctaggaaaccgagctcctggaaggagcctcagattacaagaactaaggaagaagcaattgaaaagcttagaggattccaaaaacagattcttgatggttctgccactttaggtcaactggctgctactgaaagtgattgctcctcacatgcccggaacggggatttgggcctttttgggagaaagacaatgcatccatcatttgaaagagctgcatttgcattacaagttggtgaaatatcagacatagtggaaagtgatagtggagtacatctcatcgaaagactaggatgagggacaaggattaatgatacgatgatcaaatggccccaatcattttcatgctgctatttcattctaattataagaggtacttaattattaccagattgaactagttacaatcgtgtaattgaaacggttatggagcttgtccattgtaatctatcatgcaagattgtttttatatgtttaatttatacaatctccctgactagtgacaactccagtcgcaaagcatcatagactgctatattctaggactaataaccttggattgaagatttacctattgactcttcatcttcatttcgcatccaattgatgatggaatcctcgcggattgaagggttttgctcatctccttctttcttaaccttttaccttccattttctactctttattagctttctttcatagctacatagtcagaagaggatgcgttttttggtctcatcctttcggcccttcagacatacaatttcgtcgcatatctcaatgggccaggctctgtctgccattcgtgtatttcataaaaattctcactcacgtacccaaggtttaaggcgccactctcactactgttgccaccgcaagatagatatgagtacttctactaaacttccagagcgtcaattgctaccagccaatgttaggcctaccaaatatgatttgacattggagcccttattttctaccttcaagtttaacggagaagagactatacatttagatgttcaggaggactccagttctattacgctacacgctctagacatcgatctccaagattcactattgataacttcaaacaagtctaagactcccccgcttcatgtgacaagcaatgatgatgaccaatcgctcacttttcaattcaaagagggtactctagtaaagggagataaggtgcagctgcagttgaaatttgttggtgaattgaatgataagatggccggtttttaccgctcttcatatgaagagaatggagaaactaaatatttggcaactacccagatggagccaacagattgtcgtcgtgctttcccttcctttgatgagccatcgctaaaagccgtattcaacattgccctcattgctgatcagaaacttacttgtctctcaaacatggacgtgaaagaggaacaatctctcggagatagaaggaagaaggtgatattcaatcccactccactaatttctacttacctaattgcttttattgttggtgatttaaaatatattgaagccgactataactatcgcattcctgtcagagtttatgccacccctggtttagagaagcagggtcgtttttctgtcgagcttgctgctaaaacattagaattctttgagcaacagtttgatattgattatcctcttccaaagatggacatggtggcgattcatgatttcagtgcaggagctatggaaaactttgggcttgttacctatagagttgttgatttgctgtacgatgaaaaaaattcaaatttggctactaagcaacgtgttgcagaagttgtccaacacgaattggcgcatcagtggtttggtaatcttgtcacaatggagtggtgggagggcctttggctgaatgaaggctttgctacatggatgtcttggtactcttgtgacaagtttttccctgattggaaagtatgggaacaatatgttacagattctttacaacaggctctggctctggacgctctacgtgcttctcaccctattgaagttcctgtgaaaagggccgacgagatcaatcaaatttttgacgcaatttcctattctaaaggatcctccttgctaaaaatgatctccaaatggctcggagaggatgtgttcattaagggagtctccagttatttaaaaaagcacaggtatggtaatacgaaaaccaccgatttgtgggaatcgctttctgaggtgtctggaaaagatgtggtcaaagttatgagtatctggactggtaaaattggatttccaatcatctcagtaactgaaaatgcaaaccgtatcacttttactcagaacagatatttaactactggtgatgtaactcctgaagaggatacgacgatttatcctgtttttttgggactcaaaacagaaagctcaactgatgagtcgctggtccttgactcaaggtcaatgtcagtagatatccagaattctgactttttcaaagttaatgctgaacaagccggtatttacaggaccaattatgcaccagagagatggatcaaacttggaaagcaacctcaccttctaagtgtagaagaccgtgctggtttggttgcggatgcgggcgctctggctagttctggtcactcatctacaaggaactttttgaaccttgtaaattcatggaaagatgagtctagctttgttgtctgggacgaaataacttcccgtgttgcagctttaaaagcagcttggttatttgaatcccaatctgacattgacgccctgaatgctttcgtaagagaccttatttctacgaagatcaaaagtatcggatggtcattcaatgataatgaaccattccttgaacaaagactaaagagccttctatatgctactgctgctggtgcaaaagtaccaggagtagttaaatcagcattgataaactttcaaaaatacgttgctggtgataagactgccattcaccctaacataaaggcagttacgtttcaaactgttgcggcccaaggatctgaaaaggaatgggatcagttactcgacatctacaagaaccctgtatctattgatgagaaaattattgctcttaggtctctcggaaggtttgaagatcccatcttgatcgcaaagaccctggcactgttatttgatggttccgtaaggtcacaagatatttacgtaccaatgcaaggccttcgtgcgactaagataggagtagagtcacttttcaagtggttgactcttaattgggacaagatttataaattgcttccacctggtctgtcaatgcttggttctgtggttactatcagtacttctgggttcacttccttggatgatcaaaagcgtgtcaaagatttctttgcatcaaaggataccaaaggcttcgaccagggtttggcccaggcgttagacaccatccaatccaaggcaagttgggtacaacgtgactctaggaatgtatccgattggctacgtgagcagggatacaaaaaatagtttaaagcatattttctatattacaatttatttatcatagttgtatattctttgcattaggattgattcctctcctcttcagatttctcttgaaggaagtttctattagctccttatcttcatccgagtcaaagtgagcaaagtcgtctttgataatgcctttctcagcaccttctgaacgcgcagctgcttccttctccttggcacctgccttagactcatcatgaatggaggaatgaatttttttgaatttggctacgaaaaatccatccacattataagtatgaggataatatcttctcgtaagatttacagagggatgatatttcatgcctctgtaggacgtaaaaccaggtttacctatcgtgagtcctgtgtcaactaacctcacatttggtctctttttcagagcatagttaacaactgcttcgttttcttctacagcaacagagcaggtagaatacacaatgatacctccagaacgagagttagcattgaccgaatcaattgctgatagtaaaagttgcctttgcaaataaggaatctgtataaagtccttttcggttctagcaactttgacattggagtctttggcgatgacaccagtgccagagcatggagcatctaaaagaaccctatcaaagccgccaataactttaggaaattccctagcatcataattggacacgacagtattcctacacccaagacgatgaatattggcaattaaagacttcgttcttgctttgtttgagtcgttggcgaatacgcaaccagtgtttttcatcatggcagaaataaatgttgtctttcctccaggagcagctgccatatctaagatacgttcgttctcttggggatccaaggccatgacgggaagaaacgatgaagctgcttgtaaaatgtaatgtccggcaagatattcaggggtggcaccaattggaacttgagagtcaaaaatttgcaggccaactttggtccactttccaatgggttgtaagttgacacccttattaaccagcttttgagcaagatctctacgacgagccttaagagtgttagttctaactgtgacgggtctggcaatctcgttggcctcaaaaaactcaattgcttccgatggagagaataaattaaataatttttcagccaagaatggtgtgtacccaaaataggtgcatatgtcttcgagaagttgatccacatactgcgatctactctttccctcttgagctagtatcttaaacttctctaaaaccttcacaatttctatcattctagtcctcacaacggtcaaatccggtggttgactcgcttctaattccttttcctcaggtgttggaagaacgatggctcggggttctggaacattagtttgaacaagctcttcttctgcctccaaagcttccaattcttgctcttcatccaatttacgagacaaagcctccatgttagtagcattcaattcctccaagtcatcatcttcgtcatcggaaaacattggcttctctctttcatcttcatcagagtccacaaactcatctgcatcaagcgcatcttggaagtcatcatcatcttcttcagcagaatcctcaaataaggatttctttgcagcattcaactcctctaagtcaacatgtggaagatcttgatcatcttcctcaatgtctaaattatctctggtgaccttcgtagatttctttttaggacttggggaagtttccttcttcggtttctttgaagctgagttttctatagctttagcccgtctagaacgtttggagtttctctccttctgaatgccgtgaaattcctcataagaaggaggcgctgattgtttgtccttagcttttcttcccattttctgcgatcacttagtattctagaattgatttttttttttattttatggaatttttttttcccttatgaatacctagacactaccattagacaagacactacctttctcaacgcaaaagacaagaaccatcaacaccttgaagccttccaactgaccccttgtccatttctcctgactgcggtaattttcatcaaaaaaatctgtttgtgaattccttcagaatttgaacatcgagacaatggcctggaattcaaagaaaagaaaggatgaccgatatgagtcctataaggattttgaggatgaagatgagttgaatgacgagacatttggcagtgatgtttatgttggtaaaaactttgatttttctggcggcaaaccaaaagcaaatgtgcctagcgccccagctcaacctccgaatatgttgtatgcccaggcagctcgaactccagtagaagatgtgttgaaaccaatggcttcgttgtggtcggaaccaagctctcaatccaaaccgcaacaacaagctccgtctcaacctacagagaaagtgttgtcattagaggaaatcgaggctcagcttttgggcgggtccgtttctacaggtcctgaagctcaacaatccccattttatggctatcctccgaacattcatcctgggcaaaatcagcagttcatgcagcaattccccaatggcgttcctcttggattcatggtgcctccatttaatcagtcatactatggaccccctgatggccagtatcagccctctactgttcaacatcagggcatttctcagatgcagccaccaccgcagggagtttctcaatcagttcagcccttcccagtttcccaactatctaactcggtacctcctcatgttatgcaaatgcctcaagtttcaaccgaaggctattctaacgcaggacctgaggggctagcccagactgattctcattcgcctacaaacgaaggccaattggataaagaacgtaaagccgagccacaggatactttgctggatgaagaacagcaacgtcctgtcgggtctactaaagaaagaaaaacttttgacttatcgagcttgccggctctcggatccgaggaagctcatcagagaagaattgcccttcagaggcagcatcaccaccctaccgagcccgttgagaactactcgaaatacgaaaaccgccagaatcatcagttgcgttctcaccatcgccatgaagatcgattttataaccttgatgatcctaacttgtcgcctaaggaacgagagcgtttagcaagaagaaaccataagctggagagaattctacgtggctccgggttcatgactcctaaggataaagactattgcactcaaagccaattgagtcagattgtgacagacgatccttataacgaagatttctactatcaggtttacaaagttctgaacaaccccaatgcgaacggggacacaaatgtaattgcacaaaaatatctcgaacagagtggtcacaaattaggtggtaaggaccaaagggttgatgttgcacttcaacggatgcagcatcaagtttcacttgcagttaccgttgttcggaatagaaatgctaagaaggccgaaaagagtaagagtgagcaacatccggtgtttggtaaaacaacttctgctacatcaaagaaacctagacaacaactcgatgttggcaagtctttgattgacagggtggccgaagggaaagaagatgatacttatgaagagcgagaaggatctgccaaagacattaccatcaagaaaacattatctcctattgaattgaagttctcaaaatccagtcaaacgtttcaactgtatttgattgaaaaaatatttgatgaaattttgaaactggaatctcaggagcgtgagggtgtcgacatcactgataattcactgtgggaagctttgaatttggagcccatgggcactcagcaaattaacaatgctgaagaaattccgtcttttatttcaatcctttactacgaaaagggtatgaagttgttcccacgtacgttccactttttgtccaacgagcatcgtcttatccttgtcaatttgatcttcaaccacttacaaaagctttatgttattttgaagggatcctacaagatatatgagagtaacgattatcaagttcctagtgagatcaacaactcaattgagcaattccagggtacagttttgaagtccttagtcctctttttatcagaggctaaatttcaagacattcttgaatcgcttatcgtactcttgaataacaacaacttattgtttctttgcactaccaaagttggactttcgattattaccattttgatttcacgactggaattgattaaacaggaattatctcagacgttaagtggagaagatttgtcaacatggagttcagtttatgataacttgttccaatctttggaaggacggttatcgtctatctttcctccaaaatcgaaccaacagctagcagacgactcacacgtttggcaatttttggcgtctttaactctggctggccgattgaaccatcaaaggattattgtgggagaagtccgaacacaaatcttcgatgtagttgaccaagtgaagaacctaagagccaccaacgatccagttaaggttgagaaatcaaatattcttttgtcaaatttgaaccttttcctcaacgtaatgggtttgaacgcaactgagaatgacatcactgaactaaaatcttaaggttgatttctattgtcacaggtaggaatctcgagaccttatctgtcctttattgacatggatcagattagacatcttggtgttgcaccatagtaaaaacaagagcaacctaatttcttgtttaccactctcaaattaccaggcctattccaaggaagtcattgattgagatgtagtataaattctacctgagttcaaagctgacaacttttgaataacagcttgcaagagaactatggactctttattttgccttgattgagaattgttgtgatatgacaggtgacggtgcataagatgcagatatatgcctagtcattgagacattatacgctgggacaattttgatgataggtgattagactggtatactaataggagcttaagtgtattgattgtttagttgaagacattattttaacagagaaggggagaaataagagttcagaacgagaataaaacaaagtgcttggcacacatccttgcttctaattttgttgcaaaatcgaaaagagtaagttttgaaaagtgtgtatctgttaatgattctatatacaagagaatactgataaaatatctattgtccctttctttgataccacatgtatgcacgtttatgaacgtcaacgggcaatggagtgattacctccgactcgccaggacgggaaactgggtctcgtaaatagacggcatggcaagtctcgaaagagatttcaagatgttggggtaaaactgcaaatggtgcaaggaatggcctgggcgtccatggagtgaagtatgctttggtagaatcttgacgcccaaacaaacctttctgccaaggaaaattcacttttaggcatttttcgccatgttctttaacttcttcccataaactaagattcttgtgtcgtctcaaagaatcagcccaagatgggtcatatgggagctcctttgcatcttcactaactttactctgctcaaattgttctctgatgtgttccaggtatttggtattgatctctgatagtagttgctttgttcttttttgtttgaattcgtcaatcggctccttatcagtgataaactttgtaacatgctctaaggtgttctcatcctcaggcaggttcagcaaattatgcttttcacctaaggtttgatatatttgaaataccttctctttcaaacctgagccaaacttactttcaaagacctcgggagtaatatctttcttagttcctcgcacaatgtcgataacgtcaacaagaatactttggcgtgtggtggactgctgttttagttgtctcctagcctggagtttgttgttgaattcacgaattttcttcacacgttccttatcatctgttgaaattaaattagactcaccgcgggattgtttcttcgcctgctgtcgttgccaaacctccaaaggactagctttactctctttgacaaacttgttccagcgggatatttgaatttgatcaactttgtaacttgtcttaagatcgggcttggcctttcccaacgcttctaagaccttgtcaggacgaacagaaaaaacatcgccgggcttaagttcataatttggatgacgcatcactaccccattaacagacacatacttgtgtattatatactgacgggcttgacgaacactacttgcgaacatggcgcggaacaatgccacgtctaaacgcttctccaaaactgcaaaagtttgtaacatcatgggtgtttcgtcagtattccccccttgcaacgaggcatccagttgagcaactccctgcagcttgggagaaaaaatatgctgccatttgctttctctaagatgttctccgtgataggctctagtctctgccttggagttccacttttgttgatacagtgactggccattgaagcctggcctctgttttttatagaggttgaacaaattgtatttgttcatagaagcacgcaggcggcctctggtaagagacttgagcagcactgctttgcgtggcataaaggcaggtgtcttacaaaagtaggtgttgaccaagtcctgaaaaaaatgctcgtcaaaatattcacataggagtagtgcttaattatacgcggttgtactcaaaactactttgacctcctgtccgactgaaagcctaataagcttttgttgacatccttataggatcctttgtcaatgaagagctggcagtttgatgaggaaatagctcttctccgtgcagcatgttacaatcgtcctgtaggaaaggacaaagccaagcatttggaggctttggtaaaggttttatctgatgctgggtatgcagtaaccgaaaaggatgcctgggataagttagcggagtactacgatttcaagcaattggaaaacttggatctatccgaccagtctccaaatgaagaggacattgcttcaagagatgtgtccaatgacgaggcacaaaacgaagacgagactgatgccaccggtgttggcgaacccgagcacatgttagaacgagaaggaacaccaagaactcgaacaagatcaactaagattgaaaaaactctcacaccaacaaccaagggccgtaagcgaatagataattcagacgaatctgacagatcggatagggagcggagtagaacgcccgtcaataaaggaattggatatagaacaagacggagaactcccaaagaccgtctaaaagatcaagatgatgttgacggcagcagtagaaactctaatgacgaagacacgaggaacaacgatagtgagctagatgatacagatacacccaaaagagtcactagagcgtcttctagaatatctagaagaactccacgcaaggacaaagacaccattaaagaccccaaagatacaacgagcaagaggcgaactcgggcaaggtaaattgctaatcaattaattctgtacacaaataccaaaaaagcattagcaatagtaattatcatttcgtagcgcttctaattgatccccaaaagctctacttcgaaaatcaaagtagcattaggggggatgatattggggaatccacgggatccataagctagtggacctggaatcgtcaatcttgcaatctctccaatagacagttttggaatggcctggtcccaaccctgaatcacctgaccaacaccaatgtaagtttggaatggctgattacgatctctggaggagtcaaacttctttccattttcaagagtaccgacgtaatgaattgtgactaggtctcccgtggaaggaaatgacttcccatctcctggactaatacgttcaatttttacttcttggttctgggacatactaaatgcacttgatataaaagttcttcggcaagtttgagttaaggttcttctaaacagagaggaggttaacatatatgtcagagagtggtggcgcggatggcaacctgctcgcaccttatagtacaagaaacacatcgattacataatctattatctattcatctatgttttcccctgtcttagagaacatcagaaaatctccatttgaggccgtacttaatcccagtgttgctaccaatatcgaaaggtagacttgatagactctatcatagaccaccagtcgcggaatcttaacgaatccatccacattatcctcgtttaagtctccaacaaaattaatctctactcttgtttttggagggacagtgaagtcgcgtgtgtgataggcatctcggaggtgaatgtcaacactatgaatgagtcttgtaatgaattggagagctacttctcctggattctcgatgatgtatttgacgatcaaggttgtctcacttattttcacgatgttgagcagcaaacgagggtctgatagcgttacgctttgttgacatactgcggacacaaactcgaattcacgactactactctcttcacagggtttaaactttagattgagttgtagctggagaggtaacactccctgagcagtaactaatctattggtggtaaaatgatggtaatatgtcacctgttgtctattttctagaatacgcccctggtatgccaagttcatgtcagaaccttcaggtaattttgcaaaagatgcattttcggtcaatgtggaaacattactttcacccagcattagactcttttcgcaagaattttgaatcttagattctaagcaccattttcttgtagattctgtgagtgtgaactcttggatcatgtggtctggtatttcagttttgatttcatagtttggcaaaggtaagatgtggaactggcaaagaaaaggattgattacctggaatggtatcttcttttgtaccaaagctccgtgatcgtgtaaaagaatcagatctaaagaactttcaccatctttggctggcgcggtgaatttaattgttctagacacctgccccaatggtgctagctcaatctgagaattagcatcagagagttttattatggagttattaacagaggcctcaactttgatcttcaactcttcattctcaagatttttataaaccacaaatgcatcatatttctgagaggaaaacaacggaccagtagtgtcaattgtcaattctacatctggaatcgtaggaacaatggtgacaacattcggagcattttcaacttgttcagcgttcaaagaaaattttatcgaaaaactaggctttaaagatatttctaatacaagcaattcaaaaccgactttcgttggttgatcaaaggtgaaacgaatagtttgaaaaaggtcatcactaaattcaaaaggtccagaaacaattttagcttctccaccagctttgcaataaatcgagttaatggttggatttagaaagtgctcacatttcaatgctggtttgattcttaagtaacatgcgattttttgtcctaaattagctactggtcgatcgaaccagacctccgcatttgctaaggggatatcagcatagttatactcaaaagttgtgcagtcgaatacagaccagtcgcaaaatttcaggagcgccgatacttgcttctccacgtacacaggctctattgtaagtagaatgagaaggtatttgagcccatcatgaggctttttcaattgtagagagcactggtacagcctccagaacacgacgctagtcaaatgatgccacttctctctctctaaagaaatcagggctaatttaaagttactcgaagacatggcataattattggtttgaaagtactcttcgcccagacgaaagtaaatggaaccttctatccttggaaacggaaccgaagagctagttagggatcgaacagctcgatttaaagattgaataatgtactcggaaatctgcagagacgtttcatctagctgaaggtactcatctttgatcggggtggagcctgtgtaaatgctctgcctgtatcgctgcttcatctttgcggctgaggtatacaggaatgcagtattgggaagtctcaaggaggatagtgtgtatttggtcatgccgcttttgagatacttcaaaggcgccaaggttctatccgtaggcacaagttctttgggacatttgtcacataattcagctaaccattgtaattgaattgttttccatgatagagtagatgacgcatcgggactgagataaaacctgttgagtattgacactacattttgtagatgaatgtcgaactttttgtaagctatattagcctccctgaggagcaaatatgctctgcaaatgtgaatggtgatgatatccagcaactggcgaaattgcatccaggatgaagaattgagggtgatacttttcatcaattctatgatattttcgtaaccatgttccaaaaacttgacacattgttgaaattgtgtcttgaactgctgaactatattcatcttaaaagaatgcctagccatcaatgccgtctctttgtaagctcctcggtatggaatctcagaaagaccagcattctgtttttttctcaaacgtttatccatagcattgtaaaaatccaagcaattgctttctacggacgtcaggatattggatacaaatgtaccacagtcatcaccagaagttctgtaaaattttacgtctttgatgctcatttgtatcacattaaccctattcacacccagtgttgagttttcatggagtataacaggaacaaatgaagttcttgaagctgcgaaaaagtccataataatgcgtaactcgtcaattaagattgaatcagactccgtggcatcctcttgcgattcaaacgactttagctcataaacaccaatgaaaactgccggtagcaggtgaagatatttgatcatccattctctactaatgatcccatctgggtaaagatcactttcatggtgaaaaggagacaatatagacggctcttcatgcacttcttttctaggaggaagctttaccgaattgccaacaaagcggatgcgatacttattaaacactcgtctttgagacttctgataaatgtcattgtcccagattccatcaacattgaacttgagtaattgggtttctagctcagccccaatgtgactactgttcacaactgggtaggatcttggaaccataagtccttgagaattagtcaattgaactatcttcgatcccaataatagtttaatttccgtatttgagccagtagaggccaccaacccctgtacgaatagaagtggtgccggttgagccaccatctcctggggataatgattcatacggtaggtatggttaaaggagtagttcccactgtaaactaattttgatcgcgatgaaacttagaaacgagtggatctggatataaatatttcatgtacaagtaactagctgctgagactatatatcatcacctattgtaaattcgtctaaaatctgctccttcgatgctctagcaactggccacctaaaggctgaacgtatatcttgtaaacttgtcaaacatgcatagcacatgtccacctcagagccggggttcattaccagcttcgaagcatcatcctctagtagacaagtttctgaatatattctaagattgtttatatcagcctcggtaactaccggggctggctcgttaacagtgatattttcaagccagtgtttagggtcacttgagagttggatatcacatacgatgcaccgcttgttgtgctcggttgaacgaagctggtctaatttagtaccaatcttaacaacggtagaaacgacttccgaataatctccttctatggagtcaaaataagatctagttaattcgttgacagtcattgatttgttaactttacttttcagcagatcagcggctttcttttgattcatcacgttaaatctttctagttgcaacatctctgaatagtgcaccacttccgatttaagtacatctcttagaggatgaataatatgaatctctgagccattatgtatctctactgcatcagtgagccttttgcctattaaagatgctcgtccccggactgttagggatattacttgatcagctaattttgtcatagaatgcccgaagagaatagtctggcaattaataaccaaacacgttcttattaacaattggtatatgaccatttccaatatatcttctctggaagatctgttaggagtttgatctaggatttctgtaatggtcagcttttttgtgtcttcactattattgccagttatgtagctttgaaaatcattatcaataagtatgcttccaacttgatcactatcaaggataaactgattgggatcgactattttgaacgatacatcgactggacagttgtggtcgataccataagcctctttcaattcttcgactttatcccgcacagaatagtcgctatctgagagggtcgactcgtcaactatcacaactttcaaatgaaatccttgccgccctctatgagttttagtctgttccagtaaaagattgaaaagtatatcaaaaagaactaaagaggaagaacccatacttaaagccaacatgacattttgagatacagattcaacgcctttttgaggatattgtactttgaatttatcttccatcatcaattttctctgttttcccctaataaaccttaaaaaacaatctttacaaaaatattccttacgagaaaagcagatgctgcccatattcttgcatctctgacaaatattttggctagtagagatcctctgagacgtggcatctgaatcggtaaatgccatgatcttgtagcagttcaatcaatgatgcctcaattttttctctttcctctcagattacgtaacattcatgatggtagatctcgtaaactatagaaacttgaaaggtggaatggaatgatgaggcaacctgaaaatacttctttgagcccaattctatgaaaaccattcattgtttttaagattcggattcggattaatcgttggtacaaacactaattccgagtttcaggtaaacaaatgttctagtggtcaacatggtgttccccagaatataaatctctcgaaactaagtttcattcttctaagaaatagtaggttttgcaatggatggagaggatagagatagtgacattttagataaggagaagataaattttacaaagggtagcaaagatcagttcaagtattatcctgacactccaacaagggaaaagctagaaagagcacttcttttgaaggaccctacaaaattctatgatccatgcgctgagtcggcaaaaatggcaacgagatgtatggaaaggcacgatcaagactacaaggaagtttgctacgaattctttcaagcataccgggagtgcaagaaagattggctcgaaatgaagaaaagattataaaaataagcaagttctctgtattatgttaataccgtttataggaataaagtgtctgtgcggtgctagtcgtaaactttacagtcttatctttgttgaagacatctctaagctcattgaacaagtcctgctcgctaatgtttaacgttgattttagtctcgtagaggaactaaatttcgagtcggatgttttgtcgtcgagtcgatgctttctagcctcctggtgtctattcgagtcaatcgtagaagagcaagatgtccactgagaatcattaaacgaatcagtgataggaatcttgaaatacaggtttcccaaaagacacggctgagctaaaagtgcaactatggaaatttcgttgactgcctgggctattagagggttgtcggtaggagaccgtttcacttgctttttaaggatatcgtagaacggcgctgggagccttagattacgagaggttagcagggaattcatgcaccaaaactctagctcgtccatccgaaaccttgaaaacctactggaaatggagctagggatggttagataaatatggcctgaacgacgatcaatagctgcatatgcgctaacaggctttttgcttactgcaccacattgcaacctccagtgcatgatgatatactctcgtttcaatttgaggcgacaatcagggcaaagcaaagacttgtaaacatcctcaattgatggaagggcattgaatggtggtagattgtataaattttctaatgctgttgtggtttcaaaaatatcgatgtgttgatttgggtgcctcactgaaaaaattaactgctctagtcgagttgtattcagatgcctattagatgcaagaaaatgattcaaaccttgagggttatcgtggaaatctgggtctatatacctaaactggctttcttcttctgattcagtttctgagccggtaaaagtttcagatgtgctggatgtatctttgttagccatacagtctactgatgcaccaactccacttgcctttgtgaatagaactgtagccctgtcaatcatatcagccaacgacttagctcctacgttctccctgaataatgtcttcaattcgtcctcaatggatttcaatagtttagagccacttgtgctacagtttcttctgacgctcaagtagttcctctttttggtgtcatactcccataaaaatgcggtttggtcaaagtctattgcttcgccaacaaatgatatactgccatttgcttcagagtggttcttgctgagaagaattacaccactgcataatcttttttggaatggtgagctcgtaaacttaattgtcaaaagaggatcgttctctgaacattcgttcttatacaaggtgccttgcttaatagaagtggtgagatagttgtgacaaagatccgaatcagatctaagactttgatatatctttcgaattccaaaatagatgccataaatttgtggccaatctgaacttagcaagttgggagaaaatagatggtcatggttgcttttcctatgttggcaaaaggatctggggtagaaatacttcaaacgttttcggttcaatcgtaaagagctagctttcttttgcccacttgcatccttggagtatagtgaagacggattcaaaataggttccttaattgatctctttttattagtaaattcttcccgtagaagcctgagcaatctatttaatgtatcatggcccaatttagaacactcatcatcacaagggtacacatcttcaggatcgtagtcatcagggtcaatagagtcttcctcaaactcttccatttctcgtacagttagcaaattctggccctgtcttcttatgtaaaaccgtaggaactctgagacagacatttcaaagggaagtccgcctgatagcgataagggtgaggcctaatggattgattagtaaacgatacttctttccaaatcactctattcgcggcctgcgtactcaattggtcatgtgccatgctagttacaatagcaaatagcttaaagactcgatgtgcgaaacccagttcttcctcgttggttttttattcaggaaatatcaacatttcacctcttcttcaagttagttccccggaatgtcagatcagtctttttggaattcgacagtcaaatttgtcagctctcataaagcggtcattacattgactacaatagcaggtgcttccaccttagcttacctttattacgccacaaatgccacttcgaaacctgattcttccgccactggctcctccaagaacaagaagaagaagagcaagaagcaaacagccccagaaacatcaaatgctgatgctccttacccagttgacaacgaaggcaaacctcaaatcaatgaggaaattattggccgcctaacagaagacgagaaaaacacctgggctcaatctttaaaggaaaccggaaaccgagcattcaagtcagacgactacgagaccgctctggaatactataatcttgccctgttgtgcaaaaaggatccagctttttattcaaatagctcagcttgttgggcctgtttgggagacaaccaaaaggttattgagttcagcactaaggcattggaattgaaaccggactatgcaaaatgcttgatgagaagagctgctgcttatgaaaagattgaagagtatgagaaagccctttatgatctaactgtcctaaccatctatgagagtaccattgctgataaatctatacagtccatgttagagcgtatattaaccaaacaagctaactatgttatggagaagcaattgaaagattttgtacctcaattaccttcagcttcttctattgcttcccttctgggttcttttactgaggattctgtttctgatgtctttggaaccgagattccagaggatggatctggtgacaaatttttgtatgaagctttgcaagattttaagactgccactgccgactcgtatgagcatgcggatgttgcgttgaaccaagctgtgtctaagtacgctgatgttactgtttctagcgatgagactacgaagagaagagctgctatggcctatgagtacctgggtcagttttatttccttaagaatgtgactgctgttgctcaagagcacttgaaaagagctatcgaattaagtccaagaccaagatctcatgttattttggctttgacttatattgataaggacttacttaacgaggccgaagtagagtttcaaaaggctatggccatcaacgccaatgatcccgacatctattaccagagaggacaacttagctacttgagaggagatcttgccaatgcatctgaaaactttgaaacatgcaaacgtctgaatcctaagaatgtttatgcttatattcaacttgcatgtatctcatatagagagggtaagatcgaagaagctgttgaaagatttgttcaagctaagaggacctttcctacttctcctgaagttccaaactactacggtgagattctggttgacaagaacgatacagaggatgctatcaaacagtttgatattgccattaaattgcaaaggtcactttcaacggtcagtattggagctcttggtatcctgaacaaggccacgattcttgctcgtaggaatgaattccctcaagctattgaattgctagaggaagctattcaagttgatcctaaatcagagttggcagccgttcaacttgctcaaattaagcttcaactcaaccaagccgaagaggcaattgttttgtttgagaagactgctaaacttgcaagatctccagaagagaagcaacatgctatctcctttgctgaagctgccaagatccaagcaagggtgaaaaaagatccagctcttagtaagagagttgaagaaataattgctcaagcccaaggtcaccagaatgaagctactgccgcttctgcttaacctcctcctatgtaaatagagttatatatgtatactgttaataatggttaacatagtttgacatacatagttcgcgattacatacttgacatactaagcatgaaatatgatactattcacaagttacgaacgagtagttgatggtagtacatgtcaaatagatttgtgcaggcagggcagatagattcagaaacatttcaaaaacaaattgaaagggaaaatgaagagtctgcaaagcatgctgaagaacaacgtcaaagagagggaaagactttagttcagcaactggagaagcacaagttggaaaaatatcaagaataccaacaacagctagaacataccaattctgcctacaggcttaatgaaaaagattctacgttttacaatgaactacaacgaaaacaaaaggagcaagaatccataaaggcccgctttctcgggcaacgagtagaagagtatcgaaagctaaaagatatgggtccaaacctaaatgcaatgcaacatttaaaggtctccagccttatcacttctgccaaaactaaacctacgcttaagaaaagaaagttagacaattcttcaagaggaaatatagtggggtacagtagttctgatgatgacgaggacgagaaagcccatgaagatatatgaccagaataatttactcagcttgttgtaactcgactgattgattcaatatgtagtggccacttttgaataccatcacgcgtcacagttcacgtttcaaaaattttacaaaattgaagttgatattttccagaagcgtacttcaaatacagggttttttgtagcatatattcttttttttttcagtgattgtattatttaactatggttagtactctcataagtcaccacatattgaagtattgaatccgtaagttagtaaattacaagttctgagcaagggttgatagtagcatagtctcattatatgtcgcgaacagtagctagaaaatataatagaatgaactgtatcgaatatcttccatttcaacttttcacctctttggacatgtttcacatattgtttaacaagaccccgatgacaggtcggatggctctttccgcctccacaatttcacattcttctccggtccttacaattactcgaaacttgctgaagactcaccgggcaacttataagagatggagaaaaacaggcaatggatacaagagaggtctctctggaagaaaacatggcaatgctgggtggtctaaccgagtgttgggaaagctggttggtacgtgtcaggcaacgtctagaggagcaggtaatcaaaaagctagattagctaaactcttgcccaatctatagggagtcgctacgtgtatatattagagacaatgaatgaagtcaattagtatttatgactgtattcagtttaattcaagacgaactggcccgtcctttgtaaaatctatttctatccatttgtcctcagcttcatctttccgaatcaccgacgttggaaaatagtgataattagttttcagtgttaatgctgaaggaatgttgtcaaatgagactagacgcaacttacaataagtgttgtctgggattccacgaacgacattgataaacgcttcaagatcaggagtctcttgctcatttacatgtgtcacaaattgtgtagaatttaaaccgtactgggtagctggtgatccttgatttctgctcatgatataaattgaggaaggcaaattcttcataacctggcgcacggactggtgagggggctgtaataacgcaccagaccaataaactagatgggatgtgttgaacttttccgtcgaaacggtgggaacggtcacctttataatttgtttttttcttagaatttcaacttgcagctcagtttgagtatacatgtcgtcaaggtcagccattttgttcacggcatgtccatttagagacaatacaatatcaccaacttttaaaggcgaagcttccattccaatggctggggtactggttcttaaaacggtaaaaaattgaggtctctcaacatcttttcgtgattctactctttcgatccatgcttctggaacccctctcaaccgggcttgaattacaggtaaagcgtaaaattcactatcaataatacgcaagtcagttaaatgcccttcgtttgctatgcatcgggacacaatttgattgatatgactggtatcgaatcccattccgaatacacgatcgtagccctcatcggtcaccgatcctagatatgttaaccataatgcacgtatagttccatcctcatcagcgagtacacctgagggtgcaggattggcaacacttgagtcaacttgaataccttcaaagttacatgccctataacggggactcaatggattgataggcacattcagtactggtatatcgctgacctttgtgatatctgaaacagctctcatattttgattgaatccaacaaagacgactttgtcaccccttttcagagggttcgaagaaaaattgggagtcaaaacgtcagcctccactaagcttgggtcatacttaacgattgcatagttgtgcaaaggatgcaaaaatttaacctttgcaggtacaatgatcgactcggcaacagtgacgaatacttcgatgagatcgtgtggtacgaccttacgtgaaatgatgacatatccattttcagcgctagcaattacaccatatcctcttgaggtattgtctttgtacccatccatcactaacgggaagtgagcagtaacaagtaccatactgtgacctagtttggaacaccccggtttctctgtgggaatatcaatgaatttagcatgcaagggtctcagtggtttgggaggtagaggtttttcttgaagattagtaaaatcccacaaaccagtctcatcgtttctagttgccagcctgaattcagagtaccagtgtcgatcaatgtacacaacgctttcttcaatagtatgaaggtcggaaatatgcctgaaactaatttgaactcgagagcagtcgggaatagacttgagaacctcgataaaggtatctaagtcgggtgtatctttgtgatctaaggagtcaattatccaaccacacctatctctcgtgtctaatgtgaagcttcctgatgctctattagcaaacacacctcttactggaatagcatacaagcgtgccatttggtaactaagatcattaaaggaggcaccacaaacttccaaatacctagctggagtgatcgcatgtaagtcattgacaggaatagtaaaatgaagatccttcccgtttctatcaaccactagttcgactgtttgtcctacagaagaatcaagtacttcatctactttgacaaatgaagagactagttcaccattaatggagatcaacgtatccccctctcttaaagacccatcggccggaccctctggaaggacaacttctgctacaagtaatccgtgaatagaaggaaacttatctcgcattgtcttctcattatcagaacgaatacccaatcttctacattcatcgaatggtctcaatatccattgaacttgtatggtgcctcttgaaattggctcaccgttttggatgcatctaagagcacgtaaagctctataaactggaaaaaaaaagtcagtagatgattccgtagatcctccagcttgaagagcaactgcatatccgtcgatgtccactactggggaaccagatgagcccccagttgcactggcagctgcctgaatatactcggtattaaaatcgttataagtaagtgatccatattcaggagcgttcctgtctaatctggaaataaaaccacttaaaattgacaacttttcaccagcgtcgtttcctaccactctaatttcgcacccgacttttgctaagtctggtctgagagttaattctgatactttcatatattttatgttcttgggttcaaactgtaatacaccaaaatcgtgcactggatctctgtaaataggcttcacatcacattcttcgtgattgtcaaacacagcatagcctacgaaaggtccgggtccaacaacatgtctattggttaagatgtatccattgacactatcgaccacaaatccagttgcttgactgaccactgcgtcttcagtatcaaaagacgccacctgacaaaagtgaatactaaccacagattgcacaaccttttctatagtagtttgccatgattggtttgaagagccatttgcaacgtaaggaatgctattcaatttaatttcttgttcatggtcactagtgttaaaattatcagaatcggaaagttcatcggtccgtcttttcttggagacatgttgtgtcatgtgagtagttactatatcaagcggagccaaagttaagacctccctgtaatgagtaacttgcaaatcttgatttggagtgaaaaaaaaaaaatcatttcgagcataccaatcttagcttatgtcatcatggtttttgaagtcgcgagccaatggttataatccaatctccaacttctacgaagttgtaacgtccatcacaaaatgttgagaagtttgctgaaagtacaagtaagagggttctcgtgtggccgtgttgtatcagctgccaagaataccaatattactcccgcaataaatgaaggccatacagacttagcaaaggagttggttagtggggctcccaaagaacttattaccgagagagtggccaggatttaccaagaagccaaagctgccacccagagtggtcagcacaatactgaaacgtggaaaatagactgggatatcctgaataaaggaaacagatgggaaaatgacttaatgggttaccagtcctcctctgactacatgcaaggaactatcttgaagtttgatactagagaaggagctatccgtttcgctaaaggacaaggctgggactactatattcaagaacccaaagttagacggtttgtaaagaaggattactctgccaacttttaccactctaaagggccattgaagcatatccgaactaagtagattgtttaaagaattactaattatggtaaacattggatatgtttgactactggatgaatgggaggttcactggttgtcagccctaacacctttggtggaatgagtaagtacaggtcgtaattctagacttgagtatcttccatatttggattacgtaatggaacaggtctgctctttcactgcaaatgctacgttcttccagaagaatcacagaggttatctcatattcgtcattagtggtttacttcgtctaatatctgtcacaattaagagtacaatctcattcaagaacttaagatttcaattaactagggggcgacatctatgaaagctaagaatgaaccgtgccctcattctagacaacttttttccacttctctattgaactcgcaagaaaactccgaagatatagagggtctggtagagaatataatacacaatgcccaaatagaggttcagcggcaaaatgagagatcttccaaacggggccatgactctcttttggatgatactgtgagtgaacctgattcaaacaaaaaacatagagtgaacggcctgattgatgctataaaccagtttcagagatctttagtcgaaaccactgaggaagaaattgtgcatagtcatgagactgaaagaaatgagaacactgcaggttcagttgattctgacaaccataaaaatgaaatcagcattcaagacgattatagagttactttccaagatattgaccgtcttcctaagttaaagaatgagacctttgaaaacaaagctcttcttcataaaaaactcgtatcgaatgattccagtgttcaaacgaatgactctctggtttatttgggttcaaagttttgtcattgcttagtcagtttcaaattgaatgaactacatccttcgctagatgctgagctgttagattgtgccgtgcaagaagttttacactttaacaatgtccatatttgggcgcttcgtttaaatttcagagagctactggaaagcaagttcccagcaaagcagttccgacccaaagtaatggcagagtgtttcatggcgtacgttgcggctctcaaaatcgagacggggtccgactataacctacttactttacttactcagtggatcttgaaacttgcttcagagaaaatttacaagttgcgggttgaaaacctcgttgacagatccgctaaggattctcttcataagttaatgggtcccatgagatacgctactgccttcaatggttcaaaatttatctctaaatgtctaaataacaaaggggaagttcttggacatggcagcggatacaacaagacggattctgaacttagatcggcgatgcatgcactctcttctactgcttgccaaaagaaatagtatacttagttaagaggattctcaaagtggaggattgtaagtttcgtgattatgtaattgttcaacgcgcattcttcttcagttttactatttaccagacttctattaggagggcaacgtttgatagcatctttagcaatatgtcgtataaccgttcttatcatgacggttatggacgagaacgtacctctaatatgaggccctcgtacaatgagtacagtgattgggatgatttctcttgggagaaggaagatccacattctagacgctatggctccagaccttcaagttacatctacaataaccctagaccaaatgcggacagaccaaatggttctataagaaaccacgtaaatcgaacagctcgagcacctagaaattcaactcaaggtctcaagtttcaacctatccctgaaaaatatcagaacataagctacaatgtggacatgtttccaagacaattgcatcatgttgatgaattcagaaagtttacaaactcgattgtatccacccaaaggaattttcgaatagtatatgatccagaagtgaagaaagataagaggaaaggaaacgcaatattaattaagaagcaagaagagtcagatcctaaagtattgatcgatcctcgtaaagagctaagcagttacccccatattcagcgatctgacggaacaaaatctgccaaaagaatgttcagaagccttttaccaacaaagcatacatatgattccgcatctgtgggtccacctcctacgatagaaatcataatccatggactatcaccttccactgctcaaacggttctaaaaaacaactacaaaaggtatggcccgattgcggattgtcgtgcggttgttgatcctgtcacggctgtaccactggggctatttgttttgtctttttcaggaaagattgacgaggcccacacatcatgtctcaaggccctgaatgctgcaaaagacggtgttcgtgtcaatgggggagttccaaggacaacgttgttttcggagtctcgtttgaacgaaattaaacataaaataataaaacagaacgagaacaagagacaggcagaagtttccgaacaacaacgattagaacaagaacggaaactgcaagaccaacgtcgattacagtatgaaaaagagcaagaattgaaaagacagcggggatccttaagaatcaagaagcaagaagaagaccaacagcgaataattagcaaacaattgttaaacaataccgaactttctaatatatttcactctgctatgaaagatgaatctcacaaccaaaccttgtacacaagaaacggtaataatggcagacatcatcgactctcgaaggtagttgatgatgccattagaaagcgaccgtatcttttcatctctgccaagtttatccctgttagggatgtacctgcaagagaaataatgaacctattgagaaattacccttggaaacgtgtgctgacagatgctgaaggcttttacgtcgtttttgatagtattaaagaagcggagaaatgcttggagaatgaagatggaaggaaattttatcaacgacgactgtacatggatttagtgatacaccctgacttcatggaggacaaaaccgaacttggagtagagcaaagtatttctgatcaatcaaccagcataatcagtagtgaactagaaagatacttgataaaagacattaaggataagataattgctccaactatcctggagatgttgagggccgagaatttctcggttgaaatagaatctgcactgaagaagaaaaaagatctggaagaaaaggtgtcagaaccttataccactgccacaacggtatcacctgtcactgacagttttacctctttcaagttaccaaccttaccatcgtttagaaagtcgaatatttccaagaaagaatcaagctcaaggaaaaaacagaaattgggaacgagaaaaaggtaccacgcattaccaatgactcatgtactgaactttgattcagaaggagagactgacgaacatgatagcggccctgaaactccaaatggggtactaatgtctatgggaccaaatagattattatcagagagaaaacagtcgtttatttcggattcttcaacatcagaagatgaatcagaagttgagcgggactcagaaatcaccaccccggaaaagcatcttggagaaaagagtaatgaacaagaattggctttagaaacttccgacgacaaggccgaactgaaaaacaactggatcatgtacgatcctaaatacagaccaaccacatttatacgtccagttggtgagctatatgatgccaaaaccattgacataccaaggttgaaaaaactcattgaggatgatgaggatctcaagctagcccaaaaattgttctctgatattaaccctgaccatagtattccttgcgttgcttattggatctggaacaatttgcgagcgtttacagaatcgtctaatttaccaaattctcttggtcctatgtacagtaatcagtctggctcattcaaaagtgagggatatacgaagatcccagatactgagaagtctgaatatttacctcaccgtcgaaagatccataaaccactgaacacggtagagaacgatgacgaggcagcaaatccgaacccaaaacttcagagttcccgtgttaacagagctaacaacaggcgctttgctgccgatatcaatgcccaaaaacaaatgctgaacagtgaaacagatattcttgacctcaatcatttgaccaaaagaaagaaaccggtatcttttgccagatctgctatccataattggggcttatatgcgctggaaccaattgctgcaaaggaaatgatcattgaatacgtgggcgaaatactgcgccagaaagtctcagaggtcagggagaagaagtatctcaaatctggtataggttctagttacttgtttcgggtcgatgaagatactgtcattgatgctaccaaaaaagggggaattgctcgatttatcaatcattgctgtcaacccagttgtacggcaaagattatcaaagtagaaggtaagaagaggatcgtcatctatgcactgaaggatattgcggccaacgaagaactcacctacgattacaagtttgaaagagaagataataatgaggagaggataccgtgcttatgtggtgtccctggatgtaagggttacttaaactaggaggtatagaggcaaataggtagtataaataataacaagcatacaccatatgtatgtctaaagcgcgtaagataactgtcattcgtgaaatttatcaatctctgataactttgcctgcagtacgataagtttctatcctctagcaaaacccatttcagaataactgctatgattaccaggcaatttcgtagtcatttactaagaggagctacatttgaatccttagtatcgtttggaacgtatgccgtacgttttaatgtcgaggaaagtgtgctcaccactatcaaacttgacgacatatcaattatcaaacctgtgaaaaagaaggcccagaaaaggcgtacatctcatagcaaaagatctttccaaataaatctgagtgatgtctcaactttggatgatcaaaattctaatgctccagttaaaacgtcactcgtaacagaaagaaaccatgaagtgaagttaactccactatactctcaggtgaaaacaaccattgatcaattcgaaactaatagtaagaagcacattgtgttgactcaggtgggatctttttacgagctatattttcagcatgcgataaagtatgcgcctgagttgaaccttacattgagttcaaaaaaaatcagggacatggagattccttttgcaggctttcctgatcatgctgtggataagtacttaaaaatgattttcgatttaggacatacggcggttatatgtaatcaaaccaacggattatacgaaaacaaaattcaaaggccagtaaacagattaataactccaggaacagttattgacgattcgttaagagactaccacaataataattatctactaaccattacatttccaaaggatccattgaaagaaattgatggagtcaatgtcggcctggcttgggctgatgttggcttaggaacattccatgttttggagacgactttatcgcagttgatgacccatgtttctcgtatatctccgtctgagatcctcataaacgaagaggttgatttagaaacattgatctcaggaaagtggtatccggagttagttgaatttaaacgatattttatcacaaggcaaaagcttccctctgcaagaaaaaaaatcaatagtttcttcaaaagatttgttgatcctgagcataatattaaagcagcgtatgacaattttaagcaaaaggaacaatcagctatgttatctcttttacattatttggatgagtgtattccaaattacaagactaatttttcatctccgactcggtccatttcgaataccttgatgcaaattgatcccaaaaccatgcttgatttggaactgattcaaactcgtcaaggtgggttcagaaccggtagtttagtttctattattgaccttaccttgacgcatgcaggttcaagacgattgaaatcttggttatctgctccctctgcagaactgtcaattattcaagaacgtctttccttggtggagctattcagatccaataggctactatctgaagaattaaggctactgatgaaggacacagcagatatcaaaagattgatgaggcgcataaataatggtaaagtggatcccatggagttagtattggtggccaggacgattctacaattgcaagacatggaatcattaatcagcgaacaatctccacatattcaaaaactacttttgcctctttatcaaactctttctgatgatggactacttgaaaaactgtctaaagaattgcttactgtcatcgatgttgaaaatctagggaaaaaaactgaaaataggctagatactaccgttatccgaaagtattggagcatcaccgaaaccgtttctccaaaactcgtaacactgagaaaacgctattccaggttggttaacaaatgtacacaattattagagacctatgaaagtgaattgaaggcaaacaacattaattacaagggtttgcatttactgaaagatgttcgatcaggtgaattcttattagaaattaagtcgactaatgccaatagtctagcgtcaaccgtttctattttcaaggataggctacgtgataaaaccagaagtagctgccgtttggtggatcctgagtggacggagttgggtacgaggttggttgaaaccgagtacttgatactaaaagaggaggaaacgattctcgagtctttcagggttcgattactagcgttaactaatgatattaggaatgcgtcgtatattatagagaaacaggatgtcttaatttcgttctctattcttgcccgtaacatgaatttgaacaagccccatatagatgaaagcctagagttagatgtggttgatggtaggcatattgttgtggaggaaggacttaagcaaaatttaggcgaaatacaagatttcaccgccaatgattgtcaacttgatacaaagaaaccaacatggataataacagggccaaatatgggaggtaagagcacttttttgaggcagaatgctctgatagttatactggcgcagataggttcctttgtgccagcttcaagtgctcgtattgggatcgttgataagatttttaccagaatcgggtcatcagacaacatttatagaaaccaaagcacgtttatggtggaaatgacggagactgcagcaattctgaaggagtcgactccaaggtcattggctatagttgacgaattgggaagaggtacctccatgagggaaggcattgccattgcatactcctgcctttttttttatctacaaggataaaatgtcgaactttgtttgctactcattatggagcagagcttgaagctttacttcttgaagacactgcatttatggaattgattgaattccaaagaacaagaatcatagaattggaaaagaacacatcacttcctatatcggaccgcatcatttttgatcaccgtcttaaaccaggaatcagcgcacattcctacggtttagaaattgctgaacttgctggatttccaagagagtcaatagaggtgggaaggatggtgatggacagatatgaagaaaatagatgaatagatgctatgattactggacaagcgatacataattgaagttcattgtaatattgattaattattccctggaggaggttgttttctttgattatacgggggtaagtgaccggttgtgtatctgctgttttgttgttgctgatggtttagttggctagctagctggttcattatctgaaattgcatttgtagttgcagtttcagctcagattcgctcatggacgccgtatcaagactcattccattctgaagagcttgtttattctgactgtgagtttgagtaattccatatggctggggaggataataagcctgctgtggtggagtttgatcataagcggaattcatttcaatattcttgagtgaaggttcatttggtgaataattttgaggatgtgtaagtgcaatactatggtcatgaggtacaaattgaggatgagacggttgttgcaagtgaagttgagattgagaagagattgatcgccgttctggagcgtgaattggacttgtgagttgaggttgactttgggattccaatagtgcatgtctttgagttgtggtaggaagaatttgctgctgcaccgacggatccactttagagttttgtggcaaactatacttgattggcaactgagtaaagttggtatatccgtttggtacttgattctgtctccttttcgcagatggctcgctagaattcttatcttcatccctggcagtcttattcttattcttgttctttttcttcttctttgactgtttaaatgctcgttccttctcgtcatcagagaattcttgttcttcttcggggatctcttcatcatgccaattactagcatcagttccctttacagattttattttctctgtatattgaaattctgattgcgggactagatagtaaactttagtgcccttcatatgtttgaaattttcaaattcttcaacggaattgtatttcaccctgtaaaaaggagtttccaactttccaaaaatttcaaataaaggacccagaatagttctatcttccaagcagagtacagaattttctttgagaactctgaattcacctgatgcgtacgccttgataaccacacttctttcgacacaagcgcttatttcaccaattaattctactggagtgccttcgtcaataactaaatctttgggcaattcaggagccttttcatccacaacttcatttttcgatctaatgggcccaattgctggggatgtttcatcttcggagtcatggattaggtcgttggcttcaaccgagtttaactctgtttcagattcggagtcagactctgactctgaatccagatccgaatcttgatctgagttggcactttcattactacttgattcaagatcaagagattcagaacaatcgtctgaggaataagaagggttgcttcctttaatgcccacaaatatccgatcatcactagttgtattacgttggaccatgttatcattgttttgaagaaggaatggttcaagatcgtccttgttttcatgagattcaatcgcaacgtctccttcttgctcttctttatggtgtacatcaagtatctctggcgctaattgaaataaatcctttacactttcatcggattttgttgaagcagtgtgcagactctctggtataagatttgctttcgtatctcgtttctcgtcttcaccaaaagctatcttgtctggctgacaaatatcattgtcactcattatggtcttatgctagcgtagaaagggacaaagatatccagaaaaaaaatatttcaggccaaattctgttcgcgaaccagaaatcttaatcttctgataagattctatgaggtctaataacgattacaattctatgttttctcaaaagttgtacagttcattttcaaagatagatgagtggctttgatcttgattcggtgatgagttgaaaacgtttatcaaataatttcgagatgtatctgatgatgatggaatgaaaagctcattattgaaagattcaagtttggcctgaatctcactgaactgttcagccttctgaaacttgtccacatgttccataaaaagtccttccttggaattatcataactgtccggattcagattttctttgttttctgagtttgtgacgaaaatgcttattctgctgtcttcggcactatgacgattcggaaaaatgtcaggaagataacagtctttgtctttaagaacagtttgatgttcatgttgattgtttttgattaaatgcctcaaagtcaaagactccaaagatctaggcgccatgttttcttctgcatcatagcttaaaacagcagctagttctgggtcttttttaaggtcttcagagtcagttgagagcatagatagcttgttcctgtacacgaaataattatcatttgcaaagttatagtttggctcggactcaattgttgttccctgtgaaaccttattgggtgaatcaagttgcagattttgaattggtgactcgatattaacgatgctgtccttaggagtttcgtcgcaatcaactgttgcgttcatgtgttttgcatgtgctattttgatttgctttgttttgcccgcaacctttgggttcagtttcatcttgactttcattttaggctgctcagaagtttcttttctttttcttcctctctttgttgttttcgtcccaggataagtcatagaatcacctgaggatatatttccggcaacaactctactgctattggtacaatttaggtattcattcacacaagacatgtggttaaaggtattaatttggtcatcctccctttcttttgtattacagctcataaacgcgcaagcaacggagtcaatactatcgaactgaaaagactcagctgtgttcgtatatattgagcaatcatcgatgcgcttttttgcctgtttgcattcatttcttgcagaagcttgttcgttgctagtttttgtattgggataattggaaggtgatcgtccccgaattatcaatggtggtgtctctataaaggctaatgtgacaaactcattgttctccaagcatgcaataagttccacataaagattaaaccttctggttgaagaagacggtttcctatagttaatcgatgaggcaaactggatgcgttcatatcgggcgactttgaaaatactgttgtcggggtacttattcaacccaggttccatagtcaaagattcctccctattatgataaaagagcttgttcaatcgctgaatttttccaacatttctaatattagcagcttctttgatcacttgatgagtaggcaaacttcctggaactgcgggatgaatgggtggttcaaattggggtcctctatccctctttgccgtatgttgtaccagtgaaatagatgttccatcttcggtacattttgaagtcaaccttaatgcaaagtacattattacgagattgttgttctcctggtctattgtgtggtatgttgcattggtgaattcctcaaagccgtagttctcaaactggaatgctgcaacaagagtaaagtagttgcgcttatatccgatccactcgttgtttagaaattcaaagcctcggtctattcttccttctatcttggggattattaatctaccaccgttggaatatattggccttacaaggaatgtccgtgtaaactgtggtccaactttgaactgcaaacttgaccttggagcaactttaacctttgattttgaatgatgatctgcgaaatgttgcgttgggttttcatcatatgaccgttggggaactggtccatattgctgaccttctatagattcttgtcgactagtagacatagtcgcatctatttttcctctaatatttaatctgttgagctcattgtccgcaggcgtttggttgaacttgtcggattcttttctgatcttctttggatcttgcctagtatctctcctacatggaagtggtttattttgagcattgttttcaatttcatacacgttgtcattctcttttcctaattcgaattcttctgggcctcggaagtcaagcgatgtgattagttcagtttccaattcactacttgggtttcgtaaacctggatccaaaacccgttgcggttctcttttcatttccaactggctacctttatttggttagtaaattcagtacatgattgaggttggctctgatcaaaaggttgcacatgctcccgtaatctgatttctttgtgctaaataaaggcccctcagctgttcttttcgttgcctagccgccgttctttaaaagtgaacgatcacaaagaagacagataatactggggaacatacaacatttcccgatgttgtgcaggaagagaaataagcattctacgtcagacacttagagagttgcataatgcaggtctttaacttcgattatgacaaattcaataattttgcctctcaatatctaaattgacgttccgcaatttactagacaggtgaataacgtcattgtgctgaacaagacgctgttggttcagttctctattgtggaggatacgggaactgacaaagaaagtctctgttatgtcagccgacaatctgctccaatggaacacccgtatagcagctcaggatttgcacttgtgcaaagtccagttttgtttggtcccaaacataaccaacaatacgaacagccatacccaaaaaatgaagtacttccagttgaataccttcctcccggtgtttccacaaattgagagtataccttgtttgtctacatatttgcaagggctatcgcttgtgaagactctaaagaggagtagattttgagtagatctacaatctgggagagagatctcaaacattatgcaactccttccaagtcttcaaaaactacaatgtaattcacaaaacaacgaacacaacaccaacgaagacggatcccaaatagcaactcactgaatcagtattcattaagcagcgctactaattacgctccaataacgaatgtattccagcacttttttagtaacaaaacgcacgtatgaggtaaagtctctctcccttcctcttcaaagcttacctaataatatttcactggtggtgctcggatgtgcatcttaaaggaaaaaaaataaagtacagttcaaaaattttcattttcctgcttggaatatatcaataatatgggaaagaaagctatagattctagaatcccggctctaattagaaatggggttcaagaaaagcaaagaagctttttctttattgttggtgataaggcaagaaaccagcttcccaatttgcattatttgatgatgagtgcagacttgaagatgaacaaatcagtgttatgggcctacaagaagaaactgctaggattcacatctcatagaaaaaagagagaagcaaaaataaagaaggacatcaaacgtggcacaagagaagctaatgatatggatccttttgaagctttcatttccaaccaacagatcagatatgtttactacaaggagacagataaaattctcggaaacacatacggaatgtgtattcttcaagattttgaaggcattacacctaatttgcttgctagaacaattgaaactgtggaaggcggaggtatcgtggtaatattgcttaaatctatgtcttctttgaagcagttatatacaatgacgatggatatccattctcgttacagaacggaagctcacaatgatgttgtagctcgattcaatgaacgatttttactttctttaggctcatgtgccaattgtctcgtggtggatgacgaattgaatgttctccccattagtggggctaagaatgttaaagctctacctccaaacgaagatgatgagttgactcctaaagcgcaagagttgaaggatcttaaggaaagtcttgccgatgtgcaacccgctgggtctttggttgctctctccaaaacagtgaatcaagctcaggccatattaactttcatagatgccatttctgaaaaaactttaaaaagcaccgtcactttaacagctggaagaggaagaggaaagtctgctgctttgggtgttgccattgcagctgcgatttcccatggttatactaacatttttgttacttctccttctccagagaatctgaaaaccttatttgaatttattttcaagggttttgatgctctgggatacacagaacacatggactacgacattatccaatcaacaaacccatcattcaacaaggccgtagttagagttgatgttcatagagaacatcgtcaaaccatccagtacattcaaccttctgatagtcatgtattaggccaagctgagttattgatcattgacgaggcagccgctatcccattgccgttggtcaagagattattgggtccgtatcttgtatttatggcttcaaccatcaacggttatgaaggtactggtagatctttatcattgaaactaattcaacaattaagagaacaatcgtctggtgttggaagggaaaacagtcagaccgagattgtctctagggacaacaaaaaaattgactcagatttccatggtagaacgttgcgggaagtcactctagatgaaccgattagatatgcaccgggtgacgctgttgaaaaatggttgaacaaactgctttgtctagatgtcaccttaaccaaaagtgccaaatttgcgaccaagggcaccccacatccttcgcagtgtaatttgttctacgtgaacagagatacattattctcctatcatccagtttctgaagcctttttgcaaaagatgatggctctttacgttgcatctcactataaaaattcacctaatgacttgcaactgatgtcagatgcccctgctcatcagttatatgtcttactgccacccatcgacgaacatgataataagatacctgacccactctgtgtcgttcaacttgcgttagagggagagatcagcaaagaaagcgtgaagaacagccttaatcgtggtgtaagagctggcggagaccttatcccttggttagtttctcagcagtttcaagacgaagagtttgcttccttgagtggtgctagagtggtgcgtattgccactaaccctgagtacacttcaatgggatatggaactcgtgcattagagcttctcaaagattattttgaaggaaagtttgctgatattagtgagagttcttcttttgacgacgaaagtaagtattctataaagagaattggtgatcatgaattagagacagcttcattgaaagatgaaatcaaatcaagagatgcaaaaagtttacccccattgctgctaaaattgtcagagaagcctccttatttcctgcactatttgggggtttcctatggattaacaaactctctacacaaattttggaagaatgctggctttaagcccgtttaccttagacagacagcaaacgatttgaccggcgagcatacttgtgtcatgttgaagactctggaaaacagagaatccaaatggctggacgaattcacagcagactttcataaaagatttatcaacttgctgtcttataatttcagcaagtttactgctgtggaggcgttgaatataatagaaagcaccaaatctaactacagaaagcaaatactcggcaactctgagctaaatcagtatctaacaccatttgatttgaaaagactggaatcttacgccaacaacttagtagattatcatgtgattgtggatttgttgccgtatatttcgcagttattcttccagcacaagattgagggtgtcaagctgtcatcagtgcaaagtgcaatccttttagctattggattgcagcacaaagacattgatgaaatttctagagaactgaacttgccatccaatcagtctttagccatgtttgcaaagattgtacgtaaagtgtcgacatacttcagggaactgctggcaaagacgatagaggaccaaatgccagagttcgaggatgaagctgtgggtgatatgaatggagaaaatgaatacggcaaaggagttgaggccattgagagagagttagagatcgatttggacgacgcaggcgacgaggcaatgaaggagcttagagaaaaacagaaggaattgatcaactcattggaattgaataagtatgccattgacagtggtgttcattggacttccgataagaaggctatcgaaaaagcagttgaaggacgcggtgttgtaagcttgcaaaacgacaacaagaaaagaaagaaggaaaacgcaaatcaaatttttgaagaggaaatgagccagctaacaaaagggtcttccaagggtgcctcaaaacctccttcgaaaggctttaataagaaaaggaagagcaactttaagaagtagcagcatttagataaccatccacctctatatacctaaagtaatacatctatcatataatgactgaagcacgtcttgttgcagctgtttgaaacttcctccatcatcgttttggaaagccatgattcctagttgttctgttgcaaaagcatttagcgttccaccattggcttttaccaagtgctctggttcattaaaaagatctttgtggaaattatagtaacctggccatacaaaacgatcaaaataccctggagggtcttcccagaaacccccaatggtgttatatccctgccttctcgcccttctttccttcaatgttgagtaggatgtctttatcatcaatttgatgtcaaagagaccttctagctctcctctatggtacatcataaaaccatccactagtacaaactttgtatcactgaacttttcgaatagtttggagaagtgtctcacaacctcttgatctgctccaaatttatcatctcctggcaactccaaactatcaactttgtagacaaacgaaggatcattctgaagattgtgcagtaccgacttaaacttaacaaaatctatagcatccggagagtcccagttttgggctttgtgtttaggatcatagggaatttcctcgtttggtctgtagaagtcatcttggtgaattagtaggcaattgggcaagaccaaacttattatccgggcgatcgtctaaagattgaggttagcaaatatattctttcgtgtccagtcatttttacttttcataccgttttgccggaactagaagatccgctaatacctattatcaccactttttgggtcattctacgaaaaagtctagacacacttatcactcactatattgtcttctgattaacagcacaatcaggcgcgaagtctcgatgtttgatgtccccattgactagtgtatgtaaatgaggaaaatcattattagtaagagaatcacatatttgttcaagagaagaatgactgatcttataaacgcagcaccaaaggtgctgaatgtcgaccaattaccaacaagagaaggcaaagaagatagaatagagcagtctggatatttaccaggcttattgtctctatctgtattcaatgtgccctttacagaaaaatcatcccctggttcaactccagctttatctgactcatcattacaatcagatgatgaagaatttgagtctgtcgatgctttggagatatacgacttaatttcctcgatttcagatcctgaacatcctttgactttaggacaactagccgtagtcaatttagaagacatacaacttgatgactcgggaaatccaaatgaaattgcagaagttataatcaaaataactcctacaatcactcattgctccttggccacgctaattggcttagggataagagttcgtttagaaagatgtctgcctccgaggtaccgtataatcattaaggtaaaggaaaagacgcaccaaagtgaaaatcaagtgaacaaacaacttaatgacaaagagcgtgtaagcgctgcatgtgaaaatgatcagcttttgaaagtgatcagccagatgctttcctcctgtaagtagacttctctatgagctagcagttacagagctcattcacgtttcgcctgcggctggactcccttccaggttttccgggagttcattgctgctacccacgcgcacttttttttttgatccttctccttcttcaaagtaatttaagccaaccatgggtgttttcatcccccactcaaagttgcacacactcaaagagtataagtatcagagcgatgaccgatctatcacaacgaagtactttttgaagcctttttggacccaatttgtcaagatttttccattatggatggctcccaacatggtcaccttgtctgggctttttttcatccttttgaacctggtcaccgtgttgatctatgatccatatctagataatgccgaaaagccaagttggatctatttctcatatgctctaggtttatttttgtaccagacttttgacgcatgtgatgggatgcaggcccgcagaactgggcagagcgggcccctgggggagctttttgaccattgtatcgatgctctcaacacttctctgtcatgtattgtatttggttcgacgattacctgcggctggggttggctgctggtggtcagtcagtttgcgactttgatgaatttctatatgagtacctgggaagaataccacactcacgttctgtttttgagtgaattttcgggtcctgttgaaggaatattgattttgatcggtgtttatatattcactggattcaaaggcgctcacgtatggaaagatcctgtgatttatttgaaccttgaaaagttgaacatgggaagcgagtttccactgacggttactaaattgttctcatttattggtgctattggattactattcaacatttactcagcaagaagaaatgcattggctaaattgagtgaaccatctcaccagaaggaagcaagcaaaggattgataccatttttctttttttatacgtcagtgttcgtccaagttttcctttacaaggatgtgattctacctggcgcagggctgccactggtgttgtccatcggtttgactatggcattttccgtaggaagaattattgttgcccatctaacgaagcaagatttcccaatgtgtcaacctccaatgttcattcccattggtgagattattctaactgagcttctgacaagggtatttgattttgatcgattttctgtagcaaacaacctacaatggaccggattcggattatccctaggaattcacgctctgtttgttacagagattatttacgagatcaccggctaccttgatatctgggctttgaccatcaagcataaaaaagttgattaaaaagcttgttcattctccttatatcattatatacataacatagatatcatttattctaggcggatgattgtggttgacccggttgctggaaggcttgttctgatcctggagctaaaacttcgttagaagtttgttgcaaggtaaactccttctccatctctttcaattgctgttcggataaaattgaaagcgacaaagggactcccagtaacagagctgaggaggtcacaacccataacagtgacccgctcttagaaaataatgaagataaagtagatgataagctggatccaaacgaggccaatgatgatctttgagtaggggggattatatcttttaaagccacgattctttcataaatggtttcgtcttgaaagaattcatcgtcgtcttcagaatctgaagccgatgtatcagtataatcatcatcattttcctgtggtactacttgtggagctttctcctcgataatctgttcgtcttcaacttgagttaattggaccatggttggttgattggttgattggttggttaaatgattgattgcgaggttgacgagggaaagattttcaaagttacattgtgtgtcacgtgtgctgtcacgtgataaagtaggtatcatgcaattcaacttcgttgattcggaactactgatgatgagacacggaacaggggaaaaaatgcattctcttcctagagtgatttaactttttgtttcctatttaccattgatggagatggtgcaattgttattccgaactcttacgtgtgaattttcaaacccttaacttcgcaacgtttttcggcaaagcactcgttccagcatgtgactacggtgaattgacaaactccgagaaagttgattgctgagaggagtcttcagttactacaccaaaagtgccttgtaacttaatctacttatggttctgactctgactatgataagggactatctaggttgatctattggcatcaagtattcttgttaaaaactcgtgactttcttcggtttggcggtaggaagacaggtcacctcttgatgagggtcgcgcaacatttcttaatgaatgaggtaccaactggagcttcttgtgtataaatagaggtacaatccccttaattaatcttttgcctgtgaatttctagaacgatggatgaagtagataccgctcttgttgataacgtcaagtcctttgctgccggcgggttcggtggtatttgtgctgttttaactggccatccttttgacctggttaaggtcagacttcaaactggggtttacaattctgccattgaatgcgtaaaacagtccctgaagaaagatggacctctaggtttataccgtggtgtacttcctccattggtaggtgttaccccaatgtttgctgtcagtttttggggttacgatgtggggaaaaagattgtggcctacacatcaaagaaatctatcaacgatccattaaccattgcggaaacaagtgctgctggttttatttcagccgttccaactacggccattgctgccccatttgagagggttaaggttgtcatgcaaatcgataaaacaaagtctggaatgttccaaactgtcgctaagatctacagggaaggtggcttgaagtcggtcttcaagggttcgttagccacacttgcccgtgatggtcctggaagtgcactgtacttcgctacttacgaatacctaaaacgtacatggtcaaagccaggcgaagacctctctctcggtgccattacaatggcaggaggttttgctggtgtttcgatgtggctgggagtgttccctattgacactatcaaatcacagcaacaatcatctagtgtgaaaatgtcaattgctgaagtcactaagagaatatatgctaaaggtggggttaaggcatttttccctggtgttggtcctgcattagctcgtagtttccctgccaacgccgctaccttcttgggtgttgaactcttcagagacttcctagacaaagccatataatttatacaaattgatactttcaactttccaagaccagcccaaagaatctcagttccatgtcatcgtctctgataagatcatctgttaatactcgtagcttttgactaaatggttcaataatttcggtttgtagagtgttagttagggttgaaagtctatgctgtgaaactttatagtattcttcatcttgtgtattcagtagttcgacaatattgtgagatatttcctggttaacaatgacaaattttgccacaaactccgttaaattattaagttgatggatgaagtaatgtcctgatatgttccccttagagaagtctcctttagtgttaacaaacttatgcctcgatatagacgaaatataattcctgtgcagttctacgaattcgtccaaatcataaatggcatgggacttgttcgacgttgaagcaggagaaaaagacacactggcggtctctagatattcatcatctggtagtaagacaccactccaagaagtttcgttatgctcgtctctttttccgtcaaacaatcgttgaagtttttggtaattggtatcaattattagaagtttgaagaacgatatgactttatcactgaacttgatgaaaatattacgaatgacgttcactttacggagcagccggtctaccattagtagtttccgatcatgaagagacaaaggaaaagatttgtcttctcttcttagcacttttagctgctgtagatccttatagaagctatgcaaaagtcctttctttaaaaatgacattgctttccagccttcccgcagctcaaagtttaaagcatgcaaacgccaaagaaaattaaacattcgtaggtattcttttaaatctcctagaattgttgacagtggaccatcaataacgtaatctaaagtaaacgattcccatccacgtctttgatcaagatccaacaatcgtgcatctaaaccctggatgtattcttcttcaatttccgacaaagaaatacatttctgtaatagttcagctaaatcccttgaagtgatcgaggccacatttctatctagcataatcttaccacatgacattagtgactcgatgaactctccatttcctgccaataaaaatccatgcagaatttgtagataccgctgaaatttcaattcattgtaaacaacatgcgaaaggtgctcagaaacttgctggtactgatagtttatgaacgatttgaaatcagtagtatttatctcccctgagaataaggaatgaagcttgttagtatactgattgacccactgtaaatccctaacgtcccgtttgagaaatataatcattttgccaatttgaaatattttctcacaaagatcgggatcaataaaagctggcaatttttctttatccagtactaagtcaagcttgtcttcattccatggatcaggccgagtcaaaacaaagagaccttccgcttgatatttactaatattgaattcttcttgcgccagccaatctcttattagctgatagtaaggtgcggcagatatcctgaaaacttcggaggctagatccgaaatcagaatgtccccaaacttcgtaaattcttgcaactgggataagaacgcgtgagtctctaaattcaagaatcttgtaaagttgtaaaatgtccttaaacggatcgtttcatcctttaactcgaagtagattgtggcaagtgtcaattcatcaatcttcaagaaaaggttgtttatgatcttagtgtatttttttaattcccttgatacctggctcaaaaaagccactttcgcctgcgaaatgtggtgagaatgaagttcattatcgtgtactaatttactcagataccggtaaagtagagctggttcaactatcttatgaagtatccgagccattccatggttcagttctgacggcagttgtattccatcctcgattaaaggaaacatttcggaggtattaccaagcaaagtgaactggagatattgtatcaactggaattcttctaagactctgcccgtacagtactgttgaattactgccgccaacggttgtatcgtcttcgtattgactcgtttgtttggtttattagtatactgggcattaggctctttcatctctgtgctttcatcaattaagctcttgtctctatcactgaacgacgttttatgaaatctataaggggaagtgtcatccaatatcaaatcactgttatgttcttgagtgtctgttaagttcaacgcttgaagcatttttgataaatacgaagccaaaacttcctgtttttctattttcaaaatactgtttactatgtgctgaaattggttccacttgccaatttctctttgcttgtagacgagtctttctcggaattgatccattagtcggttgaaatcatcaatgtcaattgactgagggacaggaattctgctatcctcagcaaaaattttgtccactgctagggtgcctagactacagcaatcagcaagccgttccaaaaaaccctctgttttggggtcttgaaatggcataggcatgatgtgtttgaaaggtatataatgtacacaaatgatatgaaaacgcgccggtcaactttagatggtagatgctcgatgtccgtttaaaatgaatactattgaggctatcgaagtatggctgctagaaaacctactattgaaacataaagtatcggtcctaccagaactgaaagacttatatgaaataataattcttaaaaacgcaatagaaaagtactcttacaactttgaggggtcatcataactcacattctaacccatgtgactcaagtctgctgagtagtgttcagagttatagaattgaatcagagctctcagagcatactcctgtccaacactggcgttgtatctttcctccggagttaaaattgaaaggtttattgggtttaaccagctatctcgtagttggatcttgtaataaagataaacgtaggatattaaatccatattattagacttccatttcttcccattatatggggtaagggtttttatgattttgaggatgggcttgtagagatttatgttgtaaaacgaaagatagaatctcatgatctctgtattcttttcatccaaaagcttgtacattctttgcatcttgtctttacttatgaccaggtaacgcgttttcagcaaattggcgataatcaatgtataccgctcattgatgactttgaacttccttctatcaattctgtgggcgggcaaatctaataaaaaatcaaagtcggtatcaaaggggccgggttttctattactaggattgtccatagatgcaatgttttcgctgtgttccgtagtcactagatcttgattaacagtatctgaaaggctcaaacacttgaggtaaaaactatgttcttgctggcagtccagcttaccgtattcacagttgactaaaaaggaaaaatcataaatggtgcttgagtctacactatccgagccctttcttatttgacactgttctaaatcaattccgaggtaatcaataaagtaagagtggaaatcattgtcaaataacaacattgataggtactcaaatttcaaaacatgagaagctttgagaaatttcagaaggagaaacacggttgaagaaattgacttgagtgttatttctttagccttccaaatggaaagttttcgtaaagtgtttacagagcttccatcgatgtgcctctttctgtatatatttgagtccaaaatctgacagtaaaccgagactagagatgagaggctgggaagacattccttgtaaaagctctctatgcgctgcaggacttcaatctggtggatatacgtgggatacttcattttgtcttcatcgttgtagagaaaactattaggcagttcttctcttacggggtcctgtggatgttctgcatttaagcgattctctttttttatgtattgatcgaaagatgacatgaattgcttgaagtgaaatccctctttgatatggttatgaaatattgtgtctgcttgtttaatgctgtaaggaacgtcagtgtaggggtatacatttgggaatgagggatttgctgtgaacattcttctgtctttcttgccaagcatgttatcatgctggggagcaagtttgggagatggagcaggagtgacaatgtgaacttcaggcacttggttgctacttgaaacagatcttgtcttggattcaagaaaatcagtaaccaaaagtgaacttatagaatggttactactcgatctagacaaaacagactcttggacatcgatcgttgcctgaacaacctcaggaaggtagtgttcctccagtggttgatataaagcatatctatgaataaattctttgctgtaatggtaatactccaggggtgttatgcttcggttcttggaatcttgtacttgaatggtattctcgtgctttaacttcaaaaattctttgataagtctgtactcttccattgtaccaaattcgaccagcaagagcttattaataaccataacataattacgaatttgtaggctttgtttgatatgaaccaatttgtttgaagattcagctctctcgtcattttcgttacataaccatttccatttgtcaagatattgtacaaggaactgcaataatcgtgttttgtagatgatctcagataacgttaccttaagattcctgtcttgtgagtccaatattacagaaaggtgaagatagaggatcgtaaatgagtagtaaagctcatgggatgcaatggatatttgtgctgcattagtgcgctcaatgatagcttgttccaaaaggaattttatcttcttctttatcaaccctgcgataagttcaataatgttattcttaggagagaaaatgactgtgttgatatatctaatgtgttccaactggttggacgtacaagttatgtcaccataatgacccatggaaaggtacgatatgcatatcaagggtctaagaactgaataatttctggctaggtatgatttcagatgttcgactacccgaatcttctctgtctttcgtaatgatttaaagctctgattaattccaatttccagcataaactgactgaagatcttctggatctttcctaaattggcgatatctctttggaagaaccaatcttgtacttctgatttcaaaccttgatagtgatcaaaactaaatatgagttcaggctgaggtgtgactatagtattatgacctagaatgctgtgttgagcttcgaagctctcagaggcgctagaagggatagatttggcattcgacaggccatctatatctaaagcctgaacatcttcatcttcatcgtattccaccattttctgtctatcaatgcttgcgcctgaatgtgttatatcactatcctgtactttctcatcatctaagcttcttacgaattggccaatctctgcaattttttgttcttcctcttttaagctgagccgccggacccttggtgacaactctggttgaggtccaacatcttctagattagcctgttcaaataactcggcttcctttgatatgggcatctctaggttaatagcaaaaggttgatgccgtgcgtgagatcagatatcgtttacccgcgaggactcaatgaaaggattctagtatctgaccttgaaaggatcagcagccgaaaaccctgtgtcgatttggctggccaaggtgcttcggatgaaagtgggtcccctattcgattgaggcagtttttgatttagttttaaaactcaggtgcgtacgtacaaactcgtagagatacctatacctacttttttcctctacaaacttttctctccagtttttttcctcacgcttttcccctaaaggtacacttgccagatctcgaagacaattctttgacaccaacatatcatttcgcccgctttttccatcaatatgaactcccttaatgcctcaaatagtgttgggcttaggtacgtgttgaatgccataccaccttttgttatgtcaacctactaacgcataaaagagtcaaaatctccacaattctggactcatccattaccggcacaatttactcctacaatcctgagttgcaattgatagccctgctgcctgaacataagaattcgttgaaaatcatcaagactaccttcattcgatctgtggtaattttagaatcgaagaacaatgtgaagaaaaatctgcagtcagttctgaagcaagacccaaagctgaggcctgttcatcctgaacaactgaaagtgcctaagcataaggagctaagatacaagcataactatgaactgaaccggaccttaaagcctaggataggacacgtgtctaaggaaggactagaaattttcaaagagctttacaaccttttacctaaaggagatgtcagctggaaaaaggatgacattgtcatttatgatgatagcgtacgtatcaccagcccttataaaaccgacaatgtggttagtgcccattcaggggatgactctcagttagagtttatcaaaaaagtaattgaaaaggtgtggcaagcatctttgcccttgtcttcctaaaataacgctcaattccccaaaactgaaaattggtgttctgacttagccatgtgatgcaaaagcttactgttaaatgcttgaacagcctgcattgatttggttaagagacgggtatcgctagattctaatttcacaacgagtctgatgtactcaaaaaatttcaaccctttttggttagttccctttatgccatcaaatttgcattgtgggacttgtatctccacggggctcatagaagagaacttcatatttgtagctgttggctgttgctctgcgttaatttcatcaggaatgataatttctgtcttttggttttttttgaggaactttacaaacgaatcagtgcagtcagtgattttagggttattcattgtctcaaacaaaacattaatagacagagatgaaaaactagaagggacaccaaagcaggatgtcttaagttgtagttttaagtcaccactttgatcaacaacatgattaaggttaatcaacaaagtatctctctttactatgagttcactttcttgaagaaggtttcgctcgtcaagcgctacctccacctgttgttgaaaaggcaagtataatccatggatttgaatttgaattacttgagcctgcactccagaaccataccatagattgaataattgctgtctttcagaactaatcaacagatcatagaaatactccagatatcttttctgggaaaagctataaatctggtgaaaccctctggccattctaatctgttcgaatctgctgaagatctcgtcgggtgtggagagatactgatacttgaacaatagataggcacacgccactgtcccagatcttccctttccctgtttacaatgaatgtaaataagatggtcattgtcgttttcttgataggtctcgtgtatcttgtagattatctggagaagttttgaaattgggataggttgatgatcttccaaaggaaaatgaatgaaagcgccctccttaaagttttgtatcaaatcaaaatcataatctgaaggctccagctgtagattgacccatgtgaaattgtctccaactttgcttatcaagtactccaggattactttgacctgatctctgtacaatgtcctaggaaatgatgaagctggctcccctccaactaccatttgtgtggttatgtaagacatatcaagcccttcaacatggttggtccagatcggatggcagagtgtcatcaatagcaaagtcgacgttagcaagagtttgtggttctagattgagaacagatagtttttggcgccttgtaagctctgttttgaatttttttaaattttaaaattacacagcatctacgtaccaacacaaaatgttaactatctcaggataggaagattcaataggtccattatagatccatgtggatcgacacagtaattagccttgtgggcatgcttgtattatgtaatactccaagcttctagacattccttatcatatcatatcgcgcagcgtatgtagaaactccagaaggtatccgaatacaattttagcattgcctccaagcttgaccacaatttaacttcaacttttttaatgctcccacatttggctcgtaagtattaattatttatctgagaaactccagagtctaacttcatctcaatagtgacttcacatttgtatgcaattgccaccggggttgctgcgggggtagccattcacagatataaggatgatattaagagattaatcattgaccctcttcaggagagcactttggatcctctggagagaaacgtggcatatatttgccaactaattgctgtaaagttggctcaacatctggctgatagggaaaaacaaaaatcaaaacctgcacattcagcatgtgggggtgagcctcagctggtagcaatcaagcaatctggaacagacttatcatattttgcaggtgaacaggatgtgccggccaactatctcattagtgaccagttagacatcaacgacttaattcaagaaagaaagagacggaaacagttgaatgaatccatgtttgatagttgggaaatcctctcggaagaaagtttcgatgatttatccatagccagcttggattgaatctctccaattcaactgataattgccaacactaatacgagcacaatgactagagcgaggagtaaggcgcaactccattttcttttcttcttttggtaattgtctgctttgatgagctcatgggttgcctcctggttattgttagcatgggacatcatattaacttcaatggtgtcgatattttgtccttgttgttgaacgagagttcctaaatccttgaaaatcgcattgatctcaccgaccccggtatgtatatcttgaatcgcttcagatcgctggttgatcagaacagagtggtatgaaacttcggcctgattcaaagcagattgatgtttgtcatcaatcttttgtatttgattagatatcaatggtgttgtttccgtctccagattatgttgctcttgctctaacgctgcttcgttggcctggcgtgtattctgctcaaaagcctctctgacttttatactggatattttttcatcatacgcaattttcaaagactggtagtttttcagtatcctagatgcttcgttcaacagcttattctctttgtactttacattgggactatcattttggtaggaattagattccagctctgacgtaacttgccttaacctagtttcttgtagatcgcatttactaattgaactttctatttgccctcgtagacgctcattgtctcgtttggttcccagttgttgctgaagtttcccaaacatagaaacgtcttcaacaaacgatgaaagaatgagggatgtttgacgtagcaaatcggaatctgagtttgcacgctctgtgtctgcctctttaatccggaccttgttcttttgtgcaccagcatcaaagttagcaaatgacattataggttataacctatgcagatagtcaaagtggttgggatatacatatctaatgctggggccaaatttgtactctctctggatgtatctggatggcagattactaagaaaagttgatcacctgatctgaaaattgatagtaacagacgcgcttatagaactactcagacgcgtagcgttctttgttctggcatctcaattccatcataactattcgtcaattttaaactgtcatgagtagaactgctaaactgaaaagtctaagggcagcgagatccgggattaatatcatttctgaccatagtgactctgaacaggactcataccagctctacgatacggttgacgaagaagagtatcgaaagaggaaaagaaaagagatcttagaagatgatttcattgtggacgataatggtgaaggctatgtggatactggagctgatgaatgggaaggcggctattatgacgatcaagatgataatccggattatgacgaccaggagaatgaagatcctctaaccaccaaacataagacaaagcccaaaaaagtgaaacaaattaaccaattctttactagcactgaatctaaagtcaaacctgtaaagtcacttaaagttgatgatattttgaatgattttgaatccaaaccgacgcacgctggttcccccttccaggtgaagtcgggatcgaaaagtacaatgtttggtggtaacaagagagccaaattggaaaacacgcaaaagaagaagaaagtaggacttttcagctccgaaaagaagcgaaaacttaatccttcttcctctagcatcgtaaacaatgacgagattaattctgaagatatagagagaagtattgatgttgaacagcacttagatcaacccaaacctgacatcaaggagatgaattcatcgccaataaaacaaaaagtaatctctttagaccaaacccaagatgaagaatctgatgaggaactattgatttctcgcagagcaagaacagcaaatacggaaatttccagagaagtcaacatgagggcgtcggttatagaagagaaagctgcagatgcagactctagctcttctcctacgagatccagatcaattatgacatcttcgccgtcaaaggtaaccaagttaggtggtactgatctctcggaaggacctgttttgatgtactggttagattatgttgaagttaaccacaaactactgctttttggtaaagttcgcaccagttctggtgctttagtttcggcaatggtccaggttggtggtgtcgatcgagagatttacatattgccgcgttcttctcacagaagtgactccagtgctccatgtggccccatggatgtccacgaggaaatcacccctcttctgttggaaaagtatggtctaaagagtattcgtgcaaagcctgtaactatgaagtatgcatttgagttaccaggggtcccgtcagaagcagactatctgaaaattttgttgccgcatgacaccccattgaatgcagatttagcacttccctcgtcattggaaggggaaacttttcaacgagtatttggagggcattctgctctttttgaagacttcgtcctgcaaaaagatgtgatgggaccatgttggctggaaatatccaatcctgattttgactcaatgcgtaactcaagtcactgtagggttgaaatggcaatacaatcgccgaaagacattactgtataccgaggaacagatcaaacagcgccaaatctcacggttttgggaataactgtccagacagtgatgaacacgaggaccaataaccaagaagtggccgctgtgtcgattgctacgttcaatgaattgcctcaggagttgcctattccagaagatttacagcctgatgaactgatcacgttgatacgcccattgggcgattcgactgtatttcctccaggtgtgcaaagagctatcgaaaaacagggcctcaagatacgatgtacgcccaatgagaaaacattgttgaaccttctttgtgcactagtaaaaagggcagatcccgatgtttttgtagggcatcgtattgaatctattcagctagacgtgttggttcaccgactctacgatctgaaggtacctacttggagttcgtttggaagacttaacaagaaggtctggcccgacaggtttccccgacgttctggaggtcccagcaaggttcgggaaatttttcacggacggttgttatgtgatattggcaatgatatgggccaatctctaacaaccaagtgccagtcttgggaccttccagaaatgtatcaatctgtttgcggtaagaccttcaagccttctgaaattgcactcaacaaccctcaattgtccgagaatgtcaacttgttgttaacggtcgcaaaggaaggtgccagtatggtccaaattacaagtgaaataactttcagaattcaaatcctttctctttcaaaaattctaaccaacctcgcaggtaacgcatggagccatacattgggtggaactcgtgccggtaggaatgaattcattttactgcatgagttcagaaagaacggatacatcgtgcctgataaagagaacttttatcagaagcatcaacagcaacagctgcaagaccaaagtcccgaggatgacgagactacgaagatatcgtccaagaaaaacaacaagtttaaaggaggtttagtttttgaacctgaaaaaggcttacacaggaacatcgttcttgttttggattttaactcactttatccttctattattcaagagtttaacatttgttttactactgtcgaacgagaatctggcaatgtcgacactattcccccagttccagtacaaaatagccaacaaggtgttcttccaaggcttttagccaacctagtgagtagacgtagggaggtgaaaaagctacttaaagattccaaaattggaccagtagaaaaagcacaatttgacatcaaacaacaagccctaaagctaacggccaactcaatgtatggttgtcttggttatgtaaattcccgattctacgctcgacctttggctatgctagtgactagcaaaggtagggaaatcctgatggatactaggcaattggctgaaagtctgggcctcaaagtagtttatggagacacagactctgtcatgattgactccgggaccattgactaccaagaagcaattgccattggagaggacttgaaagccaaagttaatgaaagatatagcttacttgaaattgatattgacaatgtctttaagagaattttgctacatgcgaagaaaaagtatgcggcaatgaatctgagcttacaaaatggtaaaatggtatctcagcttgaggttaaaggtttggatatgagacgtcgtgaatactgtcaattatctaaagaaatatcgacacacgtcctagaacagatactaggagaaaatgattcagatgaagcattgagtgatatctatcaatatttggaaaccatgggaactaaaatccgagagaattccattcctattacaaaatttaacattaataccaagctatccaaagatcccgcacaatatgctaatgcaggtggtatgccacaggttcaagtagcattgcggctgaggggtcaaggtaaagtcgttaaggcaggtacagttgtcagtttcatagtcacagctggtgatgataacctctctgtggcggagagagctcgtcccttggctgaagtgttggccactcccgaacagctacgccctgatcccgactactacttggagaaacaaatttttgcccctgttgaacgtttggtggagcgccttgagggcgtagatttggtgcgattggctaaatgtttaggtttagactctggcaggtatgcaaggattcgaacccagtatgcaaacggtggtgcaaatggtgatgatcttctgcaaccgctggagtcatgtatttcggatgccgaaagatttaaagaagccgcaacgttggaactaacatgtacatgtggtgctcatttcgctttcggaggcattcaggagtcatcttactacacggtaaccttttctggtattcaatgcagctcctgtgggacacagctatcttctttgagagtagcgagtcaattagaaaggttgattcgtcaccatatatcgctctattacgctggttgggtagagtgtgacgacgtgtcatgtggagttcataccagacaggtctcagtgtacggtaaaagatgcattggaaatactggacgttcagttggttgcaagggtgtcatctcgtatgtatatacggacagagagctgtacaatcaactactatatctagaatctttgtttgatgtcgataaagctcgtcgacaagagttacggccactacaggacgatacagaaaacagaatacggagtgactctggtgaaacgaaaaaaggtatatcccaaagtaccttggatgcgttggcagagcaaaacagagacacatttggggcattccaaagtgtggttcaaaagtacttcgaacaatgtggacgacgctatgtcgatatggcaagtttatttaatttttcatagtcgtaatataaaatcagttgttattatcagcaattcatttgaataattcttcaatagaggctctcaaggaatggatttgccgagttagagcagcattaccctctgccgacgcttttgacacttcctcttgtaaggagtgcagttgcttaactgcctcagtgcgagcttcgtggacttctggtacacgagattcttgctctactaaaaaattgaccgaattttggtagcttaatggcatggtctggcgatatacaagagcaccagcaatagctggtacaaaagttctcacaacaatacctctcttagaaacggccactcccgtggccaagacagcagttaatatacctatgacactgggtaacaatggttccaccactatcgaattgtacttgtctttaactatactccattcgtttttcaatgcagatttctgagtagctaattcagcgtcgatcagagtgtacttttccaacaacagctggcgtgctttgctggagtacttttccagtagtggagacgtacgaatggccattccatgaagaaaagtcaagttgtgcaaatcaggtgattcagagttctcaagccttgggtctataggctcatttcttcctggcgtaggaagtacttcctcgtcatccgagtagaaagatctaggcataggataatgttggataaactaaacgaaggaatacaacgaagtaaaggtactgcaaacctggtcatgtgactgatcatgcgagtttttggcactattactttatgcggcgctgtgtttgcggctttttcttgtttctttctcttcttccgtttattgtttcctgacacaattttcaattggaaaactcaagttcagaagttctaaatggcgtcttcctctaagccagtacaggagcaggtcataagatccaattcgaggcctaaactgaaagatgaaagtttaggggctgcaaaatcgcaaacctcaggcgagtctcaaggatctgagacaacaagtttcactaaacaggatccacaagaactcagtgaaaccagccccctagctgattcgaatagtaaagatgaaccagccaaattggatgctggagataatgttagtggtcggatatccgccgcaccatcagccgcggttagagcggccacaataagagccgcacaagaacaacttcaagcccctaccgtatcttcatctggtggctcggtgcttccagctgttcctggctcaggcgcagttagtggggtgattgctccgtcagctccgtcctcatcagctccaccttcagccccaccatcagtcccacatagtgggatgtcatttgcgccaaatccatatgctttctactatccccacctctatccttatgcttacttccaacctccggatcaaataccaaaaggagctagagatcaacaacctcaaagattccccaattaccctccaccattcaactattatgtgcaacagcagcaacagcaacaacaacaacagcagtttccaaattcttcgtctaattcaaataacgtagcgccattgtctgaggagttcaaaattggggagatgatatacccaccccctttctttggttcgttacctcctcaccaacaagttcctgtcgtcgctccggagtcagaaggttctacacaactggcggaaggtggtgacgacaaccaagagaaaaggaaatctcgtaagcggatccctccacctacaaaccctgtcgatgagagcggaaaaagcaattcgaaaagtgtggataggccgtatgcttgtcctttagagggttgtctgtgggcatttgctagactgagtgacttaaaacggcataagaagtcacatgaatgtccagaatttcaatgtccttactggaaaaatgatcctacgtgtcacaggaatggaggagctttcaataggctggatgtgctgaaacggcacttgcggttgattcactatgttgttgataaagagaagaagggagaatcgggcgatccggggtggtgcagagtgtgtcggactgtgtttcccacatcaaagcagttcttagagcatgcagacaagtgtgcacagaatatcactgtagcagaatggaaagatgttgaaggcagtaggcgacaggctaagcgtgggttcgaaggtgatcaaaacgctaatccctctcaatcccgtttccctcctaaaggggatgtcggtaagacacaagagctggtcatgaagaagcagaaagtgtagctagtttaataatgtatagtatgtattcaaaggtttaatgttaacatcaaaggggaaagaactacacactctgcagctacctgccttcactgtaccaaatatagatctttctccttgcggcgttggacccagttagatgcaagatcagcgtgtttttgctttcgcgtatcctcttcacgttctttttcctctctactcaagtcacactacaatgagaggtaagtcatccatcattatgctccttctttgatgatctccaatcactaacaaatgcagaatataagatagtagtacttggctcaggaggtgttggaaaatcctgcctcacggttcaattcgttcaaggtatttatgttgaaacttatgaccctacgatcgaagattcgtatcgcaaacaaatcgaaatcgacgataaagtgattgatctagaaatattggacactgcaggagtacagcaatttacagctatgcgagaattgtatattaaatctggaaaaggtttcctcttggtgtactctgtggatgatcccaactcgttaaaggaacttgagcgtatccgcgagcaagttttgcgaatcaaagacaattcaaatatgccaatagttttggtgggaaacaaatcagatttggttgaaaccaggaagttaactccgcaggatggaattgaaaaggctgctaattggaactgctctttctacgagactagcgccttgaataagtcaaatgtggataacgtttttgtcaatgttgtggaacaaataattcgaagagaggaaacaaagacaaacggaacttctacaggtaatcaagcttctgttccaccaaatggacagggcaaaacttccaatgacacatcaaaatcttttaatacaatatcaggagtccataaggatacgaagacagattctgccaacaaaaaaagccccaagaaaaagaagaagagaaggtgtacaattttataaggattaactaatcaaccttcgaatatttgtattatttgtataagaaatggaaggcccattcattagacacgttattcattaattaaaaaataataggaaaaaatataatgacaactgtggggttcgaacccacgcctccggagagaccagaaccttaatctggcgccttagaccaactcggccaaattgtctctacgtaagtatacacgaaagatgtcatatataagggagtatttttatcaatgctttacaataccgaactgagaatcttgaaacaatcaaagatgaataacttatactaagtcagagtccaatggtacgaccttgaaacatagtatgtctatgtaaagacgttatcatgattctcaatttcaactcacgtatcaaattcatatagagttgttaataccacttctacattaactaataaaatgccttaacaggatgcactaagagtttataaaagatatgaagattcaagcaggatgcaattgttgtcccctgatttaaactaaattactccgaattgctctagcaccattaggatcagattttattttcctattttatactcatctaaaaacctaagctagtttataaaatggtatactatgaaatgaagcagtaaactggcaaatatgtattcagcaaaagcacgttgactgcttatattttgaaagatttctttggtccccgttgtttgtagcctcaacgatatggtcagtacaaattgggcaactgtactgcaaaatcctccaaggaatgcgttgaaaggaaaagtgcctaccagcaggcaaaatgcaaactgtagtactccaaggaagaccaaaaatgttaggaaataatcaatcagtcttagctttctgttacccgagatactcttttgatatgaggcaagggatgtggatatcgcttccgaaagttcatgaggcaaacttcttgtcaagcttaacggattgaccgtggcactttgctgcgttggatgtttctttgccatgtttcaattatgtaagtagaggaaacgtgttacgaggactattgcgagagagggaacgcactttctacgaggcgcgatagagcctctctgtgaggagggaggcaggagattaatgggaagcattttgcgaggtagaatacttcatacattcccaccaataaaaaagtactaagagataaccatgtctaatgatatcataaatataaatgacctcaagagcaattcatccttcaatgatgagtccaattgcgaaaaggtcagcgaacccccctctttgagaatcgttcctcccctgaatttctgtccagtggaaaggcacttgtacaggtcaggccagccttcaactattaaccattcatttttaaaagagcttaatttgaaatcaataatttggcttgcaatagaagatccacaggacaattttctgaaatttattgatgacaataacatcaagttcttttataacttgggattcaatagcatagacaacaattcatgggacggcttaagtgaaaatagtataaagcaatctttagaagtgatagtggatacaagaaactatcctttactggtatgttgtggtatgggaaggcacagaactggtaccataattggctgtttgagaaagttacagggttggaacttatcaagtgtaagtgaagaatacaggaggttcacgggaagcagaggcggtcgtattttggtggagctgttaattgaagcatttgacgtcggtactataagtatggatcctcaatttgctcctgattggcttaccaaaagtacaaaataaaaagagaagttacgctgcctacacacattaccttacaatacgttatttgaccttgtttctgagctcctgctgttttctttgttccaaactttccttggcgatttgagcagtcatcatactcttgcgccgtatactattacattgttcccatccaaatatgctgcccaagaggaacccaccaaaggcccaattggccgtcttttgaatatttttgtggtacaagaaggtgatggatccgaagactgccattactgtaaatcctgacaatccagcctcacggaagcatggtatgctgataaggttggcgggcgagaaatctttaatactgatcttattcactgcttgcttcaaaggtgaggtagaggggatgggtacagcctgcttagaatcatcaaatttgggaggaagttcgtctagatagcgtggttcaggcactggttccttctgttgtttctcctgtgagtttttttcgttggaaaatggccaccaagccattacagtgattatccttaaaattattcggctgagatgggctgaaaaaacagttccttttttcagcgaacccgtcctttggaaacgtagatttacccttctgctgcttacgtgaccatccatcgtgtaccatcgtgtacatgggcttcgcgatcgatcagtcattcacctactatttactttaaatcctggtcatagtaatcacctgtgattaacacttcaaactttacatgaccgatggagctgattcaaggccctcagatggtcaaaatagtatcgacagggcacgaagagcttctatggcacgactagcgtcatcacctgttccccctggcattgcgatccttcgtggatctaatcattcaacaaggaattcacctgtatcatctcctatcagaccgtcgatactggagaccaactccatctcttccaactcttcaggcggcccagcaggatttgcgttggagaatgatgatgagacactaaagacagtggcaaagcacgttcctcaatcttcaagctctcttttattacccggaggtgatgttacgagggacatcgtgcaatccaccaagcctagtcgattgaagaagtcccgaagtttgagtaacactagttcttttttggatggcgaacgaaggggatctgtagcctctagcataaacgtccctggcggatttcgacgtgatttcctgcttagaaaacatgagcgatatggacataaaatggtccgaccaaatctctttacaagaaacttccttgagttcttgtccgtgtatggccattttgcaggtgaagacttggaggatgaagattatttagcatgtaattatgagttgtcttccgattcaacgctggacgaagaaactcctctgattgggggcaggcagagggaaaagaaaggcaaagctagcacattgaagtcgttctttctcttattgaagagttttattggaacaggtgttctatttttgccgaaaggcttctacaatggaggagtattattttcatgcgtgaccttgattgttttcggcatattgtcatggtggtgctatctaatattagtccaaagtaaggtggcaactggtctttcttcatttggtgaaattggcctcaagttgtatggtaagaccatggaacgtttgatcttgttttcgatcgtggtatcgcaaattggttttgttgcagcctacatggtgttcacctcctccaaccttgaagcttttgccaacagcgtctttggccatggaatagcatccatgaattttttgacaatagtgcaagtgctcatattgataccactttccttgattcgaaacattacgaaattgtcccttgcgtctctttgtgccaatgctttcattttcgttggactcttccttattgtgtgctatgctggtaagcatttggttgataacggaattgcagagggtgtagtccttttcaatgaccgcggatggagtcttttcgtgggagtggctatattcgcctttgaaggaattgggttaataattcctgtgcacgaatctatggcaaacccaagtcatttcccaaaaattctacttgcagtcattttaacatgttgcggactttttattggaattggagctttaggatacttgagttatggtcataatactaatactgtggtgatattgaatcttccacagggttccattcttgtgcaaggtattcagcttttatatgcattagccataatgttatctgaaccattgcaactgtttcccgcaattcgaataatcgaaaccagacttttcaaaagagccccaagcggcaaatatgaccctaaggtcaagtggctcaaaaacatcttccgtatggtatttgtagccatgaccggtatcattgccatatatgggtccgagaatttagatcaatttgtttcatttgtcggatgcttcgcatgtattccgttggtgtacatgtactcaccaatgctgcattacaagagtgttgctcaaacaactttgtggaaagcttttgatgttgtattggtacttgtgggaggaattgcaatggtctacaccacttggcatcttctccgggatgactagcttggcctaagattttgtcccaccttctccatggaccattctcttcatccctattcgatatctttgttccacatgtttctctgcatgaacagcctcgaccgttatatgtcgttaaattaaggcaataggcaaattcctgaagaaagcttggtttgtttgtggctaaaaggaatattattccaattgaaaaaaaacatatatcacatcaactaaaacaattacacgctgaattgtgcaggtacgcgtagtccgttttcttattcctatttaccacccccagtagatcttgttaccttatattgtggtaagcacactaccgcctgattattataccgtttctttttctaatcatggagaaaatttctttttttttcttgctcttctctttgtgatgtgcgggtcttaataactacaagccatctctccatcttttcatcattatattgcaaaattattgcccccaaactgaaaggataacgttaaattaacggttgatcacgataactgcaaatgccaaccgtgctcagccttgaagagcttgtgctacgatgttgtcgctctggctgccaggacctagatgatcatcagggacggggatcgtctgatgcttcaacatctaaatttgaaaatatcgtcaagaaattgtacaactcagaaaatttagcatatctgaaaaaattatatgagtatgaacaagagtggaacagggtgcacgaagatgatgttagtgacttatttggtggagagacagaaaggtgcaaggactgtatttgtgagggtgaacctccgtttatcacccctgtaaaagacatagatgattttcaagaaaacacagccaagaaaatgcatatcagttcccttgaacgcagaagaaacgatgatcaagagtttgaatttctgaactctgagctttctgatgataccgctgatggttccgagctgacgttcctctggcggcagattattgataattatatccgagaatcttctacatctcagatcaatgtgagtgcatctattcgtaagaacttactgttggaagatgatcttccaggacctcatcacccacaagttttctctgattccaaaaacagtgttctacgtcttctgcgagataatgtctatatggaattcctgtcagacattagaggtcgagatacgagccaggaaaacttaaaattcaccggtgccagtggtaagaaaatacccaataaagacaaccacacatcaccggtcgaccccaactctatcacttcgcctcaaagttcattaaggccccaaacttcatcagcatctctatcaacatcaacgtgttcatcatgtgcacaaatagcactcgatcaagtgcttcatacggagcttaatccagtcgtctcccctacaccacttgggccttgtggggtcactcctgcaactacaacaggtctggttggaacgaaaaagcacctaaaatcacggtttcgaccagagtcttccaacaaagaagatatcgaaaaggattcatcactttccagtaataaatcatccctgctttctaaaagcctcagctcttggaaaagacgcattaggaaagaaccatagatattacactgaataattgtaccatagaatagcttacgtagtaaacgattacataatttatcgagaaactcgcccatccattgcatgaatccgccaccctcagtgcactcactgtgtttcgattcgcttccctttcaacgctatttctctgaatactgactgatggatagactacaaagactgctcggacaggctggaggactgggtggaaccagcggaccattatctgatggaccagcaattgatactgcagagacagttcatatatcttctctagcgctactaaaaatgctcaaacatggaagagcaggtgtgccgatggaagtgatgggcttgatgctgggtgagtttgtcgacgaatacacagttcacgtaattgacgtgtttgcaatgcctcaatcgggaactggtgtcagtgttgaagccgtcgatgatgtttttcaaacgaagatgatggatatgctaaaacaaacggggagagatgaaatggttgtcggatggtaccactcacatccaggttttggatgctggctatcgtctgtagatatcaacacacaacaatcgtttgaacagctaaacaagcgagctgtagctgttgttattgatccaatccaatcggtcaagggtaaggtagtgattgatgccttccgattaatcaactcgacgtctcttcttatgggtcaggagcctcgtcaaacaacgtccaacttgggattactcaacaaaccatcaatccaggcattaattcatggtcttaatcgtcattactattctctaaacatcgactaccgtaaatccaacaacgaaatcggaatgctactaaatctacacaagaaagaatggcagtcaggtctgagaatgaatgactatgctatcaaggaagccaacaatgtggaagatacaaagagactggttcagattgcagaacagtatgttactcgtattcaagaagaacgagatctttccgaagaacagctgaagacacgatatgtgggaaaacaggatcccaagaagcatcttgcggagatttctgatacccgaattgaggaaaatgtcgtatcattgttatcgggaaatgttaattctctttccatttgaacatagtattagacacaacgttatatttttctttcccaaacctgaagaacgctttgatgaagaaacaacaactctctttctatttcttgaacctttagatcatggatctgtaaccattggtcacgtcctttatcataaagttgaatcttgtatgctatggtgtcttctcctgaactccctgggacaacatcttgtacgatattggcaacaagtttatatgtctgattgaattgtaaatcttgaggaaaattaattatggtattgttgatagcactgccagacacactgtctaactggatatcttgttgatttctgtcaaaatgtaacaagagcaccctgggtgcttctttaacgggcttatccttttcaaactggttaattaatgtttgtagattaatttgtggggtctcgtcattgaaaactgtagttctggggagtttcaaagggatcattaggaatgaagagccgccagcagcaccccgaaacgatttcctcacacgatgaggcatcaaatgaaggaggaacaagaaaaaatctcttggtgtcttttgctgtgtgaggttaaagcggtttttcgactcttctgtgactactctcattatctctgctggggatatgtgtgggcggaattgcttgctactccacattcgacgtatgaaaagtccaagttcctggttgaatgaatctttaaatgaattcaaaagatagtagttacgaacagcttttatatggcccaacgcaaggagtacagtgttgctgtaatcattgaatcccttcacattattcaagccaataaatcctggtctataagggttaccatcaatatctcttgcagtggttgtttgtttatcgagggaagccacttggtctttcgtatatgctggacttattagctctttgatgtcatccaaagacccatcgtgatctttgacttcgaagccttctggcaaagcgaatgttttgagcgtactaaaactaatgaatagatgatggtttacgtccaatgaatgaaggtacgcctggctagtcggtgacctaccttgaagatatttgccacataccaagcaacagtagacattggacttgcttaaggtcacttgacattttttttcaaaatcaaagtcaagtttatgtctatttattgtattgaagtaaaggtttcgaacctgcgacaacctgttggtttcgccatcgttagcatgtttgccaatatcattgtcattctccccatcgttctcaattgggttcttttgatctagctttgcccttttatgaggtctctctgagtctgactggggcatcaggcaagaaaagagatatcgatcaccaattttcaatgtcaccatagggaacatccagcatccaaattacttggacctctatttaagctattattgttaacgagtattacagtccctatccattataattacacagtttagcatgccttagaagattatttgtttgatttcctataatcctgaacggaaaacactttttccctggtgacgaaactggatagtatccatcttctcaaggatgtagagtgccttttgcaacgcaaattcatcaaaattaacaaacttgggcattttgttactatggcagaattccctctttagggtttctacactagtagaccacccgatcggaagacgtttcttcaagtgagcctgaatcactgtgacttgagctttgatttcgtctgtatcagcagatccctgggtgaccgcatccatagtcgaagccttgaacagacggatagcttccgtaacatgtctatcagaagcaacgggagatagctccaacttggctagcgactcggtaattctaatgatagcttccaattgacgtactgtgattgggatggacgatctctcggcagaatgagattcttgtttcttcagctctcttcgaattccgataaagtgcgatgagagcctttcagcagctgcctctgataatctaggggctgccttctgcttgcagtacatgatgaatctcttcattttttgaatagggatctctccctccacatcttcgtcttcgttgttgattcctccattggtatgaacattcatcacatgatgagcaatggacatgtctctcttaggattatgttcatccttcacaataaaaatcatatcaaaccttgacaaaattgtggtctggaagtcaatattttctccaggagacttcatgtcgtcataacgtccaaagattgggttagcagcggcgagaactgacgtccttgagttcaatacagtggtgattcctgcttttgcaattgatattgtttgctgttccattgcttcatgaatggccactctgtcctcgtctctcattttgtcgaactcatcaatgcaaacaataccaccatcggcaaggaccatcgcacctccttccaaatagaaatctcttgttgcaggatctctttgaacagacgccgtcagaccagctgcggatgaaccttttcctgaggtgtaaattgaaactggggcaactttttcagcaaatttcagcagttgtgatttagccgtaccagggtcacctaatagaagaacattgatgtcacctctaaggcgcataccatctgggagtatcttctttgatccccctattagaagacaagctacagctttcttgatatcctcatttccataaatagaaggagcaatactgttagcaaaggtctcgtaaaagccatcactacgagccatttctaagaattcttcctcttcctcttcagtgaatgtgacagaattgccaatccttgagtcatccgtggctgtatgaatacctaataccctcatgaaagggtttctaatagcaacattactctgcccaccatctcttcggggctgcttggcctgataaatggagtatataccaaccatgtcgcagcgagttcctggaataacttgattagttagatatcgatctacacttaatagtagatgacgaggcatctctccaataggtaccatatctggtgtttcttgtaatttaagaatctgttggtctatgaatgtagatttgtcatgaacaatgatatatgggtcaggaggacaagatggtttctctgagttgggttgttgaggtgcctggcaagacttcggagcgttgatatccccaagacttgtagtgaccgatagttgaagcgtgtgtttgcaggaacggcacatcaatgcaactttcgtaactttggaattgagagttgatgcactgatgacgatacccgaaattttgacgattttaccaatatgacttgaagacaagtctctcattgaaaccttattatcgttactaagcaaaacgagctgacaagaagggaaggtggtcggtatttcctcgttgttcaaatatatgattctcctggcaatatctgtgatggcctgttcaaaaagtggaatcatttctgcaggatcatctaccaactttttattgagctcctcattgaatacgattaagtggtcattttgaatcgtcagtaagtacttgtttacaagtaaattctgtctgagttgttctctgtagatgtactgattttccatacgaaactccaaaatgaacgaacggaatgccttaatgacctcactgaactggtcatcgttctgttctccgggaaggacacttgtgttaaagactgatgctctatcaaaggacattgcaacaaagtataaacggttgtgagcgggaaaaagatgtgtaggtaattgtcgtagatgagactgattcagtagaaaacgcgtcctgcactattttttttctttcttcattacatttcctaatcgggacaaaatgaatctaaagacgtggttatgtagtacacgcatcgataggctatccccataccaaaacactattttaccccatccttgacaggttataaatatgcgatagtatgagtatcttcaaattcagctgaaatatcatggaatccaatcctatcaactctttatctcaactaaaagctgctggaacagttgttgtcacagatactggtgaatttgagactatttccaagtttcggcctcaagatgccaccacaaatccatctttgatcctcgcagctgctaataaaccagaatacgcagacctgattgataccgcagtacaatacgctttaaagaatgcctatggaactgaaaatcaaacgcaattagctgtggataggctcctggtcgagtttggtaagaaaataatggatataataccaggacgagtctccactgaagttgacgccagattatcctttgacaaaaaagcaactataaaaaaggctcttgaaataatagacctctatgaggagcagggtgttgacagagatcgtgttttgattaagattgctgctacctgggagggaatacaagcagccctggagttggagcaggtctacgatatacactgcaacttgacactaattttttcttttgttcaagctgttgcgtgtgctgaagcgcaggtaacacttatctctccttttgttggacgtattcttgactggtacaaggcaaaaacaggtaagcaatatgaaggtgctgctgaccctggagttatttctgttgttcgtatattcaagtatttcaaggcatacggatacaaaactatagtcatgggagcttctttccgaaatgtcagcgaaataaaagctctagctggatgcgattatctaacaattgcaccaactttgttggatcaattacaaagctccacagatgctgtccctaaagtccttgaccctgcaacctcagcggctgaggagcaggagccttttgtgtcgtttgtatccaacgaaactgctttccgttttgaactcaacgaggatcaaatggccacagaaaagttgtctgagggggttcgaaagttttcagctgactgcaataccctgtttgatcttttgagagaaaaagtaaaagtcgctcaagaggaggtgaataatatctccaatggcgtgccatcacttttccgtcgtgttttatccaagttgtaagccattgggccaaacgtttctggatcttgaagctaaccaaacctgatagggcaatgctcaggacagctaaacttagtttgaagtttcccccaggttttcttcggaagatgttttcacccacaatcacccccactctaagtatgtttgcaataccaactccgcgcttattacccccattatcaggatttgctctcccgaacctcccgcaaactgcacctataccgatcgcggcgaactgtgctccacacacttgcccaatcttataaaagttcttcctccgccacctgggttgcgctctttcttttactctaattgaaattttatttctacaatgtctaactctttggaacaattaaaagctgcaggaactgttgttgttactgacactggtgaatttgaatccattgctaagtacactcctcaggacgctaccacaaacccttcattgatccttgcagcctctaacaaggccgagtatgccaagttgattgatattgctgttgactacgcaaagaagcaaggtggatctgttgaagagcaagcaaacattgccctagaccgtctcttgatcgagtttggtaaggagattctaaagattgttccaggccgtgtatccactgaggttgatgctcgtctgtcttttgacaaggaggccactatcaagaaggctttggagatcattgagttgtacaagtctgtaggcgttgagaaggaccgtattttgatcaaaatcgcctcaacctgggagggaattcaagccgcccgtgagttggaggccaagtacggaatccactgtaacttgactttactcttctcttttgtgcaggccgttgcttgtgctgaggcaaaagtcaccttaatttctccattcgtgggccgtattttggactggtacaaggcttcaacgggtaaggattacaaaggtgatgaggacccaggtgttcaatctgtgaaggcaatcttcaattactacaagaagttcggttacgacaccattgttatgggagcttctttcagaaacactggtgagatcaaggctctagctggttgtgatttcctgaccattgctcctaagttgttggaagagctgttgaactccaaggaacctgttcctcaaaagttggacgcatctgctgcttcatccttggacattgaacgtgtttcttacattgatgatgaggctgccttcagattcggcttgaatgaagatgccatgtccactgagaagttgtccgaaggtatccgtaagttttcggccgactgtgtgactctactgaatttgttgaaggagaaggtccaggcttaaaagatccgtgtctagcaatgattgacgtacatagagcattaaggtagtataatattttcaaaattttttcatgattgttatgtaataagtatctttgacatgaaagtgtgtaaatgtggatacgataagccgcacatgtattgtaaacacagtttgtattacaccacaaattgttgcatctttattgatgacgggcctcgcagtttatcttttctgctaggattctatgtcagacctcactgcctcccgttttcgggagtataaggtgatgtataccacagagatcactcaaaagcgtaaacggtggcatgatgggactttaagggtgtttgactttaacaataagtgtttcctgaaagatgatattctcggtcaactcgtggagacatcctttgttgatggctccatagctttcaatgacggagccctggtcaatcttgaaggcgttctcatcgaggttgagtatttgctagctgtttacgagagagatgcaagttccgtcatatgcgggtcacttgggacacatcctcaagacgttaaacccattacgaaggttctttgggaatccgagaaacatcaaagtcatgacgactacaaggtagttgataacgttaccaagcgggttgagcaacgtccaagatggagaccagtggggctaccacgtcctcgttctaagaagtaagagtttacgagatgttttaaagagatggaaggtttctattcactcaactaaagattggagggttatctaacatttgttggttgagctctaccttcacgccacataatcaatggaacagcgtttgaagcaaacaccttgatcactggaaatgaagccaacagtcccgtcaaagcggcaagggcaggtcgagtggcaaccctgtctgcaacccaggcctgggctgggtttgattcagggtgttctaacaagtatttggagacaggtttttcagaagacatgaggatgggaagttaaggcaccgaggaaacaagggagtaagagagttagacaaaagtttcgaagaagagaaccagttgaaacagaacgcggtgtacacaaaaagtacaagcatgaggctcatctatctattaaaatttctttctacaacttttcagtcaactccggaacaacttcaaagatatcaccaactaaaccaatatcggcaacactgaaaataggagcgtcttcatctttgttgatggccacaatggtcttggagtctttcattccagcgaggtgctgaatagcacctgacaggccaacagcaatataaagttcaggggctactaccttccctgtttgacctacttgcaaggagttgtccacaaatcctagatcgacagcagcacgggaggccccaatagcagcaccgagcttatctgccagagggttcaataaggagtcaaagttttctttggacttgagaccacgtcctccagacaccacacgagtggcagatcccaaatcaggtttgtcagatgtcaaaagctgctcattcacaaattcagcaattgagccaggaacttctttgagggtaaccgactctactggtggagctgcacttccttccaatttcacaggctcaaatgaggtccctcgcactgaaaccaatacctgaggttcagtcgtttgcactgtttgtaaggcattaccagcatatatggggcgaacaaatgtggatgcgtctttcactgctgtgatttcactgattggttgtctatcaaggacagcagccaaccggggaagaatgtttttaccaactgtcgaggcaggggtaacgaaatgggtgaaattatgatcccggaacacttgactcaccaatggggttatcagctcggcagcattatgatcaaaaaaagggtcttctgcaatgaatactttactaaccacatcctttgggagttgtgaggcaatagaattggcgtttgaacctgccaccagcacactgatggtatttccaatttgactagcggcagtgagacctgccaaagaggccactgtgatgttaccaccttggccttctacaaatgccaacgtagaaccaagtcgtcttaaagttcgggtagcaagaccaactcctcgagtaagaagcatttcacctgatgaactagagtaagggattaatcaatcaatgttaaagaatgagcatagaaaagtagtgctctacccaaacaagagtttggtctctttgtgcctcctactcccctactcaggaggggttttccaccattgggagatgccccagtacaacgggaaacccttgtgctcgcgccttggaccgtgtcgtctggcgacggattggacttccccgtataaagtttagcatatataatgtagtgcaaccgcaccccggatgttgcaagagatggggtcagaacagaatgcaggtgttttgactccaatgattcgggtagattaccgtctactgagagataaaattctgcaaacactgaaggccagtgggaaacataggatactggttatactagtaggaccccctggctcaggtaagtctacaattgctgaacgattacgggatgatttaaacagcaagcaccaagtacttccagagcggccaacgaatgctggcgagccagagtcgaaaatttcaacattgccgagtaggaattgtcactatgttactgatgaaatagtggataatcttcccactagttcctccgttcgagaatgctctggtcagaactaccggaattcagcaggcatgaatggttgttacaaagatgttgacgccgataacaacgttgttatttcaaataagagtagaaatctgtctactatcaaaatattagcctcgcctgtttcaggtggaaagttttcgcaagttgttcctatggatggattccatcttcctctagatgttctgccctcggaattgttgccaacccgaggttccccagaaacatttgatgttcgactgctggtgaaactgatagaactgctgatagaaacctgcaaaacgaccacagcagactttgttcccaatatatcagttcctagttttgaccatgcagtaaaagatccagttcctgacagtattctactttctcaacaaactagagtgattattattgaagggctttatcttcaatgcaaatttggagaatggtctaagattaatcagttgatagaaaagaacaagttaaagaatggactgagaattttgtcgtggcaggtagggattgatccaattgaggctcgccagcgtgtagcacgaaggcatttgaagaatggtttagtatccactatacaagaagggctagacaagtacgattttaatgacaggattaatagggattttattacactacatcaggttcccacagatttgattatagataattctgatagggaaataggaaaatgacgcataatatttcttgaagcagtccccggatcagtatttagaagattggttgaccgtagatgatgacttgctctttcttcgtagaattaggtttgaaagattcaagtttaggtcgaagtctttgttttcgctgatgtacagaccttcatcttccaagggcttagaaggatatgatgctgacctgggtttagatgaaacagggctggactcaacatcctctgggataggtgttcgtggaaattcattacgaacatgatgagaatgtacgatgctatcgtcgaacgaaatcatggagctacctctagatctctgtttgtggttatcttccataatggaatgtacctccacagaggatacattggagctcagttggtgctctccttgagaatgccaagtttccaatttggagctctgggtgtttgcatggctaccattaacattgtcgccctcctcattattatcttccttctcctcttccttctcctcctcattctcctcttcctcgtcatcatcatcgtcatagccttcaccgtagtcatcgtcatcatcatcatcatcatcatcatcatcatcaacatcatcatcatcatcgtcatcttcggtggagattgacaaggacaatctatctttgggttttaattgatccaatactatggtgtccaggttttcttcagcctcattgatagtattggtattcttacctgtcattaaaggggatcttaatgacccatcaaatacctttcgtataacgtccatacgtggtgattgaggtcgaccctcgtagtctgggtgatcaaggtgagaactaagataatcgtcattcaagtttgggatagccaatggaccgctattgttgagtaacttgtagacgtatgccttatttatggccgatgggtcatgttcatggtcaatgtgtgaagttgttttagttgaagtcaaagtgccattcttggtaatccaagggtgggaaagcaactcatccaaagagaatcttgtttctgggtctaaggttaacaaattggaaactaggtcctttgcttcattagaaatttcatcccaccagggactgagaaagcaatagtcattctcactaatctttttggaaaggactactggatcgttatcataaaatggtggaaaaccgcacaaacatgtataaaggatgcagccaatagcccagatgtctattttatatgagtagaactcatcacgtatgatttccggagcagtatacccaatcgtgccgcagggagttttggttttgctagatccggttagcaagtacttagagaggccaaaatcgcacactttaataagtcctatttcagctccacctaagccctcagtgaacttcccttcgtccactttcttagcgtcatcagactctcgtttatgggctcttacttcctctggcgatctctgactatatggaatcggttcaaaaagtaaattttcgggcttcaagtctcgatgtataatcccaatttcttggtgtaaatagtttaccgcttgagccaattgggttataatgtgtcgtgatacatcctctgaaagataagtatacttgatgatctgattgaagatttcacctcctctgaccaattccaatactaagtaacagtaactactgtcttcattattgatatattcgtatagtcttgtcacgttagggtggtttaacctcttcataatagagatttctttcaaaacattgttcagtttttgtttagtcatctgtgacttgtcaataatcttgatcgcaacatcacgacgcttattttctacaggatatcttccgtctatagcttgataaacattggagaaggcaccgcggccaatcaattggactaattcataacagcgcgggagatcataatatttggattggtcaatggatggagtacttggatctgcctgctccttatcggcgtctgtatcttctactattattactgggtccggactgttagaatctggctccacgggagatgtaggttccgatgctgctgcattgtccttattggattggcccttgggttgaactcgggacttccttcgccgatctttctccgaatcgtgtggtcgtatcaactgtttgaggttatcaaaaagtgtcataatgagccgaatattcccttcaaatcaaaatggtatcaataggaacttcaggccaagggttcagcgcagacacgaggagagctaagaggtaaagaagtgtgattctactaggtgaaaggttatagggaagaagggttttcgcgataatgtgacatgattaaatagcgatagataccatacccggttctgacatcgttcttaaattaaaaatatgctaaaagtttgctgcagcatttgaagtacctctatagttcgtagaagggattggcatgttaccaaaagccgagatatcatcacccggacctgcttcagagggttcatgcttgttgttgcgccaaaacattagtgagcctaagaaaccattactaggacgctgaacgtagtgaccatccgcgtcgacgtagtctgactccatatggttctttttcgtgatggagtttggaggcgaagtggaagcatgctttcgacgccaccaccataacagaaccaccagtccgaatattactgggaccccaactcccactaccactccaatcacaatatttctgtccttctcagagaaaccggagttgttgtcggaagaattctggttaaccgaaagagatggtgattcagcgatagtggaactgctcgtgctagaagtagaacttgactcagagctggaactagaactggtagttgggacctcggtactggaggttgtgttgtcattagttgtgggatctgtggttggatcagttgaaccagtattagtagatgttgtgggtatagttgtagaagcttcagaggtagtgggctctaccgttgaggttgaagaaggagtaacattggtggaagtttctgtttcctctgtctcctcctcagttgcagtgggtgtctcattagtgtcattagaaaagaaagaagaggtgaacgctgaggacgtggtagtttccgacgacgattccgtggaactagtgggtaagaaactcgattcagttgaggactgtgtgtcagaagtgaaatcatcactagaagtcaaactaatagacgaagagttcccatcatcacgacggaaaaaagatggattgcgagtattcacaccaagctcatcggcacaagcaaacacgtttgcaaataatagccataaaacccaaactgaacccaggatcatattgcttgtccttgaagaaaaaaaaatcagcgactaaatatagatctaaagatagaactaacttctcgctcctgtttttttggtgtagatactgggtgcatccgacatccaatccctacctaagtaagagtttcgtgccttagatttacttttcggtttcggctccttggatcacactacactgcccctatgagttcttcgcgagccaaaagaaaaaaaaaagattcagccagtgtatctgtttttctcctcttttgtttccttgcacagtgacatgaatcctattaaggctgttgtggttctctttgaccgttacttctacagtgaaaaacagagtgaatgcagtgatctggacttgcgtgtcaaacccgactggaaacagttgcggacaaggatcagaactatgcctacgtgtgacatatgtcattatgcctttcttttgtctgttatgatgatatccataatagtttctcccgtgcacatattattcaagctagtggtcataataggacttgccactatcttcattgtccctctgacgtcgcagttcttttggtcggctctccctatactcacttgggtgggcctgtttttcaacatgccatttattcctgtttggatcaaacctgccattactgttcagtcattacctgcactagagacaatactttatggagataatcttagtgatatcttggcagcttcacccaatgcttttctggatctgttggcctggcttccatatggtattattcacttcgctttcccgttcatcctggctgcattgttgtttgtttttggtccaccccgctgtctaagggcctatgcatttgcttttggttacatgaacctgatcggtgtcattactcaactactgttccctgctgctccaccgtggtacagattacttcacaaccttgaacccgctaattactcaatgaacggatcacccggagggctaggacgtattgatcaattgtttggttttgacatgtacacaacgaccttttccaagacgtcaccgatcatttttggagcttttccctccttacattcaggctctgcagtcatggaagctctgtttttcagttacttattccctcgactgtcttgggtagcgtgtgcgtatgtttcatggctgtggtggtccaccatgtacctttcacaccattactttattgatcttacaggaggcgctgtcctctcgttgaccatattcacatataccaagtaccgtcatttaccgatgcgcagcctaaagtgctggtgccgatggtcatacacctctatcgagaagtttgatgcttactcttcgaatccattgcgagggaaaacatctgctgacgtcgtcattgagcttgacgaatctttttcatcatcgtcatcttctactaatcttaattgggtttaaaaaagtattttgcatacttattctctctgtacattatctgttgtatcattatatcataataaagtaatacactccatccataccaaccaaaagcatgaatatcccaagtcgcgcatccgcacgattagaagctagtaatcacgaaaaaacataatgtaaaccactctagtctcaacaagtgtaccatgtcagaagtactaaaaatagattattcaaggcaaccacagctcactcttttggaagccaacatattacagcaataccaacggctagctttgcttttacgaagattgtcttcagaaatagcgagaatcactgctcaaccaatgtcccaactaattgataatttgtcaggactggaaaagaaattgagccttgtatcaacgttgttcaaaggcgccgtatactccttgtttttgcagcaggagaacaacgaacagagacaacacgaaaatcacgaaaactactaattcaaatctacttacaaacaaggaaacgaaactgaatttacacactcaacttgacagcttcatcgttgatataactttggtaaggctttagggcttcagcaacagttaccttaacgaatttttcagtttgctgaggagcacgaccaacaaaggtcgatggatccaacagtttctcaagatcatcccagatcggtttgaaatattcggtattcttaatacgttcgatcagatcgttgtcaccaccctgttctttaactacagcagcagcttggtgagacaagacacgaatttcttcgtgacaatcttgacgggagccaccgttctcgaccatggccataatgatgttctcagttgccatgaatgggagctctgacttgattctgcgctcaatcactttagggtaaaccaccaaaccagatgtaatgttcaacagtgttgacagtagaatgtcagcggtcaagaaagctgaaggaagcgagatacgacgaatggccgaatcgtccaaagttctctcaaaccattgcacagcagaggtttgaaaaacatcctggtacagagatcccaagtgcctagccaaagagcagacgcgctcggatctcattgggtttcgcttgtaagccatagcagaagaaccaatctgtgacttttcgaacggttcctcaatttctttcaagtttgctaacaaacggatatcagtagccattttgtgggcagtggcacccaaagatgataatggagcaactgcatcaatatcaatctttcgggaatatgtttgaccagtacaaggataagcatggtcaaatccgagcaactccacgattttttcatccaactcgtcgaccttatcatggttaccatggaaaagggataagaaggaggcttgagttccagtggttcccttagcaccacgcaaaccaatgtcgtctctggcacgttgcatgttacgcaaatcccacaataactcctgcaaccaaagagtagaacgtttccccacggtggttaattgagctggttgaaagtgagtccaaccgagaacaggcagatccttgtattcaagtgcaaatttggataaacggtcaatcacattaaccaacttggggatcagtatgtcgtaagcatcacgcaaaaagatcagatctgcgttgtcagtgacataacatgaagtggctcccaagtgaataattccagcagctgcagggcacgtcttaccgaaagtgtgaacgtgggccatgacatcatgacgaacaatagcctcttccttctttgcatcttcaatttcctcgtcagtgatctccaaatgtttctccatctcggcgatggcctcatcagtgatcatttcaagaccaacctccttttcagctttggccagagtcaaccacaattttctccaggtggaaaaacggtgacgtaaagagaagattttagacatctcatccgaggcgtatctggaagacagtggggtagcgtatttatcgttagacattggtagcgtagttcttagggcggactgaacaaagaggaaagaaggaactatttatttaggcatctcatcaatttattgcctgacagagtcagctaattgagaggggtcgcgcaagtttagtaggaagtcttctcagtcaaacccagtgggccgaccaaccaagcgcgattctgtcatgaaattgattctggttgtttccttctcgtcctctttttacaatataccccgtctttttttttagagttcgttgttaaatatcagtcgagagtctcctgatgtctgcgttgaatctttccaagaatccgatatacgaccattgcttttctcaagatagaaaaactgtcgccatcaccaaagaaaatgatgttttgttgttcgatgtttccggtgctaagccatctctcatcactaccttaacacaccatgacaaaccagttactgcggtagacatctcctctgacggaaagattgttacatgctctcaggatagaaacgcccttgtatgggagccttccggtgatggaaagacatataaaccgactttggtattgttgcgaattaacagagccgctacgtgtgcaagatgggcccccaacgggaaaaagtttgcagtaggatcaagtgatagagtggttgctatatgctactatgaggcagaaaatgattggtggatttcaaagcatctaaagaaacctttgcgttccaccatcttatccgtagattggcacccaaataatgttcttttggcctgtggctctgctgatggacacgtaagagtgttttctacatacatcaaatctgtggattcgaagcctgacccctcggtgtggggtgaacgcctaccctttcaaacattatgtgccgattatatcagtaactctgggggtagttggattcatgacgtctccttttcaccaggcgctgagtttttggcatttgtgtcacatgatgggaacgtgaatattgtttatccttctcctcctgtcggctctgaacctggcgtgcctgctgcctattttgaagtcagaacccgtcatttaccattcaaatcgctcacgttcatcaatgacaataaactggtggctggtggatttgatgcccacccagtagtatttgagggttctgagcaaggctggcagctcaccaagtccattgatgatccaacggaagcaaagaaacatgtccaggaggagcagtctgccattgatcttttcaaatcaatggatttgaagggtaaatcaggttctaagttttcggagtctcttcctaccattcaccaaaattcaatcaccaaagtaaaactctacagtccaaactcaatatccacctcaggcaatgatggtaaagttgttgtcttcaaagtttagattacgtaatttaataggtactgggttacacatccaaacacccaatcggtatgttaagcagggcaatgtatttcgataaaccctccagcagcaatagcagtggagttcattttgtaacaagattataggtcgttcaatctcaatgtccgaggcacagtcaacaactaacacacactctgaacgtaagaggaaggttctaaggaaaaagcctgaatccaaaatgtcagcaaagcgtcatgtttggttagcagggcatatcctgactttggtgtttggtattgcttacgatgtattgtacgttacgctgagatcccgttcgacttggttagctcctctgttttatcgaatttcgttgctaggagttcttgcttgctacacattaacaattctaacagtttttggttccagagcaataccctcatattttacgcttttagcaacggagaatttcagatacctgttggttgccattatatggttttttagcggcaattcactgttcaagctcttaccatacactttaatttcgatcctgcacctcggtaagtacttcaagcttaatccaattctcaggttagagcctattttcaagaaaattattgtgtacaatgagctctacgtcatgttagtgatactggcggatacatttatgctacgcggtgattcagggtttgccctcgtgggctacattatgatttattggttgcgtctgctctactcaccccagtccagacaggtattgtatttcttcatcatcagattggatggtttggttaagtctcaaaaaaacaagtacatggttagcatttgggacaactttattgactacctgaaaagaaatcaggactacgacgctgcattcgtcgaggaagaaaacaagactgctgaaacttcagcccccgtcacaaaagaaaaaacaataaattccgctcatatgtctagtaaggaacatctggttaattcagtgatttctggagtatcaaaagttggaggaggaatctcaggcggtgtcagtaagggggtcggagccccaaagaaggttctttcaatggcaagttcaaagattcctggaaggcgtgggtctggtggctgaatgggaaacttggtagaaattagcatacttctctacatacgactaataggttcggttcctaatgaaagttttcagtggttttggtaaaatttagttatcttcattagtctcagaagcagaactgaaatttttttttcatcattaaactttcagtcggaacacaatgcctacatacttgcgaacattgtgatcactgagtctggctatgatgttagtaacgacaaccggggtatactaattggttggactaatcgtcaaatattcagatggtgatgcatgtttttttccttagtacatggtgagttcacaggaaatcaagtttgtgaaaacgattcatcataatatcaacaataagcctagtattgcagtgccacttactttaacaagctcgtatattaggtaaaaaaggtaaactgaataaagaaaaaatgcattgggcaggtggatcattagaatttcacaatccgggtaactttaggaggatcttgaaatgttagggtcagagaggaagctattcaacatgaaaggtaaacgacttcgatactaaacacagtaggctctttcgtaagagtcgaattagtttgattgatttaaggtgctattggctgaaaccttcgatgaactaatataccagcatttaaaccttgaaactcaagaaaactgcaaacacactcgacaaggaagactattctctacattatcatacgtggtagtactatattatcagatgtacactaatttactcggaagcagtagctctagtgtagatctgttgcttagagtgcaacagaactggcttgatgacaccgtcgttctccaattgtctcagagcaacacgagccatagaaccaccgatctttagtctgtcgaccaaaacggagacggaaacgtatctgtaagttggaacctccttcatgattctgtcgtacttgtcctgttccaggatgacagcatgttgagccttgtccttaacctttcccttggaccacttcttcttagacttcttactaccggccatggcggcagcggccttggctgccttggattgttgaatctttggtggcatgctaaaagggttagtatgactgaaataatcctcggaaagcagtgatgatagtgaaagagaaaaaaaagcactcattcgaaaacgggaaagaaaatgaatatctagcaacaaagcacagacaacagggaaacggactatttcataaatcttgagatcaagttttaaattcacttgagagttgggtaattgccatgctgaatcttgagtaccttattctattacaactaatattcgtccatgaggtcgtttgactctctatccatttctgtctccctgtacatggctcagcaagtagcagatactatttcaaatttcaaatagataatcttttttcagcacactaaacttgttaacttacctgttctttaacctgtgtactaagaaaagttggttctgattttttctctttttctctagggtgcgggagccaacgcaaggtagtgtgaacgtcccaaaatatcaaagtcctgccagttttttaaagtcatgtgacaaaataggacggcgttttgcctttctgatgatgcttgtgcagggcttaacccttttcatttgttgacacctgagcgcgaacataaacctcctataaacatttatcaaatcaaataaacctcaattaagagtaaatgtcaggaaagaggagagctggttcccaaattcaaagggaaactctcgggcacgacgatgacacatcggacgaacagtcatcgggattgcatagggcttcagcggaagtcttatccaaaaggaaaatcttaaaacccagaggtatgttgtcttctaaacagtccacaggaataaagttttcgcatccacctgtacctacagtgagcagcaccaattccgcaccttctttggctgatgataacacgcacaagattgtagcgttaaacaatcagtttgttgccgctatcgagcaagccaggtctagcgatccaagtgctgatttcacgcccattctcacaaagtatctggattacttgaaatcattgaaaaactctcaattgctaccaaaatctcagtcagaggcacagaaaaccagtaaagcagagccaattgacgtggactctgactccggctctgcgtctgaagatagtaaacctactgaggtcaaaattcaaggaccatccttcagtctggaaactgttccgacggctaaaaattccgttttctcgtttggaaaaaagagtaagcctgaaattgtctttagtgatgattcagaagaagaagttaaggtagaaggcccatcgtttactctatctcagcctgtagataaatccaaatttactggcgttttcaagttttcagctgaggcatcaaaggccaaggaagacgctgcaattgagccaccatccaaaactgatgaagagaaacagccttccgcttttgaatcgcaaccagatgttagtgccaagggtgagttgactgcctcaaagccgcgtacattagcttcatccactaatactaccactgactccggacaaaagcctgtagcatctgggtcaacaactacagataaaggaacgaccaaacccttcacatttggtaccactgcttctgttcctggctcctctaagcctttcacgttcggttctgcagatactgaaaatggtgccaagaagtttacctttggtacatcgggctcgactgagacaagtgctgctgaagagaaacccaagccttttacatttggatcttcttctgtcaccgacaaagcagaatctgatagcttgaagcctaaaggttttacttttggttcaaacaatgagaatgcttccaagcctttcacatttggtgaaactaaaactgattcttcatcttccaaaacttttacttttggatcttcgaaacctctagaaccttcaaaacagtctgcttttacttttggaggttcagcatccactaaggcagcaccaacttcatcctttggattcacgttttcaactccaagcacgaattctgcaactacaactgctactaccaatactcagcctgaggccaaaaatgcagatgagcaggttgaggaagtagaggtcaagggcgactttaaaaaagtagatctgaaacccattgaagctaaagaatcaaaaactaatgaaacgacattatacgagaaaagagccaaattaatgctatatgatcctagtaacactgaatctgtttacacaaataaaggcgtcggagaactaagtattaggaaaaacaacgatactggaaaggcaagaattgttgtggtcattgacaatactttcaggaagcttctcaatactgctatcttggcgcagttcaaatacgagaagttgggaaaaggtgacctagtcaaggtgcctacaatcaattccgatggaaaattggaaacctacgttattaaggtaaagacagctgcagacggtgagaaactactgacagaattaaataaagccaaagagaatgtataataaatgtataatatattgacatcaatgcaaaacgttcctgacttttgctataaattcttctgtggatccaacgtccatatatctaaatcctatgagactttctgtggataatcgtctggcgcattctttggggtcaaagatatgcttattcaagtttttcaggcagtcaatacctaaaacctcgatgatttccttcttggttccgaataatttgtagttgattacgttgaaaagagccaacgttgatctcaaaagaaaagtttctccttcaaacaagtaaacgtccatcaatctttcacatacctccctagaaagctgacttgtaaagaatgtagtaccaagtagtggcagatattccgatggagaaagattcacaatcttgaagtggttgtacagtgaattgttggttttgaacaacatcctctcaaaagaggcataatgagcctgcaggtaatccggattcagattttgagtaatcgaatgcgggtatgtcctcgtaaacagattgatagcagctgtaagtgttttctccatactgcctatattctcaaataacaaggaaaccaccccggccaaaactttagtatcaactggcttaaaactgtgttcttcatagtataatagaaatgctgtgcaaatcaaaataacagacttttgttctgactctggaatatctaggataatattggaaaataacctatcatccaatataagacgcttcttagccatttcaattagttgagaggtattagaaacactagacttattcccaatctgtttaacccatatgtcacgacgaattgattttggtatgcctttccaccataattccctgataattggaagctgtatcatgtgttcatatttggggagaacgtagtccttccatatctctaaagacttttttcgttctcttataattttttcattctgtttcaatcgttgctgttccagcaacttttccttttgagcagatgcatatagaatttgctcatactctctctgatgacactccatttcatacttggattttggaggtaaatctagttgtcttgtgaatgttttatagttcaacgttctctgagagtgaacgtgtgactccttatgagagccaaccaaataattgtgctgttgtttcattttttgtagatagaagtttctttgggtgctttcttcattctgagccattaagttgctactattaaaggcgatagtcagaaacttggcgtcagggtccattccctccaagactctatcgtattcctgatcaatttgggagagctcggagcaattggtgttcaaggaaaacaatgaggacctgttagagttgcatctggaagagtctatagatcgaggtctatttgtggggtcttcactgggagtaggcggaaaaacaagcaaattttcttttgatgtcaaacactgcaatgatctcgtcattggaacgttgtaaacgatcatattttctggaatctcatcctcactaaggtcgtcgttcactttgccacaagccgagttcgtttgtcgcaattggtttttgatagctttgttcatgatcttccgcctaactctaaactgctgagatttggtgaggttattaagtaccttcgattcgtctattatgggttccgatctaccagcaagcctaccaatagtcttatacttcttgccaaaagggccgacgctactttcatctagaggtatctcttcaaaggactcgttaatcacctccaacacagcttgcttcactgacataacgtgccaaggaatctaaaaatggcagaaagagggaaaggattgacagttgggataaaagataataaacgaatgttgtggatagttctgccagaaggaaatatcaatttaataaggacgaacagtcaaaaaggcccagttaaagatgtgatattgcgtggatgttctgtcaacctgcctgtatccaaaaataagactctccttcgtcttctgttttcgaaacgatggtggtgttcgaatcttatttcctaccttcgaccgcgtttcgcacataaatctaatcctaaataggaaattgtttacacttgattatataagagaaatatctacaaaaaatatatacatattgagaagatgggtcagttagttctatttacagtcgtccttcttattggtaattctcttgaaagcatcggataaaaatgactcgattttctttagtcttgatgggtgatctgaatcctcgccttcagctggtggggctgaattctcgaaaggcttccaggatgggttaacctttttggcggtggtgtcgttaaatgtatcagcaagagcttctaagagagcagtctgagttgcattatctggacgtaggaccttgacattgaactggactttgagagctcctctattgctgaggcttccatgaattggaacaccttgtcctggaatggaaacagttcttccatgttgagttccaatgggtacttttagcctcaacttagtatcatcaagggttggaatctcgacttgacctcccagtgctgctgtggtcataggaatctcacaattataaacgatgtcgtttccgtctctggagtacctagggtcgggcttcactctcactctgataatcaaatctcccttgacagttctaacatttggccctttggttacgtttggagcatctccagctccggatactcgtagcctcgttccatccctgattccacatggtagtttgacctctgtagtcttggaagactggcccaccccatttccgtggcagtggccacactggtcatctttgcttatggtcactccagttccgccacatgcattacaagtggaggacatctggaacccttgtaagtaatgtacagatgcaccagatccattacatgttgaacaggtggatttcttccttcccttctttagccctgtaccttcacatgtgttacaaccatcgaggacgttgtaattgactgaagcgttagtgccaaaaatggattctttgaaagaaatggtcttcaaaatttcaacatcgttaccttggtattgctccatatacgcagctcctccagctcttcttcctccctgtctattcgcaccgttaaatgcatctccaaaaaggtcctccaaattgaaactaaaccctccagctgcgtttccaaaaggattgcctgctccaaaggggtttccaccagcaaatgggtttcctggtccacctcttccaccgctgccacccatggggttaccatcagagtcaaacaccgtgccaaattgatcaaattgttgctttttctctgtgtcactcaaaatttcgtatgcagcttggatgtcatgaaatttcttctcagcccccttctctttattgatatctgggtgatactgtttggctagcttatagtacgcttttttgatatccgaagtgcttgcattgcggtctacattcaaagttttatatggatccgaaataagtcgggctgcggacccgtgaaatcctctagcctgatacttgcttaaggggtgtcgctgaaatgcgcatgaaagcaatggctgctttgttcgcagccatacgagatgtggcaatcttcgattcatcccttgtaagaatctttgactcatctcgtgaagtgttcttatagtaataaagataagcttcaagcattacgaattttccagaacatgagcgttaaattatcctgggcacgaccatgggaagctgagaatgctcgatgacgaatactttgagaaaatgtcctttccatttgaagggcttcgcgagggaggctccacctaacttagactcagatgctaaaaaaaggtatcccttaatcagtgctgtctactaaaatatactaaaagacaaactacgtaggtcgtctttgcggaaccgtacaaatctccccattgctcctggtggtaaaccatctaatatagaggccagattcttgggagtttcaaaggttgagagaataatataaataattctgacatggctacaaaatctcatcaaaggccgaagtctatcagtacatttcaggatcttattgactcaataagaaaacacctcggtaccccacgccaacttgaatccaatgaaatagaccacgtttatcttcaagagatactgaaagagtaccattctaatgaaaaagaatgggaaaaatatgccttgagtgacccttcaaagagctatagccgaaacggagtggagaatataagctgcaatgctaacgtcttgattctggtctggcagccaggaaaatcatctttcattcatgatcatgctaacgctcattgtgtcatgaaaatcttgaagggtagccttactgagaaattgtacaaagtccaaccattggaggaagatgaaaacaatttagagtgtttcaaagaaacaattttgcatacgaatcaggtagcgtatattaacgattcaatagggctgcacaaaatggtcaatgcagatcctaatgaaattgccgtttctctgcatttgtatacaccaccatatgcccatcttcatggatgttctttttatgaggaaaaaaacggcaagaggcatcatgttctaatgagtaaattatacagctggaaaggtaagaagatcattggaattaatgacagtcgtgtaggataaatctaacgttagttgctgaccccacgcacccagaactcggttttgtcagaaccatcaataccatgtatttttttccacttgtagtttattttgatgctgagttcatacttttcctttttgagaagctcacatttatcgaacagtttatctctagccactttgagctttgctagttgtttcccttctggcgtgttaaggtaattagacccagagggcaaaaggctatccacaaattctaactctcgttcgattttgagtatttgatttactaactcctcatgtttttcctgtaaacttgacagtttttgctctcccaaactttcaactctatcggaatcaatcttagttgcagtgaattgcgacgaaaggtttcggaattgtagctttggttctattatttctctgtttttcttcacttccagggcgatattggcctcttcgtctaccaattgctcagaaatcaggcgactatcctttgtcaaaccatcatggtccttctgatgatcagcctcctcattttcatcatcagtccttaatgctagtccctcagctggaacccttttcacattatcagctaaagatccactgaatgagtcgtattccagctccaaatgattataggaacctggatttaggtctttgaaggccccagtagagccattcactggtgtcatagtgacgtttcccgttccttgcgtgaaggaagtagttttaactaaagaaacactttgtatatcaccatcgtagtcgtctaaatcttcatccaagtttaccacaatatctttattatctgagataaaggcaacatccgagtctttagggggttgttcaattgtatctgtatttggagagtccataggtgataatgattactttgaggttggtggacaaaacgcgtttctcttttgtcaatagagagaaaatgaaactgcataaacagttgatcacgttcgatgtcatgtgaccaactctaatgtcgttcaagcaccacatcatcactctttcattccgatcaaaactgaccattactaaaaccgataaacactgataatggagagactagacgttgctgcccattccaaaaagatccaagagtattatgacaaagttgtcctttccaaagacaacgtaacatatgctgtttttacgtcggagaaagctaccctggtcccctccacactgggtgatggggatatcaccgattttttgcaggagtttgaagagggtaaggtccaatatgggcttgccaaggtcaatcctcctggatcagatgtgtacaagttggttttactgggttggtgtccagatacagcacccttcaaatctcgttcctcgtttggtgccaattttggggaggttgcaaagatcatgcgtggttaccacgttcagatcactgccagggactctgatgatttggacgtcaaggacattttaaagacagtttctgatgctgccggtgccagatactccatccagtacacctccggtaagtcctcaaacccaaagcctaagcctcaatcgttcagaaaacccgaggaggcctcatcggtggtaaagcctaaaattgccccttctattcccaaaaaggcacctgtcgtaccttctaagaaaacaccgtcatcttcaaccaatgatgaggatgaggacgattgggatggagaaaaagaagttgaggtaagggactttactgagaaaccattggagaagcctgtttcttcatacaaacctcaccccaaggtcgatctcgatgcgataagaaaagagggaaatagagaagcaccgctgttagtaaaggagcccatctctgtggttaagactaaatccgctcctttcaaaccggcacctcctgtgaagacccctgtttttggcacaaaagctcccataatcagcggtttgcctaaaaagtctgacaatgtaattggaggattatctcgtaactttggtgctgaaaatgggaagacccctgctcaactgtgggctgagaagaagggaaagtttaagaaagctgactctccagaggaagacgtcataactcaactaaagtcttcctcattggaagatgagcctgatgcacctaagagagaggaggagtccgaaccagaaccagaaccagaaccagaatttgagtatgagcaagagcaagagtcggaaccagaacctgaagcagagcaagagccagaaccagaatcagagccagcaccagaactggagccagagcaagaaccggaaccagaatcagagcctgagttagagcaagagcccgaggttgaaagtacgaagacgccctccactactcaagccacggctttatacgactatactgcagaagaagataacgaaatttctattactgaaggtgagctgattgttgaaattgaaaaagttgatgaagaatggtggattggtgtcaattccaagggagagaaaggtctctttgtagccagctatgtcaaagaggtatccgttgtaccatccaacaaaaaacctgttcctccccctcctgctccacgatctcagtcaccaaaacgtaagatagtggtagctgagtacgattatgatgctgccgaagacaatgaattgactttcaaggaaggtgacaagatagaagtccttgaccagcctgacgatgactggtggctgggccaagtaggcgggcaaaaagggttgtttccttctaattatgtctccgcttgagttgtatctaagtaatccttcacaagtgaaacccaaaagtatactgtagcagtcccacggggattagtcttgacaccccttctagcaataattccaccatgcgaattgaatgtgtctatataaacgggaattttgatccaatctagttggttgaggtggtaatgtattgttttcctgtcttcgtcaaatggaatttcaaactcttcagtgaacagtggaacttctgaatctccattgaagtgttcgttgacgtactggatggctttggcaaaatctctaaaattaaatcttacaacatcattgttgtgtatagaatttgacgattgaactttaaccgggttctctaaaaggggggaacctgaactttgaccataatcagactcggattcagattgggcttcagattcgccgtcagattcggcgttgaagtcattcaaatccaagttatcactacgagcttcgccaagctttttatctaattgtagagtatcttccagtatcgttccaaccatctcagaaatatgattttctcttccttctgactggtgcattttctggtggtccttcaagcttttgtgatgctttgaatgcatgtgatccgagtttccatacaatacacttcgaatcttactccaaactgtttctaagttattggaagacagctgaaaccgaagccgtacgtagctttgcaaagttccaaaacacgtcgcaataaaaacaacaggaatccaaaatggtagaattaccattattaccattaaaatagcagagtattggatgacagtctccaaggtgtagccctttttcagctcttcaacccgatacgagttttgcaaatctactaatctgggtgcggtaggtttatgagaaccaatagatacatgaggcgtatcgtcaacgtattttaacttgattccgctccacttgctaaatggcgtaaacgtggtaatataggaggtatagaatgccactgtcctatcatttcgtatgttggcaagtaaaattttcttctggaaaaggtccaatcccttgtagtaaacatcctcgggatcagctaattggagtagcatatcagagttatgcaggaataggtctcttcccgtctgacccaataccgtggaacctaaaaagtttgcggtggatgatttgattgaactatcccaaaaacgaacgcccatgtgtggagtggcgaatgttgtgaaaatcactggttctatcttgtcaaatactccgagtcgatataactctccgatacagtaacgggcaatcaaacctcccaaggagtaaccaacaaaacttattttagtgactttgatatcctgctcagacagcaattcgatttctgaaaacaacgcctcgattaccttgttcccacagacctctatcccatcatatgtcttaaagaaagcgaagttggaaggtctgagaacgtgataagagtcatcatcaaacgcatctttgatggcctgttcaattacttgcaaatgattgggaccaccccaaagcccatgaactaacgcaaacagatgagtttcagacatagcttgtgtttggttggtgttggcggaacagtacgggtttgtgccccatatatacatcgcttttcttgacatgtgataactaatctcgaaaatataaagttaactatttatggctgtgacttgtggacaaaagaaaagaggagatgaaaaattcagatgaggtgaatagagtttggatgagtcgttgaatgtgtcattctcttgaaaaaaagtgaatcagccataataagcggtgaaaaaaaaaacagttttggggcgtctttacttcaacttttgatgtcagatcctctcgtatatgaaattacttttctttctcctctagttctattctgcaaataaatagctctggacgttttcttcttgtacaccctcagactcttcttctaaatctaaccaagtgacagagtcgaacgcaggatttttcttagttgtctggataatatcgtcgatggcacttcttactactaagagacaaatagcatcaaacccaccagcaccaggaactacgcccccaaagactccaggaatatcggagcactcatttagtaactgagtttgggaaggcggttcgatgtcagcaccagttttctcacccattatccgtaattgctttctaatatgttgaaatgaattgatcacgttcaagagaggtttggattccaaaaaattcctggagttattattcaactttgtaatgctattcgcagaatgcaaagacatgaaatgcagcagatcagtatagtttgaacttgtagctagttgatttaagctttcaatcaatgacatattggcttcatcaagtttcttccacaactcgtaagattcctctggtttatctcgtcgccattgcaaaactttggaaaccaacttgggagtttctgagccacccatgacatcacccatcaacaattttatgcctccagggagagcacatttttcagccaccattctccagtcttgaagaacaacatcttttatttgatgctgttcaaaagcaacgccatcgattagcattggatcaaaccttctgtagacaatggacccaaaagtagctgaagcaacatcaaatccggaaccaatttttccttgtgctttacaatgggctatctgggccaagttatgaattgttttaagatctgtcattgattctagatcaattttggagaattctgccaacaaagcagtggtcaggaccgtcaccaaaccagcacttgaacctaatcctgtcttgggaaccttagaaatatctttttcatggaaaagaaactttcttccgtttctgctgaatcttacgactgtgtcttcctgagaatgatattcaggatcagagtaaatggtaatattaatgcaatgaaaagttgaagggctcagaaatgcaaacaccgcctccatggtactttcaataaatggatttcttttgcctaaagagctcaaaactccatccttataagtataggaccattttccttcgaattgtggagattgtacgaaaatggtatttgttggcccagtggaatctgaatctattgtagctcccattctagcagacaaagcgatcacaaacgaactgtagttggcatcaagaacaaggtagccaccagccaacagggctttgctcggagcgctgaaagctttcattaatgcttctttcaaggattgacaacttagtaccggatggacacttcacgactagttttcccgaacctagagttgtatcttgatctgtccaccgaccgttgtgagcgcgaagcacacaaatatcggctggtgcttaactttcgtgaacagtaaactccccggattctctgcttccataatcatcatgtcacaagaagaattgtggaaacagaccaagataattggaatcattggccttggtgacatgggaatgatgtacgcaaggaggttcactgaagcagggtggaaggtgatcggatgtgatagagaagagaattaccctaagcttaaagaggagattaaagactttcagatagtacaaaatggccattatgtttcaagaatcagtgactatatcatatattcagtcgaggctgagcacattgacaagatagtagcaatgtatggcccgtctaccaaattgaacgccattgtcggcggccagacatcttgcaagtatcaagagattcgaagttttgagcgtcacttaccacctgatgtggagataatcagtgtacattcgttgcatggaccaaaagttgatactactggccaaccactggtaatcattcaacaccgctctagcgatgagagtcaacaatttgttaacctgttgatgtcttgcttaaaatccaagcttgtgtatcttacttgcgaggaacacgataagataactgcggacacacaagcagttacccatgccgcttttctcagtatgggtgtagcatggcatgctagtaatcaatatccctgggaggttccaaaatggataggcggtattgagaatgctaaaattaatatctccctaagaatctactctaataagtggcatgtgtatgctggattggctatcaccaacccctcagctcacgctcagatattgagatatgccacatcatgctctgatctcttcacactcatgatccaaggaaaagataaggagcttcgagagaggatatacacggctaaacaaaaggtgtttggacacctgggagagaagcaccagctcctattagacgataacatacttcagcaattttcattgagcaaggagcctccagaaggcaagcaacccaattcacacttatctcttctggcgattgtggatagttggagcatgctcaacatagttccttatgaccacatgatctgctccacgccagtgtttcgaacatttttgggagttactgagtacctattttgtactccaaatctactagatgaggctttggattgtgctataaccaatacagaattccgtcatgatgacttggagtttattattgctgctagaaactggtcgcagatcgtctccaatggagattttagcggatataagagagaatttgaaaagactcaggaatttttcaagccaatgttacctgaagccaatcgtttgggcaatgaaatggccaagaagattctagagagagcccaatagagaaatggctttttgatctctttcttggacagagcacaattttttttgacttttgacccccccccccacctgttctaccacccccgcccaggtagattaccttcgagaaagataatattttgtctcatcttttcgctggcatctccagttatactacaactcaacctacttcacttcattgatcatcttcaatcaattctccacgaaatgggaaacgtgttcagtggcatttttggaaagctctggggtgtcaataaggagattcgaattcttttattgggattggatggtgctggaaagacaactattctttacatgttgcaaatgggggaagtaataaaaacaaaacctactattggcttcaatgtagaaacactaaaatataaaaatatatcgatcaatatgtgggatttaggaggtcaaaccagtattagaccttactggagatgttactatgcggacacagcggctgttattttcgtggttgattccaccgacaaagagagattagaaacagctagggatgaactacatacaatgctgaaggaagaagaactttctgacagcgccctattagtttttgcaaataaacaagatcaagctggtgctctaggagcctcggaagtctccaaagctttgaatttggttgcattgaaagatcgaagttggagtatcgtggcaagtagtgcgatcaagggtgaaggtttgaccgaaggtttagactggctgatagatgtcataaaggaggagcagatgtagagtatatatgaaacggtatgttataaaagatttattaattgcccgtctcgagtagttttatgtagatggttctttcggagcatggatcaactaaatagcccttcctacatgctcgcgattatatccacacgctcccaccagccttcggtagatcgttccctaccagtcacttgttgatcatcggttgctctctactttagttctgctattcaaatcgttcattccacaaatgaaccgactaagaatttcgttaaatccttcaaggaatgcgttcaggcgatttggattgattttgggtagctcaacagcgttggtttactactccaatcaacattacaaaaatgattctccattatacaaaggtctcttcaaaaacgatcagttgctatcaaataggcacctattgaaggcagacaaggattctgacactcttgaaagaggattgtttgacgcttctatgaaagaacttgaagagcagaaccgtaaagttagagcgcaacagatgaagcgttttgggtggttaaccaagcttaagttttctctggtggattacgtttgggaaccgttggttactgtgggacgactaatagaactgaccattcttttttctcctattcttttgttaaggccaattgtttggtttgggcatcgacgacatgatcgtagcaatgaaaaatccggagcaatcttatggtacaagtatatcaagttttcagccgaactcgcaggtccttcttttatcaaattaggacaatgggcagcatctaggacagatatattccctgaggaactatgtaatgaattaggaaagttgcatgctaatgcccgtcctcacccacttcatcagacaaagcgtattttagagaaaacttttgggcttccatttgatcacatttttgaccactttgacgaggtccctttgggctgtggagctatagcacaagtgtatcgtgggaagcttaactctcaagttttggaagataacaaggtgaccgaagacgaacagtattttgagttaagtacaaccgacagcaaaggattaaggtcagcaaccagctttgaaaaccatcacccaactaatccatgggtcgccgttaaggtgatacatccaggcgtagaaatgaaagtacaccgagatctaaaaattatgaacgtttttgcaaacattatcaactatatgcctacaatggagtggttaagtttacccgatgaggttgaacaattttccatactgatgcgtatccagttagatctgcgcatagaagggataaatctgaaatacttccaagcaaagtttgctggtagagaaagcgtcaagttcccgaactcgtatatgaagttcagtgggagagaagttctagtagaggagtatatgcaaggtgtatccatgcagaaattgctgaaatgtaagtccacttttggaaaaggcatcaccaaagagactagtgacaagcttcttgatgcctttttacaaatgctgatcttggataactttgttcatgctgaccttcatccagggaacataatggtgagattctaccaggctggcgagcatcagattcatccaaaaaaatactcaacggaggaggaaattgatcaactttctgtacagctgaacaaactatcaataccagagcttgaagaccgattagagacgctccataaagagggttatcatcccgaagtttgcttcattgatacaggattggtaacagaacttaatgaaacagatagaataaatttcattgaactatttaatgccctcagcgaattcgatggatacaaggccggcgaactgatgattgaacgatcacgaaccccagaaactgcaataaataaagaaatatttgctctcaaagttgaaaagttggtagacagaatacgagaacgaactttcacattaggtagtgtatcaattggggacttgctggaccaagtcctcggcatggtacgacaacatcatgttagaatggaaggagattttgtcaccgttattgtggcaattcttttacttgaaggaattggaagacagttggatccagaacttgatctatttgccaggtatgtatatggttggacccttggatttcctacctattagactaacccgttagctctctaccagttctaagaaaactaggtttcaaagatggtaaaatgatacttaagaacaagaacacggtatctatggttaaagtctggctagtctttgaagtgcgacagtttatacacgcttcggttcaagatgtaagtacaaaattattcccgaaaaaagttgaccctgttactaacgataataagatctacaaccttgttaaatctgacggattatctcccaactattagacggcaatttagctagacgaagcagttattatagatcatagtagattactcaagattagctcagatcggatcgcggagacacaacacatgctaacggctaccgattacgtaagcgacattatccagccccacatgcttctcacgtgctcttctctatgcaagaatataaaccccaaaccccaaggcctacctttcacagaagaagccaccactaggcacgtttcctatacggcatgaagtttggcaagacctttataggtcatcagataccagagtggtctggtgcctatatgaactataaaggccttaagaagcaaataaaacgtatcagctttgaattacagcaattgagatctcaggaagtcgattcggttggtttactcaaaaacgaaactatcaaaacgcatttggccaagttcttttttgatctggataggaatattgaaaatgttgacgacttttttaacaagcagtattctgagtatgagagaagattaaaaaaaatcatttccattattagcgtcttttctgatagtcaaaaccaaaatatcgaagaggaagagctagacgaacttttgaacgtactcattagtttgagatctgactttcgtaatcttaaatggtatggtgagctcaacaagagaggatttgtgaaaattcttaagaaactggataagaaggtaggaactacctgtcaaagccagtttttgaactctagagtctatcctctgtcatttgccaacgaatttgatattcttcgtcatttgaataccataaataaatatttgactgagtatggtccttgcttagaaaagttgtctccctcaagtgctacaagtttaaagatggatttgaaagatctgtccattgacacagtcttaaagcaacaatcgaaagaaaagcagagtgctttgaatgcattggacatttacgtatcctacattgaaaatgatgattctgaaggtcttaagagacgattaatcaaagagaatcagtcgtttgacagaattccgatgaagttactaatctctttgctcaataaagctgccttgaagactaaatacaaatgcatcgatttgatcattgtcgctattccgatactgggtgacaaatccgatatcagtggtcgtaatttctttcaccaccatgtcattgcattgggaaaacaatatgctaaagcttcggaattgcgcaaggaaatgaagaaacagcacttatcattccaacctgctatgactcccgacgaaatccatcaaagtcgacgtcttggatcttttggaccggatggtatcaactccaatgattcccccaatggattactttacatctttcaaaaaatcccagaacacttgaagttcggcattttacagagggataattataagagaacacctttgcattatgctgcgcagtacgggctgagagaagtgaccaatattattgtacagtgtcttaaaaggtggggaatgtggctcgataatgtttcaatcgatgatatatcggtctggggggattcagaccatttgaccccgttacatctatcagttttaggcaagcacccattgacatcagaagttttagtgaatgcaatgggggaaaatgtgccccttgcctgtcccaaacttctgcttatagcctcaagattaagttcccctccattaatgaagcttcttctgagttgtcaagggattaacattgattttcagaatcctgagaataacgagacggcattatacattgcttgccatttgaatctcttgagttccgttaaatttcttctagaaaacaatgctagcacagaaattggtgaatcaagttttgggtggactcctttgtttattgctgcatctgaagggctggaagatattgtgaagcttttgatcagctatggagcaaaaattgatgttgtggatgacagtgggtggactccaagagaacacgcctgcttgagaggccatccatctcttgctccaattttaaccccagcggattacgatcctttcgaagaaatcaagagggagaaggagaaggacaaactaagagagaaagaaaatgaaaaattcaaggaaggggacgtcgaaaaactgagacttggctctgaatcagaaggaacaatatctccccagagttctactcatagcatttttgccccaggatccccactacccgttagaccttcggaagctccaggaatctatgacttggaattgacaagtacttcaagtatagacgttctcccagatcgaaataattctactagcagggctgaaaatagaacaaccagtctcaatgacgagacttctaaggtttacaaggctttcaaaagcaatttgaacctgaaggaacgaagtaaacaatcaccatcaccagttccaataaagtcatttggacatatgtacttaaaccctgatgaagcaatcgttctcataactctaggaacaacggatttgcgggatacccatgaagcaattgacttgaaaagagtgccgatctctaaggcttatgcgacggaactggatacggctttgtcggttgtaattagaccacctgagagactttctcatgagaatcatcctgttgtcctagatcttccactggatgatactcatggaagcgctacagatccaattacatttaagtgttcgaagcaggaagcagagaatatgattatttactttgacattgtacctacctattcttttgatatgaatagaaacagagatgccttttatattgattataagcagcacgagaatggttcagaagcaaataaacaccagcacccggacaagaaggttttaggaagagcagtcgctttactatcaagtgcttatacttctgttggaacaaattatagatctttgaacaacgttattaccgttccaattctagagtctgattctctagaggtcttgggatcagtaaggttcgagtacaaacttgtgaatgcttttactcacccaaaactcacatttgatagaaccgaaacgtactggaagtcattagtatctaccaggcttattggtcacagggggttgggaaagaatagcaatagccgcaactcgctacaactcggagaaaacacagtggaatcatttattgcggccgcttcattgggtgcgtcatatgtggagtttgatgttcaattgacaaaggacaatatacctgtagtctatcatgatttcctggttgcagaaactgggcttgatgttccaatgtatgagctgacagctgagcaattcctgggattgaaccaaccccatggattattccgcaagagtaatgatagaggcgaaactcttgatgacaatgttctgttaaagtcaagaaataatttgagcaggcgaggtagggccatgtcttctgtcgatgctggcatcctttcacacagatccaaatcaagtgaaaacgaagacttggagcagtactctgatgactttaacccctttttgaatcacagaatgaagctaaccaggacttggaaagccaacaagttcaaaggtaacagtagaggaacttcgatcgcttcaccatttgtcactttggagcaactatttaaaaaattgccaaaaaacgttggattcaatattgaatgtaagtatccaatgctggacgaagcccaagaggaagagatgagtctgattttccatgatctaaatcattgggttgacacagttttaaaggttgtttacgagaacgctgaaggaagggatattattttctcctcatttcaccctgatatctgtattcttttatctctgaaacagccttctatcccaattttgttcctaaccgaaagtggaacacagcaaatggctgatatcagagctgcttctcttcaaagcgctatcaggtttgcaagaaaatggaaccttttgggcatagtatctgcttctgagacaattatccgggcacctagattagcggccgttgtcaaagcttctggattagtttgcgttacttatggagtaatgaacaacgaacccgccaatgccaatctgcaagtgaaagcaggagttgatgctgttattgtagatagtgttcttgctgttcgtgaaggactacgaaatcgtgagaacgaggaacaacaagctgaagatgtatagatttagctgaattcaaaagaacaaaaaaaagctattattacgcagcttggtttttgtagtctttgttcccccagttcactatgccaggatagtgcatccctctctctctaggcttcctgtgattttttttcctagctcgaattttattgaagccacactgatctttctctcatcatactggttaagcaatgtcaagattaataacccgatccatagtcagaactaacctgctaaccaatctcaggagatcggcattggtaacacaaagaactccagtatcaagcttgtttgttcaaagtaccaccaacaagtatgcagtcccagtatttttgtttcgaagctactccaagcagcctatcattactgaggaacctccagccaaagtgtacaattatgagcaaataaaggatataactgaagctccggacagcaatgtggtgctggtggacgtcagagaacctgatgagtacaaagctggtttcatacctggggctgtcaacattccgttcaaatcatcacccggagcactaaacctctccaaagaagactttttggatacatttgaatttgagaagcctagtaaggacaaggagctgattttttattgtctaggaggagttcgatccagtgctgcagaggaattggcgggcacttttgggtatctgaaaagaggtaactatatcggttcttgggaagattgggttgcccatgaagacaagaagaaatgaaggctggacgttttacgagctgtctaggtatagttatgtgaacttggataagtaattgttctcgttatataatatataattttttttattaaagattaatatattttcccataaaagataaattagacggaagactttgacatcctacgagaaaattcatgtgcaacgttatacatttaaccttaattttttttccaaactcgtctgaaaacatgaaccaacgtagaatactccagagaataattataaatatgcgataagtaagattagcatcaaataaactaattttagtatcaattccctaaaccaggtagtcttaagacctgctttcagtcttagtagtcggttgtctcctaacccgtttcgacatttctagctcatcccccttagccccagcttacgtgcataaaaccgttttttccggtacatcccatccgaatttaaaatcccctgaaatcctaaaaagaaagccatcggcccgataagatggaaaagataattcttcgttcacgtgacattcaagggggataaactaaaacaagaacaataactaggctcttcttactcatgctacctattaatcccttgaatttatatagcctccttggatgaatgaaaattttgctcttttgctcctctatccatttttcttatcaagatgattgatcggttgcccttagagattcgaagtgttgtggcccagaacctgccgcaaacggacaagtttcatctattgctcaccagcaagaaactttacagaagcactattgacagtgtttatgagtctattgtcatagatggcaatatgatttatttccatcccgagttaagctcttatttataccaacgaaacagcagtattgaagggagtggtaacgcgtttgtgactttgatccatacataccatggtttgaagagtttttgcaaaaggctgatcaaagaccccaagttaatatcaaagatccggtattttgagatatctaataacttgccagacaactttatcgaatttgaaatctacgagtacttgattaaaatattcccagtgatgaccaatctccgattccttacagttaactacaactcctgctacattaatttgaacgcgttccttatgaagttacctgaaacagccagaatgcagatcaaatgcatcgaaggtgactttacttccaatgtgcttatgcatggaccaacagcaagtatcaaagacaacaatgaccttattcgcataagttccaacagtttaagtagcctgaaactttacaatctatcaaaggaacttgatttcaggttaccaccaatgtctaatttgaatgttttgcacttgaatggtaaaaactataatgcctccaattacagagtccctgcagtttataacatcgtgaacactctgggtatagacttcaactttgttcaagagaatttcaacaagttcttttataacggaatgactaacgaggttaacgtcaccagcttcaactctatcttcaaccattacgataatcagttagttattgaagaagatcaagaagtgatcaattttcatagaatatttgccccagaagtgaaattcgattctctagtagaattcaaattggatcattttaccattgattacgctaatttggaattccttagaaaacacctaaatttgagacaatgtcaaaagttgtcccttttggatatcaaagagttgacacaattctttgatgacgacgatcctatggaggaagaagattatgaaatttccgataccgattcaatggatttccaattcaatatcataggggatgatattactgaggtgatgcagtatgacgcggcgaataacgatcaacgatttcctgatgaccttttcttcttatacagtttgaaagaccaagtgcagaacctctcagagctcaatgttaaggtgaaaaacaaagtgaaagatattgttccgctcttgcttcaaaaaattgcacgtttggaaaaattatatgcattcatatattattaccccagcagtaggcaatttcgaagctggagccatcagatcaggacttacttcgcttctttgagtaagcactctaatactataacaaggctgataattgataccgaagatcaggcaaacaacgaaattttggaagtcccatcatttgttttaaagcattacttgcccctgtttcacagcttaaggtgtcttcgtattccggtctcaattcaccatattcaccatatacttttgaggttgcatgctttcaacttagagtatctggagttgatatttccagagtttaattattgtcaaaatgcaagccaatccaatagcaacaatagcagcactagcagcgtcagcagtgggctcattatcaacaacgactacatgaacagctctccatacgtatcacatgtcttgtacaatagtgggaagactattgatgcgaaagaagttattgactggaaccaatattatggattttctgaatccttaagcccaggacagctcttagctttggtcaagtttgattcaactcagaacttgaatttgtcgtcctttaggctgaagcaacttgctcgcttattcaagctcaaattccccagtctgcggtacctcaagatctttaatgtcatcatcaagttggatagtcttagccacattgagattagggagaagggcctagaaaaatggttcaatagtcagctgttgagctgaaactaatcaaataagaaagaaatataaagctacttaactcattaattgcataaatcataacgtaatattaccgtaaaagttttattttggcctggaatagttcagtgttccacaatttttgcatgtccttttctctaaatccgtttcaaaggaaacgattgcgtccttcacttgcgttcccaaatcagagcagtaaaactcagtttcatgcactatttccttgcaattcagacaataccatctaatacggtcattcagtccctgaggacgatcctgttcaaccactaagccaatagtatcagcaaacctcactggactatgtggcgtattacctggtagcaaaaacgattctccttcattgataataatgtccttaaattcaccatcatccacgactttaagacacatgtggcccttgtattgatagaagtattcaggtgtctgattaacatgataatcggttctctcattaggcccacctacaatcattaccgtaaatcctcctctgtggagacagtaattattaaccggaggttgcaagagatgtccattctcttctatccatttcgggatgttgattggaggtggtagcattgggcgaaggtttaggaatagaagtgaaaaaaaaaactcagagttatcacccgattttgataagctaagggttggaaactccagtgagcaccggcgagggaattttaaagtgatgttagaatgcgcgctgtagcaatttctcacggtgctggcttgaaaagcattcaacttactgaagagattatttttgccaattggtggtatgtaaaattgcaaagcaattattgtgtctgaaagggaaaccttgcaggatatatagtatggcatgaagtacggaatgttacaaaaatctatcgttaaatgcccgctctaaccacttgaataacctctcgtagatcactttatttgcgttgtgatgggcaatgctatgttcactgtcgggatacacctgaagatcgtaattcacaacaccattaatattgaactggtccagtaaggttagtgtgttctgaaaatgcacgttatcatcagtagtcccgtgacaaaccaagaatcggtttacattcttaaaattggaaaccttcttaatgacgctgtgttcactgtagccttcaacattgtcctttggaaggttcatgtatctttcagtgtagatggagtcatacaaaagccaattagttactggagcaacagccataccatatttgaaaacctctccagaatcatattccaatgtcttaagcgtagtgaacccaccgtaagaccacccccatatcgcagttttgtcaggattcacaaatgagtgatctgaaatccacttggaaactactgcagtgatgtctcgtggttcccagtagcctattttctctgtagcgtaagatttaaaagcccagcttttacctccagtacctctcggatctatgtaaagcactattgcatccagtgacgaagaaataatatgctcaaacccaatgttgaactgcacatctaacttctgggagcccggtccaccataaatgttgaccaacagtgggtacttcttgctaggattaaaattggcaggcaacacttcaatcatgttcagtgtgacgccgtcctcaagtgttacattagtataggtagaaacaggaacgctgtgagttgctaaactaacctcgacaattcctctattagacgataaaatgtcatcaagacttgttgtactagggtcagaaagatcaataaatttctggtatgggagtttggggcctctgtaagatagtaaagcatattttcccttaatgtttacatcaaagtacccaggttctttgatatccataacagccttaaccttgggtcccgttaatgatgtataatacaagtgatgttccattgatgattctttggtgccgataaagtagactctatcttcaagcacttctaaaactccaggtccaacaacattccatgaaccatctgtaagcacaatatacttatcggatgtgcagtctggataataagccaagtgatcgtagtcctcataatagattacatcaatgtaaccaatggtatctccaacgacaggataaacagaaaattctccagtgaaccagccgttatactcagttgcatcatgttttctcaccaccgaagcagaattggcttcaatgtccactagagtaacttccatttttttcgaagtgcggtctgtgaacttcgacaagaaaaaagaattgtctatccattttaaactgtaaagcacgaagtcttctcccaaagaaactgctgctccaatatttagcttttctaacttttgcttggcaacgttgtaactaaacaaagaaaccagggggttgtcaaatcctggttttggatatttcaatcgatcaatgaccggatatttcgacacagagcctgtttcttcaaaaaaatgctgcaagttgaaggttgggacattgctgtcatcaagtctcaagaacgtaaagtacgatccatcgtcattccaccatatggctctgtcgctacttaaaacttcctcttcatagatccagtcaggcttaccattgtaaatactctcatcaccatcaaaagttacctgcttaacctctaaagttgagagttgtttgaggtatacattgttttcaaaaacgaatactacatgatcacctgagggcgaccattcaacgaagctcaatgccttgtcatcgtagacaggtacaaagctatcctcttggtcgctttccttatcatatatgaaatattttgcaaacgtagaatgtctccagtgtttttcatagtcgcatgcgactaagaatttggcagaatcgtaaggagaaatggtgacaaatgacactgtatacgtgattccatttacttcaattttctcatagttaaatacagttcgaccgtgttgagagtctgtaatcctcttttcatctatacgatgaaaactgtgttcatagtatatgtcatcttcaccacgagagatcagttttggatagacattgtacagacctgatctccagccgctaaggctcaatttagctcctttttgataatcagtgttagaatctttgctttcaggtaattcagtctgttttggttcaacgatagacgtggtggcagaagcagttccgtggctgtttgaatctggaacgtactcgttcaaattggaaaatcgattgtccctcgcatacaaggcaaagagaaacagccagataacaaagcaaataccaaatattagcatacagctctttcttgatactccagactttgaaaacttggccaagttatcagtataattgagattttcgttctcatcttcattatcacattcttgggaaagcgaatcattgcgatgtcttctagcatactcattaatgttttccaatatggacgaattggaagaacgtggacttagattctcttgaagctctatatcgaacgggttctcagctgtccgagatgtcattgtctctcgggaaatggatagattatcaggggtaaggacaagagctaaaggcacgtaaacgtaatttccaagttattacccgattagtgttttcaaaaactttaaattttcagtcttctcattttcatgccttagtcggacttccaactatcacttaccacaatagataatatgtcgtctgctctcttcgatgacattttcacggtccaaactgtggataatggtcgttacaacaaagtctcccgaatcataggtatttcaaccacaaactctgctatcaaattgactctggatataaataatgaaatgttccccgttagtcaagacgactcattaactgtcacattagctaactcattatccttggatggcgaagatgagtcagcaaatttcagcaagtcctggaggcccccaaagccaactgacaaatctttggctgacgactacgattacgttatgtttgggactgtttataagtttgaggaaggagatgaggataaaataaaagtgtacgtttcctttggcggacttttaatgtgccttgagggtggctacaagtcccttgcttctttgaagcaagataacttgtatatactgatccgtcgttagagagaaaactggtaacgtttggcaaaacagttagtgcttggtaacgtactagataatacaattagttgaccctccaccgacacggaactttgagtaatgctaaacagcaactgtaaaagtagattaaacctccttggaacctatcgaacatctttctgctcttcttcttgaagttctgtcctgcctcttcattcactatctaggagccctagaatcgcggtgagtaatttctaattctttacctagaaccccacaaggcccatgcaatccctacttttggatggttttcttaatcaaatatcccctaaagagctactgaaaatagagacagaggcctcatataatgacctgagcctgatatctgatgattcgttgaatactgcaactagcaatgtcaaattttctcaagggttcaagtttgacagtcaacctcacaagaattccatatcatgtttagacttggaaactatgaacagtcaattcttactttccgggagtactgatagctcgttgaaactatggaacattcggctgttgcaagaaaataaacaaaccgacgattatcaatggcaaagattctaccatttcaaaagacaacatttgcaaagcgttaccaacttggtgtcggtacccagaaagacaatccacgactttggcatctcacaccttcagtggtggccatttgatcctggaatgtttgttactggatcttatgataacagcgtgaaggtgtttgatacggagaactttgaacaagttttctcgtttgatttgaaaaataaggtctacaattttgatatcaatgctacaggccaacatgtattagttggggtagcatcagaatctcccatggttaagttactagatcttcgaactacatctgattctcatatattgatgggccataaatctactgttttgtctgtgaagtggtccccaactgattcgaatataatcgccaccggagatattctcggaaagattaacttgtgggatattcgacgaagcaaatcatgtgtctgtgagcttgaccaatataacactacaggaaacccaaatccgagtagcagtgccgtggaaacggttaaagctcaccaaggtgctgtaaatggtatccaatttaacgagcttggttctaagctagttagttgtggattagacgaaaaaatcagatcatgggatttaactcaaccaggaggcgttaatgagctcttgaattttggccctctcatcagaaacaaatctcaccaatataagaaattcatactttcacccagcacagaaacggatcttcaatttttgctatttcccaacgacaatggagaacttctagtttaccgcctagctaatgggaagttagtgaaacgactgactaaaggcaataaggttaacctcaaattaaactccattgtctacactggtttctcgtcagccacatacataactggagattcaaaagggaatctcgacgtttggggtccagaatcagagtatgaaattcatcaaaacgatggcgaggcagagagaagcgaagaccgaaatgtgttagatgacatcaacgatgagttaatcgctcgcaagaagatgaagaccaacccgttctaaaatttcatggaaagaggatgaatttcgattacctaatcactttactcgatttagtttcacgatccagaacaacaatcctttccataataatcatgtctaaactccaactagaggttcgaatcatccctccaagtgtacgcgagttagaggatcagatattaacacaatcatatttgatccctcgagagccggttcaaaatccaaactcctctttttcgttgtcactacaatctacttctgtatcccctcaaccattgtaccaatatccaatcaatttacacccaaatgtggtacggtttgtacacctcactttgttcagtaatactctgaataccatagcagaagaaatttctcaaagatttttaaagttacaccctgatcaagatcctttagagattgaaaggcttgaaaattcttttggaactgacttggatcccgattatgtcgctgaggacatctttaacagagataatttgatacgagtaattgttgataaagagatagtaacgagaaaacgttctcaaagtcctcagccttttcacaactctttgattctacccaggaaaagagcgaaaagttcgtcgttaaagaccccaaacccaaacctccagtcaccgtcaaggcaccctttggctgaagaaattaatgccaattctactactctatttgccaatgttgatcctacgaagccaaatagccctgctaccagttctactcccgttatattgaataacagtactcgcaaggtctctgaaagaattacgtcgggcatgctaacagctgatatgcccaatctttcaaacaatgatattccatctgctgacgaaagttcctaccagaaaggcagtgagccaaaacaggcaagtgtccccagtaaggaaaccgttcaaatgaacaagaaaactaacactatggagagctccgttacgacgtctccgaataaagtttccagctctaaagtggctgaaaagtcaccctctcccacaggcgaaaataccgtaaccttaaccaaggaggatgtttttagattttttaagagtggtattcgaaattctactgggaatgatactgatcttgaggacacatttagctcctataaaccagctcgcttcaaccctaacaaacaaaatggctctggattagcaatagatgaagctccatcctccagaaaccgtcagcactctgcgcttgaaccggagcagagttcgactctaactgaatcgtcggctcccaaagttgtcaccgctcttgcttcaagtacaaaccagcctcctagattgcttcgctctattaatgcaaattcaaaggtggcaaacgctttggcgaacaaggaacagtttgaagagagtcaagaaaaagatccttcttccttggcaaaagacgagttatctaagcaaaaagcagctgaagaagaaactagccgtagacgtcaggctgaagagagaagacgattgcaggaagaaaaaaggcagcttcagtatgaggagaaattaagaaaagacgaggcaaggagacttgcaagagaagaacgggatcgttccaggctagaaaagaaagcccagcaggaagaggaaaagctcaagagacaggaagagagaaagaaactccaagaggaaaaaaaaagcagctcgaggaagagaaacagcggaagttagaggaaaagagaaagttgtcggaaatgaaaagctcagaagaaattagtcagagtcataactcacagtcacctttcacctctcctgcgagacagagcactgtgcaaactgcaagttctcctgctagtaaaattatgaatgatccagcgagaaatactgggcacaattctttaaattctccagttacaaacaacatagttaaatcttctgcaaacccgttgaatgcagtagatacacttggaacgtcttcaacttcccccgttaagaaacccatttccccaaccaaagtcaacccttcatccacaaatagtttggccactgtatccacttcttcacttgacaaaaatgccaataggaatcaaccttcagcaagaacttctgacaataatgtgacaaacgcacccttgctgatttctcgtcgtaatgtaacagaattatcacctaatcaccctaaagtttcttcagaaaacttaagcagcaaaaaagtaatcgcagataaagatcaagaggaatcaagtagcgagagtgatagtacaagtgatagcagtgataatagtgaaagtgacagtgacagcaatagtgaaacagacactagcagcgattctgatactgagggcagcggctcagaggaagaaaaacatgaaaaaaaatcaggaactgtttctaaaagacccatagttgttaatacaccagccacaaaaacggtcgcaacttcaagtaagccaacattgcaggctagttcttctgcagattcttcacgaacacctgttaaaaatcaaaattcgtcatcatctgcatctcctaaaaaggcggatatttctgtgctccaggtggaaaagaaagagcctgccctgacaggtgtttcgtcgctaccaaaactgacgcagctgatggaacgaggagtacctgcagttaaggacactaccaacaatctttcgtcgtctaacaagaaactaaccccccaccgcagggtcaaatcggatgcgatagtagatgactcagatttaagttcaagctcaagttcagattcaacatcgagttcagactctgactcaagctccagctcaggctcagattcctcgtcgggcaacaactcaagtagtgacgactcttctgattctgcaagcgagtcagatggcaataaagccctcagctctcaatttttgaattctaaaaaggccaaggaactcattggaaagaaaaagaagagctcagcactttcctccttgttaaaagacactaaaaaataacctattgctgtggcgaagatgtaaaagaatttatactattaaatagagattaaacacgttgttgatcttcgatgaaattcatcgcttcatttctgtttatttcggacacttcagagactttattgttaaacataacaccataaaatttgtctgctacttgaatcatctctggtcggaatgtagtacagatgaattgagcattctcccttgatagtcgattgatcagtctagccacggaagttctatactgagtgtccagattggcatcaacctcgtcaaaaaggtaaaacggtgctggatcacatttttgaatggcgaagatgagcgcaattgcacatagagatttttgaccaccagaaagctgttcgattctttgctgttcatcacctttagagttgaaggatacagaaatagacactccggaataagtctctatgtcaggttcattgtcgccatcattttcaaaatgacctggattgttcatcttattgctctgcgggtgttccttttcctgaattgattctctcttttctaagactagtctagccataccatttggcactagcagttcgaaaacttgagcaaacgcttcagaaagcttcttgaatgtattcagaatggcttcatcttttctctgctccgatacttgaatgagatcttcgatggaatcttttgcagagtcaagttcctctcttctttggactagctcatctcgctttttagcaaagctattgtattgatcccaggccttcttgttgatatgactgaactgtttcaaaccttgattgactttgtttaataggcctatcaactcagaggagttgtactccttgtactcagtgaatgcctcttctggcaaggctccgaggtctcgtatactcttgttgatttggtcacgtcggttaacaaggagcagtttcctacttaatttcttttctgaagattccatgaatgatttcagcttattaaccaataatctttgcccattatttatattttctagctcttgttctttgttcagaatatcgtagtcatatgattccaatttggaaaataggtccttttgcttttgttcaagaagatgcaaagacttttttgcctgttttatatcttgtactgcatcattcaaatgtgaatctttctgtatggcagagctttgattcactgctttctctaaggattcaaaggttggtaaaagtttcatttccaactccgatttcagtttgttgaattgcacttcgagatcgctcagtttagtaactatctttgtcaaagatgactcgtgtagaggaatttcagaactcaataggtctaattttctgatttcatcctccgtcaagacctgaacaaaagtagattgcaattcgtgttcaaacctgtccaattccttggtagtggattcgactgactgttcactagtagtaatcttttgttgaattttctctaaattcttttgaacggatagcttttcagtcctcaaatcatccagttcctttctcaggtcatcgtgactgtgagcttttgcttcatattctttatgcagttgagaaactttcaaattgaggtcgtttattattgtttctttggtcgtgagtttctcatccagttcgtcaatctttgactctgtctcctccaattcaattttggcttgtctgagatctttcaaggtcccaattctactggatctaaagtccctagaacctccggtaaagactcctttcttgttacacttgtcaccatcaagagttatggcatcaatactatactgagaagccagctctacacctttttccaagttcagcaccacaacggttcttccaaatacttgtttcactgctggcaacaatgcatcctcaaaatcaatcttcttaatcaaaggaatacactcgttagaattaggataggctatctctttcgaagttaatctgttcaaaggcatgaaagtgactctacctgctttctctcttattaattcctccatgataatgctggctgtcttttcattgtcaacgacaacatgaaacaaagagttcccaccgacaacttctgctgccacacggtatttatgacttacctcaatcagctccccaagtgttccatagactcccttcagccccaaacgatttgcaattctctttacagaagccaacccaactgctaaagacctatccattgtttgagcgaccttctgctgtgaaacggtaacattatcttcaatagtggactgtaagttacgaagtttcgtttgttccctccaaagtgactttctttcatccatcaaaacccttgattccgatttgatcgaagagagagcataattggcttcattcaagcttttctcagaacttttgatagacgtattttctagataagatagtttatcagtaatggtggccagctctttctctttcgtagataattcctctttcagattcgaaagaagttctgaattccgctcgatatctttattgcattttgcaatctgatcattcaaccaggaatctctttcttctttggttttaaagtgtgaaaagttgctttgcttgctcagaataaatgtttgtactttcttcagttcgttcagctttattttcgttttttgctcctcgattccaattcgcagaagctctggttgaatttgatccttgcgttctgatttatcttttatgatcttgcgcaatttgactagttgttgcttgttcgaagtaacttgaccagttgagtcttttattgaaactttggattcattagcatcgagttccagttgggagatactcttaatagtttccttaatatcagactcgataccctgtttctcaagtatagccatttttttggtattttttaaatttgtgagtgtttcattcaattccttaactgatgcttcgttcttatctaattcttgtgaatacttctgaaatttctccgaaacagttgtagagagcatatctatagtgtctatttgctcatccacattagtaagttctttgtcaaacaaattatactctaaagttttctttcgattggcaagtttctcatacttcttcagctcatttttttctgcattcagatcctctaaccttttctcaataaatactagagtctcgtcaatcttttcacgtttcacctgcgaagcattcatctcctttatggaatctttcaatttttgttcaaatactctagcccctgcaacttctttcagcagtttgagacgttccgaatctttggcatttgtgagacttgtgattcttccctgcggaacaatgtagtaggggttactcttagagaaacccgcattctccaacagattcatcacatcagaacgagttgcgcttttaaagttcaatgaataatcatccttcttcaaacctaccgttctccggatcacaacttcattctgatcaacctggatccgacggtcagtattatcaaatacgatctccacatacgcactcataaccgtgcctgacccttcgtggataagactctgcctctgggaacgagtcatatgagtgtaatcgtcagagagaacaaacctgatagcggcaaagaagttggatttacctgacccatttcttcccacaacgacgttatattcaggggatatatcctcaataatggtagtgttcttgtaagttttgaaaccctgtattactatctaaaactgttagagaattggatcccgttaacaatggaatgatactgttttcttacccttttaatgtgcatcctttgtgagtggtagggaatacgcgtctttattatatttattcccctagaatatctacgcgcaggcgcgaaaaatctcaaattaatatacattgttacataagggtaatgcaaagtcactccggcttataaaatttgggggctacaaaaggaagtttggcaacatgagcttctctttttttgttcctgatctcaatcaatattttggtcccagacttttgatggggcttgtggataaaagcttgcccaacattcccacctagagtaggacttggggatccagaacatacaactcctatctgcttatctggttcctcgtatgagtatattttgttgccctctcttggtgatggacctttagattggataccaacacgcttgaacgagacagatttggggttttgaatctgagatagaatcctgtctgaaccgttgaaccccgcagtttctggtgtccttcttgatttggcgatcaaccaattcaaagatgactctactggcgtggtttgctcgttaagttcatgtccataaagacacattcctgcctctagtctcaacgagtctcttgctgccaacccaataggtttaatttgctccaactccagtaacgccttcgtgaactctagaccctcatggtcaacaggaatcgatagctcaaaaccatcttccccagtatatcccgatctagcaatatgtatcgcatcatttgtaaagccttccaacttggcaaatgctgaattaccaaagtagagcttagtgaggtccaacttggtaaatttttgcaacgtttcagcggcttgagggccttgaatggctagcagagtaccttcaaaattctcatgactagcgttcccaaactgactgatttcctccttgataaaagcagtatctttgtctctacaccctgcgttggtgacaatgtaaaactcgttttcatcgtgcttagttatgatacagtcatctatgacacctccctgatcattcagcaacacagataaggtactggtaaaaggttcaagtgctttgaggtcactgggcgtgatcttttgaagaaactctgcagcagagttacccttgacacgatgttgcaacatatgcgatacatcaaagatccctactttggatctagtccaattgtgagactcaatgtgagactgtcctttatacaatacaggcattgcaaaaccggcgtaagggaccagcgttgcgccatgttcaacatggagactgtagaggggagttttgataagagcttctactcccgtgctgtatcttctacaagatctcatcatcatttgtggaaaaatttcaattgcaactggacaggttgggcttcagcttcattttatacacttaactgacttagataacagagtcaacactttttgacagccctgacttcgtccgtttctgactctgttgccatcgcgggggtgggggagaaaggaacttaatgcttctccttacgtaagtgtcatgagatctaatacgttatttatgctctaaatattcatgtaagctttaatagcctcttcagtgtcagctactagcttacggtagcgcatttgtgactccgcttgatcaaggaagactttgtacttggtgttcaatagcttacggtcaggttcattaggagatgaaggcataatgacctttcctactccactcagagactccatgactttccacagacgatctccagaacgttcctcgcctaacttcgatggcttagagcttactagtggcttttgacttgtgcgctgttgaacgaagttagtctgaacattggcttggtttttgttcttggtgccaaaagataaagtttcttcgtctgacgaggtgttatcctcaaccccatcttcgaaacccaattgcttcgactcatcctcgattggtgtcataagaggaaatgggaagccaccaggtgcaccgctcaagtttggagcattcatagctgaaattgaggtcatcgacgctgttgcggtaggtgcagtataaggagagggtggcatttcatgaggaggctctgaaacattggaactgcttctaactgttctccctgtcctgcctttgttctgtgccaaaatggcgtcatcagctgcaaccgcacctaacagtgctgatccaaaaactaccgatgcctcaatatatcttgggatgatgattggaagaccagtacaatctgctaacagtctcatcaagagaccgttacgacactgtccccctgaaaggaaaatacaagaaatattgtgtcctgacttttccatcttctccacaatttgacgggtctgttgtgcaatgaattcacaagcaccaagatactctatagccaaagagtctaaagaagtatccatggactggccaatgatggaggctttcatatcaggatcagccaatggtgatctgttaccatgatagtcaccgtaaaaaaataaatcctttcctagggcaagaactgagcgttctttcctagatcttttcaaattctcgagtctgttgttcaaaaaatcaaatcgagacagcccagaggattccgaagcttttcctaactcagtgtaggcaggatgggtcgtgagaacatgggccaaaagagcgcctgtgcatgactggccaccttctgcaagccagtaatctttagccatcacatccctataaggaccccaaacaccatgcacaaaaattggatccttagacatgacacagtgacaagtggatgtacctgcaacagcagcaagacggccacaggctttgtcaataccagaaaaattattgtcttgttcaaccaaatctggaagcgggatttcagtttttgcagcgattgttccaacccacccagcgtaacaatcaataacacccgaagcaacccaacaagcagttgtcaagcccaattgctctgcagcatcagcactgagaggtccaacggagtcaccagcacttaggtactttccattttttccagggatacctccaagtttttggaaatcgtttgctgctaactctggaagctctacctgtgcgaggaattccttggaccagccgtctactgaaccatctacaccttgagggacaaaaccttgcttgcaagtaactgagcaataagacctagtttccgtgtttgtagccttgtgtgttaaaaagtctgccaaatcgtaaaacttgcaacgttcaaaaagtgactttccagtttcatcacgaggaagatgatgtttgagccatttcatcttggggagctccatctctatcgacatttgaccaccaacatatttcaaacatttgtcaccagtacggttgatggctttggtttcttcatgtgccctgtggtccatccacatgataatgttctgttctgattccgtgaaatcaggaccaacagcaattggttcgtcagtttcttcatccaatacaaccaaagaacaagtcgcgtcaaacccaattcccatgacaagagcaggatcaatgtgggactgcgtcagggcagtctttacacagtaagatacggcttcccaaatctctgtggaagattgattgacataatctgctttaggggtatacttggagataggcttttctgctagccccaatattgcaccggcctgatcgactactgcagccctggcagatccagatccaacgtcaacaccaacgtaatagaccggagtggcgaagttctggtgtaactcggagatgttgagatgaaaatttggattagtgaaggaccgggaccgggacgactttaaattatttttcgacattgtatctaaaataaaatgctctctagggttagtggagaagaaagagactagaatgggaaatggttgcgataagaaggcgatgctaaaggacgtggaaggggcaaaaaaaacaaattcccttgtgttactattgggtaagctagtttctctttttgcgcggaggaaatgggagggggagaagacgcagaagcatgaaatttattgttttgtagtcaatcactcttcccttggctcaccatccagaatcgactggcaaaagtcgaattgctcattctctgccacagccttacgcaaatgtgcaggttgtatacggcgtgatccgctctcacgagccacctccaatgacttgtctaccagtgaacataaaaacagttccaatgctcttcccaccaccactggggtggcctgggcaacttttccgatatcatcatcactctgcatcaatttttttatcctagcagaggggaaatgtgtttttattctgttaaaagtctcttctaattcctgggagtcttcttcactcattcttagtgcttagtatatgagaaacgtttttttttttcttttctagcagaagaatagaggcaaaacgcgcgcagagtttacttctatctctttatatacacgggcgccgatagtagagggatgaggactggggctttcgagtagtcgatcgatctgactggaaaagcttgagttactgattagcctaatcgcaatgcacatcagccattcaggtaaagctgttctactctgctaaacaagaagggagaacagaagacatctcatcttttggaatttccactgatccttcccaccataaaatccttgattggtcccagtgaattcaaaacatcaacaccaaatgaacgggctgcaaccaatggtgcaaagtctgttgagtaaatcttgtgtatcttgtccatgacccccagtagaacgtggttctggggccatctctcgctgaagtaaggctccagcgctaacgaattaccaatgtccaagcctcgagatgtagctcgctccaatgctccaactaaggacttaacgtcttcttgccccatgttaagaccttgtcctgcaagagggtgtgttgtatgtgctgcatccccaactaaagcaacacggtcttcaacataggtgtccgcatgggaaagcttcagcgggaacctggctctagaccccgtcactatttcggacacttgaagggggaagttctcctcatctgctggttttagtttaccggcaaagaggttcaacctccattgaatttgctctagcagatctggtgatttggatttggctaaatcgtaaatcattgagagttcctcggttgagagtcgagttcctgcgttaaccatggacaggaactcagtttcgtctaaagatagcaacatttcggctaattctggagtagttgaccacaccattgaggtatagccattaggaagagggagaagagctaatgggccagtaggcaaaaacctctgccatcccgtagggaatctgaactctgtatcagcgaacttgaaagtagcaaccactccccaacgattataagaccaaccacggctttcaatgccggcaaaatgacgaactggggagttatatccatcacatcccacaagaagacgacatgtaagagagtctccatttgagagtttcagagtaggccattgggtgatgctatctttggctattgaggtgactttggtgtcctcttgaatgaccagcttgacttcctgttgactgttaagctcattcaatctactcaacagacctgcttgaatgttggtggtttccaccattgttgctatatccggatgttcaaagttcatacgagctccacttaccccgtcgtaggttacaatatcatcatacgactgagttctttcctggttgaaatggctccaagcgcctatagagtccaagaatccaattgtagatggtgttaaactcacgaccctgttcaggtagtttgggggtggcgtctcaagaaaactgttcaacggttctattatctttcctccttctaccagatgaatcttcaaatgcttagtgactggtgaattcttcaatgcagtacccaaagtaagtccagctggaccacctccaataataacgatatctgccacattgcttacacttgtggcaaaccgtctaattacctggaacatctggatatggatcgaggtaagggactaacagtgagctgatgaagaaatttggcgacagaaataccaggtccctgttcgcgaaggactatatctaatcctcaattgagatgaaccccaactgaaaaaacttaagcctttgattagaaaaataaacttctctatcgggatttttctcacttcccgtccaacttccaagctgtttgcattcaaatctctctccctgttaaaaaaggcttttaatattagtccgcggtcgttatcaggaaggatgataagcggaacttccaaatcgccagatttggtcaagatatcaagactgcatttcaatgcacagttaaccaatggaaacttctggcaccagacaagcctccagccatttacctgttcagttattctgaaaacagactttttcaaggctagtgagacagacgatttaaggtattctcttaactatgcaacgatatcgaacaacatcttgtccgtgtttcgaaatagtgatgaagtctacggatcaattgagtcaatagctcacagaatcgcagagagtgtgttcagtgatgaatccaatggacggtcagctgaaataagtgtttcgtctgaaaagtctgaaatccgttgcgattcgattgatttgagcatttccaggtatcgaaagaacgattcaacgaatgagttgattgccccatcgctggacaaattcactttcaagggactaaatctgtttacaataattggtgtctacacttttgaaagatacaataagcaatcagttgtcttgaatttgtctgtacattataacacgaataaagataagttgaaattttcacagctcacggaaaccgtttcttcttacgttgaaagcacacagttcaagacagtagaggctctagcaggaaatgtcgcttcgttagtattgcaagagtttgagttcatcgaggctgcagacgtggaagttgtcaaacttaatgcaatcatttttgcggatggtgtgggggtggcaacctctaagcttcgcaatcaacttcaacgctccaaaattgtggtgaatccaacaaagtctgagttcagtacgttgccaaatctgaataaagagacttcttttgaaggccatccaaacatcgagaaccaccgtgtttttatcgcttttggaactaatgagggagattatctggaaaatattgagaaaacaattattgagctagacaagcggggttgtaaagtagagaagacctcctccttatatgaatcagcgcccatgtaccacttagatcaggcaaggtttcagaatggtgttttccaaatttccactaaattatcacctcgagatcttttgaaaactctgaaagagatagagtatggtgagttgaagcgcgtaaagcattttgataatgggccaagaacaatcgatttggatattttgttgtacgatgatttaatccatgacgaacctgacctgaagattccacatgtctcactgattgaacgaaattttgttctttatccgttgtgtgacctgcttcctccaaccgccatccacccagttaccgctgaacctttccaccagcatttgaaaaagctcagtgcccatgacacttcgatacaagcagacgatgggctggtaaatatcatccctatacccagtattcctaatagaaaagctgacatcagaattgacacgataggcaacaaacttacaaagtccctagtgatggcagttctgaatgtaactccggattcgttcagtgatgggggtcttcacaataccaatgaatcaattatatctgtttatgaggaaatggtgcattctggcgttgatatcatcgatattggaggtgtttccactagacctggcgcagcagctccatccgaagaagaggaattatctcgagtgatcccagctattcaattgattcggaatcatgagaaagaaaacaatttacagccacaggtaatcagtgtggatacatttcggagtcaagttgcacttaaaagtttggagagtggtgcaaacatagtgaatgacataagcggaggtagatttgacgaacaaatctttgacgtggtagcaaaatttggtgctccatatatggttgggcacacaagaggagagaatatgaccgatatgcacactcataccaaatacaagcatactcagaagatcggagaagttgaattttggcaaagcagtcctttaattgatacgattggcagagaaatcgcagaatccatacaattggccacaaggaagggagtgaaaaggtggcagttgattgtagaccctgggcttggatttgcaaagactgtggaacagaatatttctctgattcgaaatttacccaatcttgccaaatacggcgttgaagcagatggagactatcaatctctccacagagtaccctttttactaggacctagccgaaaacgattcataggcgttatcactggagaagagcttccaagatcggtaggaacctgcgccgcagtaatgagttgcataggatttggaggacacttgattagagttcacgatttcaaggctgtcaaagttacgtgcgggatggctgatgctatttacaaagggctcattcaaagctaaaatgtaaagaggagattctttctcagcaaaggaaaaacaaccaagtatttaactactacgtacacaaactcacaaagataaacataccacgacttagttggcctcagcagttggagggcagtcacgggaaatgtgaccctgttcaccacagttgtaacaggcttttgtagaacctccggagacggtacagtccttggagatatgacctagctttccacaagcgtaacattttggagagccagcttgacagtcacgagcaaagtggttaggtccagaacacttgtagcaaatggtggaagaagaggccacagggcctgcagaggaagcggaagaggaatttgggcagtgacgagagaaatgacccaacttaccacatgagtaacacttggcagccttctttggctgttcacactcggattgaacatgaccggtttcgttacagttgtaacattgttttgatgaagtttgctttggctctggacagtcatttgattcgtgtcctggggctctacagttgtagcaaagcttttgctcttgttggcagttttctgcaaggtgcccgacctcaccacatttgaaacacgttcttgggaaaaatacagcagccatcttgtaaggggaaaaaaattattggatgtcttgtgaacagaggagaaagggtgatcaatgcgatcattatctttttgtatgtggagggaagaaattttcaccgggcgttaccctacgaacggggtgagatcttgaaagaaaaatctgatgacataagctgttgcatttgttctgtgcgcttatcagggcgtcaattaagttgtcagaaggttggtagcagctcctgtttcgagaaggctatcagtgtctgactcaggctcaggaggtgaatttccggaggaagtctccttagtgttggagctggctgtccaatcagtgttctcatcccaagacgcgtggcccacaggctcggtgtccatgatgtatttgccatagtctgaggtccattccataaggtcataagcatcagataggtcagaaagcttcatttcttctttaatgtacctgctaataacttctggtgttaaagcgcaagtgacgaacatgtcgacagaccaaaactggataacagggtttgactttcccagttcagataaaagtgttcggtacttggatcgaataaagtcagagatgatgcccgcccgtttcatcccaagatatcccacttcaaatttggtcatatcaatgttttccaggacatttttggttagaactctgtttttggatgacttggatacttcatatgctaatgaataaaagtatgatggcttggatccgtttagaattgcaggaactatagccagatgtggctcgatggcatttcgcagtgcttcatatgaaacaataagaggggagaactttttggacgaatacttctgcataactgattccttcgtttgtgcttttttgttcgctgtgtagttacctgtatcgttgagcaacttgaggacgattggggttggttctctatcactttccacaacgggctctctagacttttctatcccttgatacatatttagttctttcttgggactcttgtttgagaggtctaagttggtgtattttttatttgaagagtccaagtttgaaaggatacgatcttctgctacttcttcgtcagaagaagcatcgggatcagctagagttggattgacggtaacattggaagacctgctagcagcgacttgccgtatgtatggttttcgaaccttcgatttcttttctcctgctggagagatagctgattttcgtctattccataacctactgtaaactgggcgaccaaattggtccatttggctggacttttatacttaacggtttcaggcatgaaatggatagtaagggttattatagaaccttacaccagattgttgtattacgtaatataactctttagaatgctggttcggcccaagtttcatcaccggatgtaagaggatgcagatgtgcaggtgaaattgccgaagtttgatggatcctcggtttctcatacgatttcacttatataggactgccgaaaaaggacatgtgttgtagtgaaacactttttcattattggctttgatcacaaagggccactcaccagttatcatcgaaaggtaatgtgttttagttccgaggatgtttgaaatttcggcgactcactttagcctttccaggttttcggaactggaacctgctcctcggctccaaatttatccaccaagtcaaatgaacacatttctgcttgcttcctgcatccatatgctattgtctgcaggctgaacaataacaaggcttaataaccaaataaggtggagcagcagttgcattcgaaatatggaatacttcttaatacctgaagttcccttctttcccttccttcttctcccgtccacagatagatttcatttcgttcaatgtcagaagtcgaaaagtttgaaggcagtgaagaagccattcaaaggctggctcgtaccttgaccaaccaatcttcattgtcttttacttctcatcaaagctcagagaaaagtggtgcttcggatgttatgctatcccgagcttccactagagtctcccaactcaccgttcctggagagtctccctttgacttaggtgatcctagactagatccacagtccgaccagttttctgccaagtattggataaagaatctgcaaaagttgcacctaggtgatactgactattataaaccggcctctcttggaattttgtatcggaaccttcgctgtgaaggtgaaaatgttgaagctgattatcagacgactgtgttcaacgttattcccaagtatttgacaaagtggactagaaaagtagcaagcagcaccaaaaagattgatattctaagtggaattgatggtatgatatgtcacggtgatctggtggttgtcctgggtaggccaggtgctggatgcacaaccctattaaagacaattgcgtcacaaacatacggtttcaaagtaagtgatgactctctcataacttatgacggtcttactccccatgatatcaggggtacaaatagaggagatgtcatttataatgcggagacagagatgcattttcctcatttgacagtctggcagaccttactgctggcttcaaggttgaaggtaccacagaatcgtattcctggaatttctagagagctttatgctgagcacatcactcaagtttacatggagatgtttggggtttcccacaccaagaataccaaagttggagattcatttgtcagaggtgtttcgggtggtgagaggaaaagagtttcgatagttgaagcttgtctatgcaatgcgaaattgcaatgctgggacaatgccactagaggtctggattctgctactgccttgaattttgttaagtctttgagattatcttgtgatacccttcaaactacttctttggtttcaatttatcagtcttctcaagaggcttatgatctgtttgacaaggtgattctgctgtacgagggaagacagattttctttggtcccacaaatcgggctaaaaagttcttccaagatatgggattccattgtcctaaacgtcagacaactgcagactttttaacttctttaaccagccccagcgagagaattcctaggcaaggttgggaaggcaaagttcctcaaacaccagacgaatttgaacagcgatggaaatcaagtcctgaatatgaggctttgatgatggaaattgataactctttgggagacattgaaagaaacaaacagcagtacctagaagacctgcatagttcgcatgttgcccaacaatcaaatcatgtgagaccttcctctgcctacaccgtttcatattcgatgcaggtcaaatacgcaaccattcggtcatttcaacgaattctcggtaatatatcccagcagctaacaaatctgggaggacatgtcatcattgccttcgttatttcatcaatgttctacaatttggccgctacaaccgataacttctacttccggggttcatgtattttttttggtacactattcaattcgttttcttccgttttggaaatttttgctctttacgaatcccgtcccattgtcgaaaagcacaaacagtacggtttataccacccttcagcagatgctattgcttccataatttctgaagtgccgataaaagtgctcaattgtgtcatttttaatgtgatcttatattttatggtacatttaagacgagagccaggcccattcttctttttccttttaaacgggttcacgtcgacttttgtgatgtctcatatttatagaactattggagcaatgacaaaatcactgtcacaagcaatgacaccagcatccgtgatattgcttgctttgtcgatgtatgctggtttcattgttcctaaggcaaatatgttaggctggtctaagtggattaattatatcaatcctgttggttacgcttttgaggcgataatgattaacgaattccatggcagaaactttacctgtgattccttcattccaagtggaggcgcttatgacttgttacccatagaaagtcgttcttgctcaacagttggctcagttacaggggaggcaactgttagtggaactagatacttgagggaggcatttgattttcttcactcacataagtggagaaactatggaattcaggttggttatgttgtgttttttttcttcacgtatattttactggtggaaatcaatccttctgcaaagcagaaaggtgaaagaacaatttttcaaagatctttcatgaaacgtccaaggtttgttcacgaaaatgcaaaggatattgaaaataatgccagttcagagaaggtttctactttaggcgaggaaaaggatgcgaatgaagttgcaatacaaactggagagagaatttttcattggcaaaacgtaacttataccattccgtacgaaggaaaacggagaactcttttgagtaatgttgatggatgggttaagcctggatctttaaccgcacttatgggcgtttccggtgcaggtaagacaacactgctggatgtattggctgaccgaataagttatggtgttatcactggtgatttcttcgtgaacggacaggtgagggatgcatcatttcaaaggtccactggatatgttcaacaacaggacttacatttggatacttcaactgttagagaagctctattgttctctgcatgtctccgacaatctgagtcaattccttataaggaaaaagcagattatgttgaagagatcatagatcttttagaaatgagattatacgctgacgctgtagttggtgttccgggtgaaggacttaacgtcgaacaaaggaagagactaacaattggagttgaactagttgcaaagcccgatcttttactattcctggacgagcccacctctggtttggattctcaaacagcttggtcaatttgtcaattgatgaaaaaactgtcaaataagggacaagccattctgtgtactattcaccagccatcgtcgttactgtttcaagaatttgatcgtctgcttttacttcaaactggtggtgaaaccgtttactttggggacgtggggccaagatctcagacactaatccagtattttgagaaacatggcgcatccaaatgcccaaaggaagcaaaccctgcagagtggatgttgaaagtaattagcgatccttcaaagaattatcatgatatttgggtcaattctgaagaatatagttcggtgaacgctgaactcgataacatgagagaatccctagcaaagcttccatatgataaagactcaaaagagtcccaaaaatcatatgccacgagtccagtcaaacaattctactatgtgatccacaggattctccagcagtactatagaacaccctcatacatctggagtaaattgattctatcttcggtttcatgcctgttcaatggattcacttttttcgaccccaaaaattcgatacagggacttcaaaatcaaatgttctccgttttcatgatgtgtgtcatgctaccggtcttacttgagcaatacatcccccattttgtcaagcaaagaaacttgtatgaagccagagaacgcccttcaaaaactttttcatggccgattttcattttatctcaggtagttgccgagatcccttggatgcttgttgcaggaacgatttcgttcttttgctggtactaccccgctggcctctataaaaatgccggccatctagaccaaacgacggaaaggggagcgttagtttggctgcttgtcgttgcctattttgtctacactgctactatggccacaatgtgtattgcaggtatctcggtggaaacaacagcagcaaacgttgcggtagttctattctgtatgagtctaatgtttgctggtgttttgaaacagaaggatgcacttcctggattttggaagttcatgtactacgtttccccattcacatggttcattcaaagtattctgaccgcgggtttagccaatgctcctgtagtgtgctcagccacagaaatgttacagttcccagcttatggcaaccagacttgtggagagttcatggctccttatatggcggtcgctggcgggtatctcgccaactcttccactcaagattgcgcattttgccaaatgaacaatacgaacgttttcttggctaccctggatgctcactactcgcaaagatggaggaattggggtattttcgtttgctacgcggctatcaacactgcaattaccgtgtttatttactggcttgtgagagtgccaaaggagaatgatataatacgaatcattcataacagagtcattcaccgaattcgttcattgcgaacaaaacccaaaaaatcttcagagcagtagataagtaattattagttgaaagcttttcaaaaagttacagtataccgtatcttgtccgtagaatgcatttggtatattcggctataagctaatccctcattattcacttttgagacagctttttcaacggagatgtaccagtctctcgcgcatactgatgcaaacatcccatcaatttctttatagttaatttccctccctgccgtagtcaacctgtctgacaccacgtatgtcaaaaccaagatacctctctgacagtgaaagggctcgtgtgctggagttccaggatatgattcattactcggcaaggtactcagatgaccaatatgaatatagacacgtaattctccccaaacagatgctcaaggtgattcctcaagattatttcaactcggagactggtactttgagaatcttactggaagaagagtggcgtggattgggtattacccagagtctaggctggtatcattacgagacacatgctcccgagcctcacattttattgttcaagagagatttgcagtagatcttgggtgatgagagaagaaaatatgtgtgagtttgttgcttggagcagtctatcatgaaaagcattttaggtctaatcgtgggtcctttggttcacattgctattggcaattgtgagttatcatagttgaattttaatgaatcaatcacgtttcttagttacgttgtagtttttttttttttcatctttagtgggaagaaacgttccacgcctatttgatcatagcttctaattgacgacagtataatatgggccacgaactcagcattgtccttattatccaaaggcctatcttctagaggtactgggaatcaaagtggggctggccgtttccctagtctttgatcctccgtcaaacgcgacttcttttcgtcttcgaaatcttgtgaactccagttatctaaaacttgtcatggtatgacacctgaagagcatgcgagattagagaccttgaaccaaatcacggattctgtttttaagcaatcaatctccaatgaagaaaagtttcggtctttgaagttaattgtctttcaagctctccctgcataccagttcaaagacattaccgattcgtacctcaatagtatacttgttaaagttttaaaatgcttagacttactagctattgaactgtatttggaactaatcgagaacaaactttatgaaaagattatcgacgtgatcttgccctttctggatcttcagtatgttcgggttgaggtgggcattcaagtcaaggggataatagtgacaataatcaatctatttcatgaaaaaatacgaagccctttccattgtactatgattaaggaattcctttacagaaatgtatttgagttcaatttgagctctttgtttgctctttttacaagtaaccaaggtctgatcactgttgaccatcccattcatgaaattgttcaggataacaataagaagctcagcatactgagttcatgtgtcacattgattcagatttttttagaaccgaagtacagtgaagtattaggcttagaagacaaagcatgggagctggaaagttcaattcgaaaggtctttttctgcctggattcatttttaaacagctttaagcaacaaactgaaaaactaatagatatgcccgtaaacaagttcattcatgtactggactattatacatctattttatttacgtccttgttgaaatacttcatcgaggatttgacatttccttcttccaagaggttcttgctgttatccaaagcaagggaatatctgcatggaaatcatttacagcagtttccaaaacttcaagctagtttggccaactgtttattgaaactgctatatcacttggtcggccaagatgatgttttcgtgatgaaaaaatcattgaacatctcaccagagtggctcctcaaggctgaattgtcgttggatcctcttctagtccatgtcttaaatgtgtgttcacttgtttttgagtacaagtcttcggactctttttcttttactaaagatcatgttcgaatcctatcacaaccgactactgtttccattcaccagctcaagcttcaaattttaacctctctgatggaaaggaataccagcatagatgtcaacagagaactactcctttgtagagacaatgaaattgtctcagtaatgccaccttctaatgatatatctatgttgttagattccgaagttttatcaaccgacgagcaaatgtcagcttggctaagattagttgtttcaaattgtaacctcgcaacgctttcaggtctggagatgatttatttgattcagagtctgggaaaagctgcatgtatctcggctcatgatttcaattttccacttggacggtgcaataaatgtgacactgttcggcgggattcttcccatccaataaaatatgtttcatactccagaccttcctccaattccaatcacaatatttccactatactgagccttctccatcagctactggagcttgactctgttcgaaagagtgacgttcacacattgaatctgctcttatctcttaggagagtctttacctcctatcagccgccgccattgacaaacagctgcgttgtatggaagtttatttcgtcggcaacgacgcacaacgtcagagagattagactgttggctgtcactttactttcattctatttcataactcctcaaaacacacaatacaacaacacttttctcaaaatttcaacctttctgggccagattactctttcagattcaaattcgtatttgactgaatccacggtactggcttgggcacaactggcacttgtgtcaggggttaatgagcacctatatgtgactctgatgaaattgataaactatgtcggatcacaatcccagattcaatcaacattggctatccactcactaaagacaattgcatacattcaagaaaaaactccgtaccaactattgtatccctttttgccaaagtttagtgttattgtggtgaaacagctcaagtctagaccaatgttggtagacagtttcaccaaacttgtttcacttagtttacaggcgttcctcaagagaacccaagaatacacagtgccttatgttttgcaatcctacaaacatgacattattggaataatggctcatgaattgcaaacttcaaagccggaattaatagagactcatctgccacagatactaggctatttgctaacgatcaacgatccgaccttagaaagcgacagagtcaaaattactgcaattttggggaacataaacggtcactaccgaaaaaaaccattgaaagacttgctcaagattaactttgactatgagtttgcatgggcagttcttcaaaattactccccagaatcacagaacgaaaaaagtgtccgtagagctttgattttcattgcaagaaccactttggcaaataagtcagagacgtttaattttacggaagagaaaattttggaactattttttgacaagactatactggctataatgcagttgttttctttcaccatcaacaatctaaaaggtatacagccggagcaaagtagattgcaagctctctattctattaactatttgatagagctaagcggtagtgctttagtgtcttgtcttcctcaaatcaggacgtctttacaggtgtccattagcagcaagcacctacagcttgagtcgctggagtgtctgaaaaaattgatagttttactaaaggataaggatctctatttgattttggattttgttgtctcactcattgttttgaaatacgatgagttagacgatcaaagcaagaatgtttgtcaaagtatcatgggcatcttatactctcaaaaatttgattctctcaaaaaggaacttactaactatgttttttccctgtcttcaaatcagcaatttgtatctaccgttttgaaaactagaattgaccatcgtgccccttcactacaacttctgtcagagttagcaaagaggtgcaacaatgataataaatgggtcgttatgcttgctttggatagcattgaaagctttttaacagtttatgataagtccttccatagtgaagttgtttatcggaaaaagttttctgagttggctcctctacttattaaaacacttttgaatacgtctttcaagtttcgtttcgaagataaaggcattgctagtaagtgcgcaaaagtgattgccaagatcggtctgttggatatcccacgtagcaatcacatttccaaaaaggattcttcacgtgtaattctaaggtttaacttctcagacaccagagaaagcattcgctttgttcgaacatttattgacattattttggtcaaggcattttctgcttctggaaacccatcaagacaattgtatcttgcatacagtatacaagagtatctcaagtttatgggcttagaggaggtggacataagttctttggaggagaaggtgggaaaaacgagtgaaccagatgttaaattacagctttggaatggattttcggatatttcaaaggcaataatagcaccattgcttcattcaaaatataccctacagtttcattcttatcatcccaaggagtatccgattttttctcttcaaaagacacattctcaatggctaactggtatcgttgatgatctcctcaatagaagtcaaggtaagtctggaatataccctcatgctcaacacatattctttatctgtacttcagcagtgcgtggcggagatctttctgtttgtgagtttattctgccgtacatatggtacagcatcatagcttcaggagatgaagaattggtcgaacttttgttcttagaatcttttgctatattagacacaaacattgatgatctaagatttgaaaatgcacgggactcgttgaaagcatgttaccaaactctgtttgatgtttttgactattgtcgggaatgtgcttgtgttaacaagcacgggtttagtccatcaagtagtagcaacagcagaagaaaatacagacaaagtaactcacagaggttagaaggtttcttatctagatttccacaagaattattggccaagagatcagcccaatgtaagtttaatgaacgagctatccttcacttggaagaaagctatagagctaagaaaatcccaaaagaagagtttatttccaccattcagtccatgtatgctgaaatcgatgacattgatgcattagacggtgtattaagaaagtattctaccgcaagtcttgataataaactggcccaagttgggttcagcgacaattggtctgtaacgctggaagcgtttaagacctccgcagagaatgaaatactgcactacgataataattttaagaacaacacaagattactcaagacattactagaacagcattattattcctcagctttggaaaaactcagtgcccttatttctcagatggattggaaaccaagctccatacccacagaatggatatcaattggattattggcttcggtgttttcaagaagtattgaggatacaaaaaggtgggtagttattatagaaaagcacccagaaacttcggttaccaattcgtctgagctgctttgtatttatgaaacagcaaaagccttgatcaacctacacgacaataaaaaggacgcaactctcaagtctatagagagggcttttggattttactcaattcagctatggaatgtaaacagtctgtcattgattcgaaaaagggacctatttacacaacttcactgtcttgaagaattgcatcaaattgctagctccacgaatagagacaactttgaactgacctctactgttttagattcaaagatagaacacgcggggcataattttagtgctctttggagtataattagtacaagaagagtggtagaagaaaatcatcctaagagctttgtgagagatgatttaagaaaaacttggactaaaagtgctaagattgctaggaagtttggtcgtcttgacctagctatgagctcaattgtcaatgttatgtcctcaaacgacctagattcaaatctagagtattctaaaattctttgggctcaaggcgagcagattaatgcattaaagcttgtggacaagattcgaacaagtgacattccaatggctaaaagaacatcggctaagatacagttgaaatattccaaatggttagatcaatcagcaaatgcaggagcttcgttaattataaatgagtacaacgaagctataaacttggataactcctggaataaacctcattatcatcttgccaagttctacaacaagctgttggaatccaactcgaacagaatgatctccctcaattctgagattgagcagtcttctaggcacattgacggcttttatgaagtcatggtagtgaaacactacgtcagctcattacttggaagtcctaagtacgtatttgaagtacttccgaagatgatcacagtatggttggattttgccgcaacatataaacaaagagtgattccttctggctttaaacctgagaccattcacaaaaaactagaggagaatcgtgcaaccatacataagtcaatcaggtatgcattagccagtcttccaagatactattggtatattgcattgtcgcagatgatctcgagggtgttacatggaaattcgtcgacaaagaatctattgattactataattgccgaagttgtccgctattatcctcaaagggctatttggtccgtattttccgttgtgagttctatggataaggagagatcagtcgttgggtcggagattgttgaaaaagtgaaaacgtctaaatgcattttgactgatgttagcaattatggtgaattattggaccaatgttggggtgtcattgaaaagttctacaatatttgcaatttgtacgtcaaagcagaaagaaactccacgcttaagctactcactgattttaaattccgcactttgtctattaattgcaaccatttggtactgccgatcaaaacaaattttaatattgtgctcccaaattcggggtctaataccaacaaatccaattcctccttccccgcagagaatactgtcaagtgccatttatttgagaataatgtttccattttatcatctttacagaagccgagaagggtgtcaatatggggagatgatggagtaaaatattcgattttatgcaaagccaatgatgatttgcgaaaggatgccaagatgatggagttttcgaatgtcattgatcgtttattgagcaaagacactgaatcagaaaaacgtagcttatctgtcttatcttacgctgttgtgccactaaacgagaaactgggacttattgagtgggtgaatgactgttccactatgaagtctgttctgtttcagtattaccagagtaaaacggatggagtaaacttcacgtatctgaaaaatatgctggcccctgaaaaaccactagaggtgaaactgcggaatttcgaagaagtgtcgaaaaagtatcaaccctatttacgacattggttcatggaagagtttccagatcctgctcaatggtaccatgctagaagcacttttactagatcgacagcagtaatgtctatgattggatatctaactggtctaggcgatagacatggagacaatattctcatttcgcatgctacaggttcagttttgcatgttgattttgattgtctttttggtaagggtgaaacactacaagtgccagagcgtgttcccttcaggttgacgcaaaacatggtggacgcgtttggtgttacaggctgtgaaggctcatttcgaaagggaagtgaagtaactcttgcattgatgagaaaccacgagtcccttttaatgaacaccctggagacatttttgtacgacccaattttggattgggcaagtgggcagaaaaacaagaagaacaaatcaatgatgtataatgcaggccctgaggttgctatggcagtaattcgaagaaaaattagaggaatactggatgcagactctatgcctttgagtgtagctgggcaggtagaagctttgatacttgaggccacatcatcagaaaatctatgtcaaatgtttgttggttggatgccattcttataaactagcataaggtatatcaacaaaacttatttactaaaattagtagttaccgactcgtgatctgacccatcttcgcatctctccccaaaatcaggctctccggcaccaggagctgaagagttaataattggagattcacttgacagagagtgaacttcttctttgatgaagataggctcacttggaatacttgacagttcaggctcttggatatctctaggaggtagagggggccttcgtttctgtgatttagcagctgagccagtgtctgggatgtttgtttccaattctgtttccgtgtctttttctagctcctcagttgtactgacctgtggaggaggctttcttatggccttagacgtaattttgggagcaggaatctcagagatatcatacgtagctgggtagtctgtgatatgagaatggggcgtaccatgaaatctacctccggaggaacttggagaaccaactaatattttttccttataaacaaacatttcagaagaaggtactctctcatgattatctctgcttgaaggggaatccttttccgaagacaatgacggtgcagttttcttgcctcttcgagactgaatcatttccggggggttataagtttctgtcatgagattgactgttgaatcgtcctttcgctctttataccacttgccaattttcttgatagaagtggagacatacttttttgactcctgaaaagcagaatcagaggacaatatgctaggtgaatccagaagatcagtttcgctttttctgttcagcttctttaagttggtattagctcttttggttaagtctgaaatagtggatgttgcttttgaacgcagtgatactgtatcagcatccacttcattgtcaccaataggaagtgagtactctgcagttctattagtttcctgggtctctaccgataacaagtcgacatcctccgaagcttcgggtgattgtcgagaatccatggaatcgggatgtgattgtgattgggtggaattccaaataccacctctgaaaatatcacactcagtgctgtagaaaacaaaatcatcatagaacggatgaactagactctctctaacagcttccttaaacttgtttccgatgattttggttatcaaattataattgaatgagcgggagctaacaataggatcaatctgaagatccaataagggcattttttcgaatgcataccaaagtcggtttgatggtggaggcttcattttgatcagtagtagtccttggagcttcaccactttgattctgagtttcacattaacctctttggtcttgaatctatttccaagactgatactcactttagttgaaatatcaactgttaacttgccctcatacaaaaagttggtagatattgtcagtgctccttctggggtcagatccttgagtttaggatgagtaatgaacggggcactgttgccaacatcaatgtgctcaatctgaaagtcatctaaaaatccaggtcttcttatcttttgaagtttagaatcaactctagccctaattgaatctttgaatttttttgtattctgtattgctaggaacagacggccaatcagagcattgaaccatttggatgttagctggccttctgttgaattgagtatttgaatcagattaatcatgtcagaattctgaaaatgcaagacatcggcgtacagtgaaggttctaggagatcttgagaatcattggttctgatatagtccctctttgaggccttcaacaaagcaaaataccaatcttctttttcatggttcaagtcagcatagataaaatatgatccttttggagcaatgcctgattcagaaatttcctccaaaagatcaggttttttcttcattatacaaattgcagatcttttagtaaagagttgattgtctggaagatttctaggccagacagacacaaaatgagttccatagttggccaacacaatgacatgttggacatttgttttctgttcgtcgctgtaaagaaagaggtttccatgttttaattcagccatgtatcgattcttccttctaaggattctcagtttcttggcatctacaagtaaaggatcgtggtcgtcctcgtcctctttctttttgtacaagctaaattttgaatcaatggacgagttttctagtgcagtggagttattgttcccagaattgagctccgaagggttaacctgtgaaaaatgatagaactctctggtgacagttaaccacccagacatgtaagtattcacaccattcgtgttctcgtcttcataaactccagcatcaaacttctctggcggatcctcatccagttcaggtttcaaaggaaccgactttccagctaaataaaatgaacagtataacaccagcggaacaaaggtgacgcctcccaaaacataaataaagagcaagaaaaaaaacatcaaacaaaacggataaggactatgaaccagtattaatccgctagaaataatattaaattcagttctaatctcagaaccagacgacctgaggtaagagctacgggactagtaattcaacctggggaagaaaggttccttttcaggagaatcaaaatgtcagatcgcgagtaacaagggttatactttagtaattattgtttatccctgtatttttataaatcgacctataaacttcgattaggtaccatcgtgcatcatcgaactgcaagaatgtaagtgtttctttttcgttcacacaaagtttcagcagagaagtttattaatacttgcttccgtctgacaaccaataacagaagaagaaaactaagactggcccgctgaaatatttcgtacaaccagagattgtcaatgtccaatgttctagtcggagtgaagcctttgaatggaggtgcaaaatcggacccagttcctggcaacgtatattatgagaagggctacgatacactggtccttcccatcaccaacgccaaatatcgagagacttgcaagttgaaattcaaagagtataaagagctaatgggagtgaacggcgataagatcgacaacttgaacatgctagatgtcccatatccacagtattttcaactgaatccagtgaaaaataataatatcatagggctcttaagttcttgggtggaactggactcaagagataaattgatcaatgagttttctagtcaggtcttgagacacgaagttagttatgcatctttcttggggatccaaacggtgataattgcgcctccaagaaatttaacaaatctgcagatttttacgagtaatctgaattctttgataagcagctttcctaaggtgaatttttccatttccttgcctatatgtgaagaatctcgctggagtgaagacggcaaactttcgacagttattgatcccctctccacatgggacctgtggaattctattcggagtcaatgtgactatgcttttaacctgtccgtttcattagctttacctaagggcaacattcctcgttacgtgattaatcgatgggtattagagccaataaagtgctttctgatcaacacatccagattcatcaccaatgcaaagggcttcccggtgttaagcaaattcaaccaaatcatcatttggtttataatccaaaaaagggctctagatccaccagctctgatcttgcatggagatctcaaagatacctccaacttggaatacctaaagtacttggtgtctatttcttcaaaaaactcacaattgacggtcatcgaacattttaacctgaaatctcttgtaatctccaatcgtcaagagcagttacagacaccactacagccatatcagcatgatttggataatttgacttaccagatctttgaaaaagatgctgcaaaatatgactcatacgaacgagctttcatagcagtactcaaagatgcatctaaaaatggtcgattgggcgagcttcaagacgacttaagacaacagctacctcctttcaatatactagtcgttgggcccggtcaaggcccactgatttccaaactattcatggcaattaaatccttagggcttgatctgcaatcattccgcatcacagccattgagaagaacccaaatgtgatacctcatcttgcacaaattaactatgccaaatggagtggtattgtaaccattattaacgaaagcacaaattcttgggaatatagaggcccatttttcaatttggtcattagtgagttgctgggaagtttcggatgcaatgaactctctccggaatgcttgaatccattggagaaatattgtgaagaggattgtatattcatcccgcagtcttactcttcctatattgcaccagcaacctcgccagccatttattcaaaattgagttctaatcaagcacctgtgttaccattgggtttcccgcacgaaatcatttccacaaagtatgaacatatatggacatttgaacacccgagtcgaacgagaccttccgttccacaaccaggtaacttacacaataaacgaacatctctcactacatttaaatgtcatcataagggggtcattcatggagttcttgggtatttcactgctgtcttataccctggtatacacctttctaatatgccttcggagcctgaacctccaactttgatcagttggttaccgatatttttcccgttggagtcaccgatctatatttcagacgaccaagaagtgtcgattctaatgaagagagaataccgtgataacagagtttggtacgaatggtcagtagaatgtttcatgtatttagtgcttccatcgcaggaatcccagtccacgacgcagcgcaattcctataatgttgacccgcaaggggccacagctgttcctcgttcttggtctcatagggtcaatattaatcaggtgacggctttggctgcccagctacatcttcgacaagacagcaacatcaatagcattttcaactctgaatgtgagaaatcagacatccaaagaggagacattgaggaggagcaagaggaggagtatcaacttagagttcgcactggggtaagccgggtacataatgcgggcggtaggtttcattctctaagactctagatcttctattccattcaggaattacataaaacattgcattgcttacctagttttaatgattttgtaagattgcagtcttggccataattatgaaaaaaactctcttctcgttcacccttttattcatctgattgaagcatctacattactctcgctcctccaaccaacagtagtcgtatccttcgcgaaatcaacaatcgactttaagtaacatatcaagaatcgtcgcaagcaatactaaacgaaccagaccgtatgcctgctattccatacgactatccttcgatagtctcacatggtactcctagaaagcagaaaagtcaggcaaagagctcacgagcgacgcaaaacttcaaaattgctcatcaaaaagttcagcttgatgttgacctcgccactcagacagtcaatggagagacggaactgaccatatttgctactgatccttcgttaaacaaggttcgtctagacgcaagatgtatgcaaatacaggaggtatttgtgaactcaacgaaggccgactttatcatggaggatttttcccgaaacgatgaatttcaaaatgatccaaacaacgaaacattgcaacgaattcatcgttatcaaaaaagttacgacaccaattctgaaagtattgacatctaccagcatcatttctatcgtagcaaatttaacccgttgtatttagatttgaacgatcacgaaagtcctgaatctgtggaaactctaaacactgaaaacctgaccgtgtatttacctgaaaacttgcgattacgtccgcatgatttaagcaatacctactcaccggtttcaaattacaattcgccattgacgacgaactctgctttaatgaattctgatcgactgtatacccctttcgttttaaagataaaatattcattgagagtacctaagaacggaataatattcaatggaggcgttcacactacaatagagaaaacgcaatggttttgtcacactataaataatgacatcggttgtagtgcaagctcttggatgccttgcattgataacttttacgaaaaatacacttgggaacttcaattgattgtccccaagacagtcggtgatataggtcaaactaagcctattggtgaaaagttttcaaagcaacctaatgataatgatgatgacgatgatgacatgattgactcctaccaagaaacggatgaagaaatgacaagagaaataaaggtggtacttccagactttgaaagtgttaaggaaagtccacatatacttgaccactctaagaaagttgtcagcgtccagctttataacaatccagtagctgcacatcacataggattttttattgggccttttgaacagctcccagcttccacatttaagtttctagatcaatctcagccaaggatattggacggagaagaaaacaatcatagtgattttacgagcaatgttgcggccagagtctactttttaccctcacagaaagaaatggtgttaaacacttgcctggcgctttataaaaatttagacttttattccaaagagtttggatcttatcccttcagcacctactccatggtatttgtggataatcttccaacgcaatatagcagctttgccggagtttcagttataagctctgaagtcttatatgagtctagccttgtggaacctttattcccagtcactgagctactgtctttaatagttgcagaacaatggtccggaattaacattgttcccaagagcttaaatgattactggtgtgttattggtatagctcattttatggcgggccaatttttgaagaaactgttcggctttaacaattataaatttgttataaagcaaagatccgatcgcatttgtcgagaagatatagggaaagctcctttagcaaatcaacattttcgatttcctgtcaatgatgctacagacttcaaattcataaggctaaaggctccattagtcttgttcattttagatagaaggatgactaaaacggacagatcttttggtctctcacgagtaattccaaaaatatttcttcaagctatgtctcatgacctatataatggaaactgtctgtcaacaagtcactttcaacatgtctgtgagaaggttgcgcaccacaagttagatcctttcttcaacaactgggtccataattctggaaccccagtacttagagtgacccagagattcaataaaaaacggatgtttattgagatgggtatcaggcaggtccaaggctatgaattagctaggtcagacgcttctaagtctcgtaaaaaggatccggtatcatttttgaacgaggcgtgtcagcacgtcaaccaaactggtcctgggatcacctcacagattttcacaggtccaatgacaatacggattcatgaagcagatggaaccccttacgaacatatagtagatctaaaggaaggttttactaaactggacattcaatacaacaccaaatataagagaatcaaaaagaacaagaaagatgaagaattaacgaagaaggatgattccgaaaatacggtgaatagactgggtgacatactttcacgctcaaaagacatgcaagaatggcatttagaagatcttagtgctgaaggtgaagaagcaagaacacaagacgcatttgagtggattagaattgatgcagattttgaatggatttgtcagatacatctcaaccaacctgattatatgtatcagtcccagttacaacaggatagagatgttgaggctcagcttgatagtgtcaattttttttcaaactctcttagaccaaatgtattttattccagtgttttggtgagaaccctgatggatagtagatatttttatggagttagatgtgaagctgcaaaaggattggcccgactttccaaagaagaaaacaaccatattggactacaccatttattaaaagcattgaagcaattgttctgttatccaatgcatgactctcatgaagacgcaactacgttaataaataatccgaagaactttttaccccttcccaatgatttttctgattttcaacggatgttcattcaggagacaatacctgcggctctttccacaataaaaattaaagattcggacctatttttgaatttgagaaggatcctgctcagattattacagtacaacgataatttaagcaatgattttaatgattgtttctacatctgcagcttgattcgggccttgtcaaacactgtagttgaagcgggaatggttctacaagaccataatgaaggtatatcttattatgacgaagctacctctgaagatggcacattggatgatcgcatgaataatatcaaccgagaaacgatcatcgagtttaacagaaggttacagcttgaccaatgggatgtttcttatcacacttgtatcagtgatacaattctgaacgaaaaggttcgtttggggagtgaaggactcataaaatttcgctttccggaactattgcaagttactcaaaagaaatattcgatatacgttagattggccggattcagagggcttctattgttaggcggattaaagaacaagtctgtgctacattatttttttagtaccgcaaaacttgagtcatcagcattgtttaagagggggttaatagaccattttctagaagcagtgggtgtagccgctttatttggcacaccttccactttagatgatccagagtttgatagattcgaggaagaactggaacaattgcgacttagcaagatcaaggacggaaagccatcttctgggctagaaaattctaaggaattattgaatgcaagcaatttcgttgttgaagaaggattttcaaataaatctcgaagagacacctatatcaggactaccatgaagggggccattcaaattttaaaaagggactatgcaattggtgagggtctcacgaaggaactatggagtgcagtgcattcttgtttactgagtattaacttgaaaagagacatatttgatctgattgatctcatgtatgatgcttacgactcctaccttgtgaagatagattctgtttcggacaagaaagtggttactagagttgaaacggtaggtgacaacacggcgatagtaaaactttatgcaaaaccacgcccgaagccttcaatcgtggactctactagccaaaaaatcgaagagaaacctaaaataaagttagggttcaaaaagtccacagagaaaagctcgggtctctctttgaaaattaaaccaaaaaatgttgaggtgccggaaaaggttaggccatccaaagtcaaaaaggaaattgaaccaccaaaagaaaatggaccttctgagaaaaaaataccgcctcctagctcacttgttgatgatgtcactgctccaacacccaaagttgaagacatctctaatcacagatccaagaagcagcttctagttaagtttggttacaaaactgctaactccagacgatttgtcagaatcttgctccgggagaaaaggctggaattttcttccattcctttcaacccaaagcgatatgatgtaaaattgaagtacaatagagagctacttgaagaaaggactagggcaagagttgatgaggatcaaaattcttcctcgaactcctattcaatgtcaattgatggtaaagcaacaaattcaggccccgtcgatagcctcaacgacgattccatacctacagatggagtcgcagaactcaaaccagaagttgaacagagaaagaaaagagttgcaaagtccaccccaaaagctcgtcaatctagaaccattgaatccgaccaggatgcattgatttctcgatcccataaaagacaaaaattcaatcccactatcaataaacccaagtccgaagaagaaataggggaaaaccaaacacctgaagctggtacacaaccaactcccaaaacgaagccaaaggccaaaactaaaattaaactaaaactcaaattttaatgaacgaggaaagcttcatgagccagagcattataatcatactgtatctatatattatgtcatcaatctaacgattagcgaagccgttcttctcgaaggaccaagaatcctcatttattcttcctctcaggacggggggttcggaacccttgacataaacatcttcaaataaaatatccattttggcttcagggggaggagcgagttcagcttctttggtttgcttgtcaacatactttctagcctccttgtcataggccttgagttcctcctctgtagatattccaagctcaattaagtgcatcttcaagcctgcaattgggtcatttctggatctcatgttctgcacttcttcacgtgttctgtaagtggttcctgggtcggacatagagtgtccaccatacctgtaggtctcgtactccattactagaggaccatttcccgagacagtccagtccttggcaaacttagaagcttggtaacaagcaagaacatccataccattcactttcaaaccggggataaattgccctctcttgtagtactcagtcatagcagatgatctagaagcagaagttcccataccatacttgttgttttcacaggcaaaaatcacaggcaaatcccacaacttggccatattaaaggactcgaatacttgaccttggttagaagcaccatccccgtacagggcaaatgtacagttcttctcattcctgtactgatgtgcaaaggccagaccagcaccaactggaacttgagcaccaacaattccgtttccaccgtagaatccagtagtgaacatatgcatcgaaccacctttaccgtaagacacaccacatctcttacccatcaattcaccctggacttccttgacagaggcacctcttaaatatgtgaaaccgtgacatctataggatgtaataacagtgtccttcttagttatagcactctcaattcctacagccacggcttcttggcctacagacaagtggcagaaacctctaatctttttagccttgtagagggcatctgaagccatttccatacgtctgacaatcaccatttgcttatacatttgcagcagagtctccttctccgtttcaaactgaagctctggaccttgctctaactcataagtctcgaaagaagaggctgggaggtcaatggaaacagtcgatgggcttgcagaagccatatatctggcattggccactcttgcagcaattctagattgagggctgagaaacttgagcatcttggtggttgtattggaagtgaggaagagtctcaaaaaagttgaggacagacaacacaaggagttagggtactaagcgcgaccgggagaaaactgtccgtaaggaggggttcggttaaacattatgggggcgcgcagatgccagatgcattcggtgggggcggagagaaatcaaaaggtcaattcagtcaacccttgattcgaaaaaaaaaaaaagaatgtcagatgtcatgatccattctaattcttatcagtaagaggtaatgcaaactgataaactacgaagtattcccctaagtacgacaattctttcaactcaattaaaggcttctccagaattaagatagactgcataatattgagcaatccctgtcgattcgcgactcagttggtagcatgaatttactctagtttgcaaccagcacctcctgctgtctcctcctatttgctccgtcgctatccttccagggaatccgcctcagttagagaaactcaaaaaaaaaaacctcaaaaaagcaccaataaaaaatgggatggttttgggctgatagtgccagtgaccctttgactaaaccgactgcgtgtcctgtgaatcatgcgaaacaagacgtgtgtcctgtgaaacatgatgtttcgttttctaagaaagaaaattccgtatctgaatgtcccgtcaaacttgataaggacgggacgcccttgaaccctctgaacaacatgccctatgatctgtcttcggctcgagctcctggccaaaaaatatcattgcctacacagcgaacattgtcaacgattcccaagggggaaactgatgcccagggtgtttgggaatacccatccccacaacaaatgctaaatgcgatgttacgtaagggtaaaggggagattgctgaggatgctgttgaatccatggtcgatgttcacaactttttgaacgaaggtgcgtggcagcaaatcctagcctgggaaaagagacacacggaagaaaacaaagttgagccaagactcctcaagtttactggccgtccctatgatctatctcccagagcagctatgtatcaatatctgggcaaattgtttccatcccatttcagtacccagccaccatttgacaggcatgattggacagtgttgagatcgaaaaacggctcaacatctagtgacgcaagagaatggagcaaagtccgctacgtcatagactattatggcggtccggatgatgaagatggaatgccaaccttcttcttggatgtgagacctgcgctggacaatttcactaatgcatacgaccgctttttacattggaatgaagaaatgaagcctgtatgggcaaaggctctgggaaagggatctaggtaaaagcctgggcaaatcatctgggtgttatttatatttacaaataatctatttttatttacacgtaggttcttttggtttgcatcttctcatccgcttgcagaatctgatcgttcaggttctctggtattttgatattaggataggttctttctaggtttttcagtattggagctagagagcgtcccaaatgaatactggcagcatccaactcgttaatcaaatactgaagtctttcagaatcctgtaatctgtcagcgcacctaattaaatgatagaatgtgaaatgattgggcttggccattttggtattactgttcttcagatcgttatagtatgcaatagccttctccaggttgttctgcttactgaacccttcaattgggatattgtagtaaggagttgaaggagtaattccagcctttgaaatgctctccttgaaaaattgttcgccaataaacggatctccaaacttaaactctgaagagataatagaggtgtaagtaacgaagttcaggttcattttttcttttttcatgtaatcaacaagcagtcttccaacttccaaggtggaaggatcctgcatcagaatatgtaccatagacgagatagtcacggcgttcgtatggataccattttgtttcatttctttgaatatgggggttaattgatcaaactctactttcccgtttactgattgcttcagcattaacgaaatgataattgtgtaggtagcaatgtcaggctgaacattgtactgggacattttttcaaacatttgaagagcttggtcatactttttgtgtttgatatatgttgatagtagcttattgaacacaaacacttgaggcgaataagtttcatctgactccaaaaattgtttaaaaagcttttccgcatctgctagctgattcttgtccagaagcttggacaaaacattgtccttcatcttcaatgtgagtggtattacggcttccttttgcagctgattcagcaactggatagctttctcgtgttgattaaaagcgataaggcctaccaaataatactcataagaaatagcatttggctgataaaatttgttcaggtattcccaaattccctccaacttttcaagacatttttcatcagagtctctcaattttgtgtgagtgtataataattcgttgaaagatctgatagagggttggatatcctgagacaccatatcttcccataaggcaagactagccttagtattgtttgacaaagagtacagatgcatcaactgagcatacgtagtctcgtcatatggcttgggtgaggaacttttgatctgttcaataatctggtcggcatctttcatttttccctctagaataagggttgttgccaaagaaaatgactctggattgttgtacttcatagactcatacttgaacttttccaagctcttataacattggctactcaacttcttcgaagccttgatctcgtataagtatttcttaagctgagagatgctaggaacctttgagacttgaagtaattctttaaaataagagctctctggctgtttgctcatagctatacaagcttgattgtaagcaataaaaaggaaagccaatcttctgtctaactcggaattgtcgtctctgacttcaagtgcctctggatggtgcttcaaatactcaacgctttcaacatacaatgagagcgcctcttgagcattattctgtctcaaataatttgcacatacacggttaaagtgggaaacatgggccaaattgttatttatcaaaactttcagtatttggtattcaatggttcccacgtcgctcttatcctcactgagtttcactgattgattcatgaacttatgtccaacgctagtcatactaagaactgaggttttctctggtagctctacaactccttgagagaatttggagagtaagtcattgaagttcaattcgttctggttgagaatttcgtatagaccggaagttggcgttcttcgtgaaaactgggatttattttgcttcactgctgttgatgtagcatcagtagccagggaacgactcaatgatttgctgttcaagcatgctcttagaacagctcgggaaaactgactggtattcagcattggtggctaactataggccgattctcaaatttttcagtacaaagaatcggaaatcgtggtcgtgtgaaggagaataaatggataaggtctactatatacagattagatccagtgctccagctctgactgttctatggtcatcggagccgaagaagcttgcctttgacgaaaacactcctgcaatagaaataaaaatctttactagcagaatcctaaactacttcaatatataatccgaaaaatatcgtcaaacgcctttggtcctcgacattccgaacactaaaaaataatacaaccaccagtcagaaaacaagtggcttaatcacactggtataattggtacaatataatcatactttactcttgctaatcttggcttcttcctcttcatcactgtcttcaaccaagaaagtgtcgtcgtctattggatgagggtcagcggattgtagcggttgccatctgtccttttcaggatccttcttctctgcagtagacactttcttggtctccttagtctcattgacggccttggcttctggggcatcaaaatctaatgtagggtcctgacttgagaaagctataccagtattgccggaaacattctcagcgtcctgttcaacatcagatctggctttttccaaagaggagcccctgctggtagggttattgttaccaaacgcagaaaataggttcttgctttgaggctgatctgcttggtttgaagtggtttgatctatttttttacctaatccaccaatccaactgttaatcttggatctggctccctccacgttcttgctcaattgttcagtaaattgcgggaggtccttgtcaagaaatttgtcgaaaaaatcgtcgtcagattcggcatcttgcttgcgatgggaatcacgacgagatgacccgctggagcgagatgacgacttgtattgtctagccagacgacgagccaacttttcatcactttcaatctgggaaaattcaccaccatggctttgtctactaggtagtttgggatgttgaggcctgggaatctctggaacaaaggttggatctgacaggtacaacagagcattgaaggcaggatccaattcaccactggatgcaactagcacagcagtaatgtatttttcttcaaattgtggaaaagcttccttcaaagtttgttttgcctgggttaatggggaaacaggcctaggtggtctctgaggagggagatcttctccttcagcttcaagtggtgcttgtttcttttcaattgaagaggtcttggcctcattcagatcagcagaatcatcaatagtcagattctcggtagctttgtccagcccagggactccagaagtttcaattggttcctttttatcagaagttgacatgttaaatggggaaattaggatttaaagcgttggatgtatctcagcaaatgtgatagtcgattcgcgcgtcctttcagctttgccatgaaaacgtgaagccaaggggagtgtataagagataagagggctaccaaggcctttgttgaactctgtggagaatgacttgcatgattgtttagccgatgacagttgatgagagactcaacgcttagaaaagctcaaacggcagttcaaagctccttgcctcaactacatattgtcatcacgtgagaactcttcatttctcatgtatgcgatgagtaggtcaaacggtgctgagctagccaatattgagaatagtatccactatgcagtggcgtggtgagaatacacagtatacagacatgttcatcatccaacgaggcccacatttaatattttcagggcctagaaactatccctcgcagttgcaccagttcataactcttcgacttgatcccagcagtatctctgcagatgtctggctaatgcatcgtctaattatctcctgtatgtgcttcaacaaagtgaacaaccatgaatgagtactttaatgatttcacttttgcttgccttgttaaccccaggagaagtcgattgcattaattgaaaggtcgtgtcttgtgtcataaatttttcaacatcgttcctacaaaaatctagtgcaagtttgttcatcatagcaaaacctttaatataaaatgtcattcttaggtttaggaggttctccaaacgtttcatcacaagccaagatacaagctgctgaagcagaactggacatggtgactggaatgttcaaccagtaagtgtgttgccaacgattgctatcctttttgtagtcatactaacagttccgttaagactagtcgatatctgtcacaaaaagtgtattggaaccagctacaatgcttcagatttggacaaaaatgagagcttgtgtgtggatcgttgcgttgccaaatatttcgacaccaacttgaaggtcggtgatagtatgcagaaagttggacagaatggtgctttcggtgtgaacagataaacgccaattatatatattctcaaggcagggtatttccgttaagtttttttgtaaatatatacaaaactctgctatttataatttttagagtccgagagctctgaagagtctcaattttacgccttctattgaattcagctttggtctaacatccaaatagaaactgggcatttgagggttcttggggttgggctttccaccgtaaaaatcgatcacatagtcaacctgggtgccacatctatcgattgtccagtcatgacggtcaaatggtctctcatatcctagaaaaagtctccaccttgcccggggggttagtttcttcgaatcacctttgaaactagtcagttggattcctccacaagattggcctccctttccatgttcccacatttgaatgtatttccaagcctgttcgttcaccgcattatgtataggaacaatacttttcatgtctttagcatgagggttccagtcttttcttcgcattgcttcaaaaaactgtttctgtgatgggtagatccagttcagttcggctccagtgcgtggaatggaactaatctctctatccgtgggaaggtctatgttggaagaatacgtaggttgttctggaagagcgtctgaggaacattccacggactctggggcagaaacactgacagatacattttcaatccatctagatctagcatcgtgatctacaggacagcttgcagggacttcagacgaattttttggttctgatttcttttcagatgcactactccatttccaccagctctttgatgatgactccggttcgggggcagattttctttgtgcggaagcctgctctacctggttgttcttttgcagccagacagcttgggcttcgtggtcgactggacacttgggttgatcttccttcgacatggtatcaatgtcagtggtttactcagtaattaaatatgcactatagagggaagtcggagtgtaatattcgcgaaagttctaaagcctgattcgactgattacctaacaaaaacaaacttaaactactacttaatttattagacgtaaacggtagtaacgttagagaaactggagaactgtggtgccaaagaaggttctaaagttggttccgaagaagaactttgggtacttgtgactgtcacatacacggtactgtagatggtctcgtacaaatcggtggatgtggggacgacagttataagtgaaccagcaccgtcaaggattgacacaactgttgagaaaggaatggtatgagtgacagcaatagtggaagtgattgttgaagtaactccatctgcgggggcagcagttgtaggagaaacatacccagtttcacagtcgtgttctgttacagttacggtgactgtctccttaccagacccagatcctgaaccggatcctgagcccgatcctgaacctgagcctgaacctgaacctgaacctgaacctgaacctgagcctgaacctgaacctgagcctgagcctgagcctgagcctgagcctgagcctgaacctgaacctgaacctgagccagatccatcagttggaatgacatagatagtggtggtcgaagtggtggtggtggatgtctctgtaaaaagcgtggtagtagtttcgttcaaagcacgggcccaaacgtcagcaaagttggcagaaacagttccaagggcaactgccacggaagctaaagtagagaatctcatggtgacgaaatgttataactggaatataaaggaacggacgcgttagatacgcaaaactaactttcaaactgagaagaataaattaggttaatgtttaccaggcatgtcaaatgtatttatacgagccgtggccaaaggagacattttggtttgtttgttgatatttttcatctataacaataaatacacggtacttaaatgctgcagtagggatatctgcatgaaacttgcatacaaagggatgccgagaccatataagaaatctcgacgagaggctactacaaagctgggcatggaaggggggatgctgctaaaagtctgtcacgtatccagatatgagtaacaaaaccacaacaacaaccagtagacttttttctgctagggatcgtttgattctcactccctcccccatggcctatctgtgagcacatgtttcacactggttttgaaattccatttgcgcgcatgcagttattgctccttgcatattcagattcagaatacaatagtatgacaacacaattcctgtaagaagtaaacagtaaataaagaattaacatacgcggccccccttcatacgccagtggaatactggaatgttaggacaagaaatgtactggcattcttggctagcggaatacggtcaggtttccatccagaccatttcattttcttagacgcattcgtggatgaagcgagagcacgaatcgtcgataacttacggtaaaacagaccaaaaggttgtcgaccccgtacctgagtagaagcagtgggatagagacgcattgggacggaatgcaatcggaagtatcaatttaggatgaaataatcaaaataagaaacgtacatcaagaggtactaattagccaacttgcgctgatcaaaaccagattgggcaatatttagctcaacctgctttcaggttcagcttgactcttgcgcaattcggccagccttttggcctcctcgtgaatttgcttggcatcagtgatgacctcaagatagaacttatggattcgtgatccgtatggatctttcttaaatctgtcaatgtaagaagctaaagtgtgctttcccttctctaatttctcctcaattcctaatttggtgtcagcttcatgcaattgttcagatgtcttctcttgaacatgatatctctgatcaacgttagcgaggaaatcattgaattgctgggagattccatgttgcttgtcaaaatcgattgctttctcaattagactatctgacagcacatacccttgagacagatattgggccacaatagctgcctttggtttcaattcttgtggggcatcagagtctggatcgattccaccgcttccaccgacattgttatctgaaacgacaacaccaacattttcgtcatctccgtcatctccggggacagtttgtagtactggttcctcggaatcgtcagaagcagcggtaacagtgattggttttccgcccagttctgctccattcaaaaggatagcggtgctaacagccgctttagactcaaactccacaattgccttcttgaatttgttatcgtgtgcatcgatagtcaactcgatttcaagcgacttgattttaccacagaattggaaaaacttctcaatctcggactcttcgacttggaatgggatttgggatgctataactacgctcatttttgatgtttctttcaactggtttactaggggggctaagatgataagcaattagagtgacaggaagcaccctggctatatcgtggcgcaaccaatggtctcgatcgcccacccacgaaaagtgcggctgatgtcagatgtttgttaattatatcttctaggtcattctatactaaggtctcccctaaagcacttttggctatagcacagcctgcagcaatggtatcaaactcatgaacatttgagatggccaggtctgggttgcattccactatgtccagagccgccaggtttcccgtctctgccacagcttccactatatacattccctcgcggaaagttaatcctccccttacaggggtaccggtggctggggtgaacaaaggatccagcgcatcaacgtcgtaagaaatgtgaactggcgacttcccagaaggattgatttttgacagtgccatttcgactactttggcaattccgtacttgtcaacgtggtacatcgagtaagctgcaattccaagctcacgcaagatcaccttttcaccagcatcaacatccctcagaccaatgtaggcaattctgttggccagcaacttcgtccttgcgttgtccaaccaatcgaactgcttgtgccataagtccctcttaagccccatagcaaaagatacgggaaatccatgcagatttcccgagggtgacgtgtctggggtgttgatatcagcatgcgcatcgatccataagacacaggcatcgggatatgcgtctaaaaatccagcaagagtagacattccaattgcatgatcgcctccaattgtcagtggaaagacttttttatgagctactgatttcactgtttcaaatatcttctcggtggcttgacccacgatagtagggtttctcattctagagttgcctgcttcgaaaatctcctgggatatttccgatggaggaagatctagaccgctatctttcaagggttcctccaatgagactttccatcccaaggcttccagatcttccttgagaccgtgtttcaagagatatttggggcctttttcaactccaccatttcgttgaccagcactgaatggtgcacttataatagttacttccttgttaggataaaagttgtaattgacttgagtttccatgatgagttacagagagtacgaaaaagaagagagaggatttaatctccttttataccaattacaagtgtcctttaatcaaccgttaacggtatagatatgtattgatatactagtatcagttgccattagagtaactaggagcgaaagataaaagttgcaaactgacaaaggacaggtcagagcgaggtaagttttcctgccagtaagtggccgcgaacgccactgatgttagcgaaccagcaccacggcaggatgacctgagctgcttctgtcaaaaatcgacttggtaacgagaaataaagcactacagttggtgtattgtcttccataatcatttattttaagtaacccaaattagaaaaaataaattagttaattatttgcagtttgaacacttgcaagactcaccagagcacttgcaatctccgctgctggtgcaaccgcagctggatgactcttgggacatgtcaacaaacatcttgttggaacatgaggagcagctgcactttcctggttcacaggtgcatgtggaagtagatgtggaacatgagcaggacattgttgatttagttaatgtgataattgactgtgggattttgaaccttgttggtactggttcttggatagagcgaaactccgcttttttataccccaaagggaagggcaaaaaaaagaaacgcgaagaagcaaaactagcgcacatcaccttatcttcttcagcacaattatcgcatccgtgatgccagacaatgaccctttaatgcaaggcaggaaaggagcatgggtcaaatcagcacaattgactcaaacgaggataacgaaggtcaactgtttccattagcttccaaatcagaatcaaccacgtcacccaaatgtctgtcttcgtagaaagtttcatctttgatttctgaaggaagatattcttgaacgaccttaccctccttgaagtctgggttgtatttataacccttgctgtatccaagttcttccataagtttggtaggagcatttctaagatgcataggaattggagctccagcaaaattggcgtcctgagcgacttttgctttcactttattccaagctctatagatagaaacactcttggctgcggtcgcaagcttataagcacaatgcgctaacatgacatcagcctcgggtagtcccactttgtggacagcatcgaaagttgcgactgcaaatggcaagcaagagtcgtctacaactccaatgtcctcagaggccatacggatcattcgtcttgaaatatacagtgggtcctctcccccatgtagcattctcgcaaggtagtataaagttgcatctacattggaacctctgactgatttgtgaaaggccgaaattgcatcgtagtgttgatctccgactctatcgtaaactgcatgcgtggagcgaagcacttccctcaacgtcgatgggtccacttcaacggaggcagcagtggtatcatcattcttttgatagtgagaatcaaccatttcaaccaaattcagtgctgtccttgagtcaccccctgcaacaccaataatatattgtaaagattccgtcgtcagtcgtaaaactggcatattgtacactagctttctaacccgattcaccaataggagacttcggttaaccactttggccaaatcctcattatctagtttgtttagtacaaaaactcgacatcttgacagcagcgcactgttcagctggaaactcgggttttccgtcgtggctcctattaagatgatatctccacgctccacgtagggcaaaaacgcgtcttgctgtgatttattgaacctgtgtatctcgtcacagaataatactgtacggcgcttcgtgagtctcatctcgttcctagcctcttcgaaaacctttctgcactcgcttattccactggaagtggcgctcagttcaacacatcggttatgagtggaagctgcaataatacgagccaaactggttttacctactcctggcggtccccataatatcattgaaggtactctatcatgttcaatgaacccacgtagtactccagtgggcccaaccagatggctttgcccaacgtactcttctaaggtttttggccgtagcctttctgctaagggtaattttgctgacatacgcaattttttgatatctgtagcttcattcagtttttgtttctttgtagccggctctgttgaaggaacactcgagttctgtgttggggaggaggataagttggttgttagatcgtagttgtcttgttcggagggtatttcaacaaccgtcttttgactggggctagtgatgccttcacccttgaactttccatgggataagactgactttgcagaaactggtttctttggctccttctgagccatgcattgatcgagatgtgcgttaatggcaccaatgtccatagacttggagcaaatgggacatctaaccatttcaatgaagggaaaccgttaccaagacctacattcaattcttcgcgcgatacacttagatttgatatcaccaaacaatacaatacaaatacaatatacaatcgactagtaaggtagggtagaaaaaggagaaactaatctctttctctttccctatcgtgcttcttttccttcttcttctttttttttacctttttggatcgcttttctccgtcagattcagaaacagcgtcttcaactgcggcagcagcagcagcaacggcagcactggcagcggcagcaacgtcttcttcgttgtctagatgaacgccatcattcacaactccggtatcatctcccacggagccaacagcttcagcgatcgcgtggtgttctaattttgggtgtttaagcaaatttgaagcattggcaaattcaatctttcttttacgtgtatgagcagctttctggtattcttcaggaatttcagcaccggtactgatcaaatcgtcaatgtagcggtctttttcatgctggtacaactccaattcctcattgtatttcctcttccattcatctctctcttcgcttggaagatccttccatttcttggatgtctcatgagtcatctccaaagaactgagaggcggcagccccttacgggcacgttcctccatgatttctttacgtgctagcgcactgtaagcaaaatacatggttaacggctttttaggggcattggggtctctagctttcttagcagcggcagcagcagctctcttttggcttgtactctgagcaccagcaacagagtagtcaacatcgcccacagctcttgctaatttagcaatgccagcaatatcacctggtagcggctgttcaatggcattgaaaaaattgaccgtggcggttgatgcctcctgagcagctttgcttagctcaaagaaggaagcaaccaaagcatccttcagcttcttgacatcctttgcgttcactgcagtggctgtcatgtcctgataatttagacgtgtatgttttgtttacgtcccgtgtgtttttcctggagtctaaggctttcttggttagctactggcttgcaagggagacttggacgggggttaagtagaagtctaagggcaagcgaggcctaccccttttaactggtgggtgttttgatttttttcttccttcgcgacctgaataattacgagttccgaggggcgcatgatcctgtttactcgaacaagtatggtagaaaaccatggtatctgagaagacgttggaaggcacaagcgtgtttctagggttaaaatcagtcattcgttatgctcagtaaaagaacaaaactaataacaccatttttcgtaattttgctagcccattcgaaaacttcgagtagtgtaccaaacagtgatttcccactaccacagtgtttttttcaatttcctgttcgccgcaaggaattagtggaggagggagcggtgttccgctaatgaggtgactgttatctgattggcctttttcagggggtgattaagaaaaaaggggactatgctgctagcgatgaatcaagttccgttttcaggatgcttcataatcaggcatataccgtgttttctaagtctgcaatataatcttggcctgggccagagggtttcgatcgtgtcgccctataacacgcaacacctgcgcacatcgtggaaagtccagtggaggaatttccacctgtggggaacataacttaatcctttcgcgataagtttggggaagcatactttgatagaggaagggctagttgggattagagctctatcacgtctagaaaatgtagcttctggtatccttgtacgaaatcaaaaaggcacaactagttttcagagagaaaagacgattaatcacgacgaaccaagaccttgcgacgactcaattaccgcggtgaacccttgacccactggcaggtttttgtaaactcttcgcgaatctgttgcccacttccagcaactctttccaggctaccaccaaattctccatccccgactcgccttaatgtctaatttccttatctcttatcatcatgaagtcttgacacttgagaactcctctcaccaattgaccaatttcaaaacacctctcagtgaatttagacatccaccaatagaagatggtctccctatcgttcagcgtgtttgactcatcaatgtctaatctcattcctgcttgttcaaacttatcctcctccacgtggatcacacgtggattattcttatatatataacatcctgattcaaatggtaacaagggtgatcaaacctagtacaatgtcttcagccataggtgatcacttcatatcattggcaaatccagaaccatgggtttctcaaacaacggtggtaataacaggtttactgttgatgctcacaacttgtcttgtttggttcaatcaaactgtacgctccctaactctattctgctgggcttgtttcttcaaaccgtttgcaaagaatgatcatggaaattctcaccaatctgctctggaatctttttatcgcagtcaagcttccatatacgactcttcgagaggggtgcttctgaaaggaagagaaaaggcattgcaattggcagcctcccacttaaaaaaatccagcaaacttgtttggattgatgttggtggtggtactggatataacgttgaaataatgaactctcttttgccgattacgtcaaagttcgaaaaggtcattgtggttgacttgtcaatttcactttgcgaagttgctaagcaaagatttgaaaagcttggattcaacaacgttgaagtgttagttgcagatgcatgtgactttctggtccctgaaaaatacatggggaatgtagatttgattacgttttcttactccttgtcaatgattcccccattccacgctgccgttgatcacatcttgccaatgttgaataaagagataggtatcatttgttcggtggactttggggtacaaacttctgccacaagtattggaagaaccaacactctgggtggctcagttaatagacacgttccttgggttttcagaacattctggagagcttggtttgaattggatagagtattcttggaccctgccagaagagactacttggagtataaatttggtacgatcaaatcccttaactgctcaaatcgcctcctgggaaacattccctattatatttggattggctgcgataaggacagatcgtccttactgttgcaccgtcttaatgcaatggcaactgaatcgccatacctggctcctgcctcatcagttcctgtgaaaagtaaaggttacgaaagagctttggagaataataagaaacatctaccttacccttcaatttattatcaaagggaggtttggagagtttattatgaggaaagtaacccacaatatgctcaattcaatgaccaatacatttatgctttcacatgggaagatcctcgtgaagatatcaagatactaaatctgaagccatctgatgttgttctggcaataacgtcagctggtgacaatttgctatcctatgcttccatcgagaagcctcctcgccgaattcatggcgtcgacttgaacccagcacagaatcacctctgtgaactcaagctagcaagtctgagatgtctaaaatacgaggaagtctggaaattatttggtcttggaaaggttgaaaacttcgaagagttattgttcagcaagctggcacctcaactatcatccaattcttttcaatactgggccaagcatggacctcaaatctttgatataaaaggtaaaggcctctatgataccggatttacaagatgggccttaagacttgccaagtatgtcttcaaaattgctggtgtatctgacaccatcgaagaacttttaacctgcaagtcaatggaagagcaaaagtttttgtgggaatccaagattaagccagctatcttcaaccccatagtcagtaagatgctagtaggaaaccctattttcttgtggaaagccttaggtgtgccacctaaccaggccaaaatgatgaattcttccattcttacctatgtggtggacacgttggatcctattgttggtcgttcgttgatatcgaaagataattacttttactatttgaccctgcgtggaagatattcacccactaattgtcctgattatctgactaaacagactttcaaaaaaatgcatgaaaaagagtctccattggacaatatcagactccacacagatactctgaatgatgttttcgaacgtttagcaagcggatctcttacggttgccatcattatggatcatatggactggttcgatcccaaaaaaaatgaagcccaatctgaagttgaacacctgaaaaagtgtctttgtaatgggggccgtgttctgttgagatcaatttcaaaagaaccatggtatattaaagtattcgaagaaaacgggttccattgccaagctgctgctgttcgtgtaaaaaggatgaccatagacagaacgaacatgtatgcttcagcatgggtgtgtactaagattccagctcgcagagttagtgatcttactatatagagtattagatttattgagaaaattgactttgaatttcgcttgaaatggaatgctcaaggtcgtctgagtgtgcaagaattgtttctatcactccaacttctttcctgggactggaaaacttttccggctcaaaatgtggatttactcctgttgctacactcgtttcaacctgtgtttgtgttgggcccgctacggtcgcatttgttgtaggtattgtgtcgttagatatctcatgttgagtttttaagtgcaagtacactgattgataagagccaaatctgccttggcattctttacaataaaactggttgtttggaagtcgcaaataatagttgtttaagatcccactaggtcttccacgacgacttttgttcttgagtaattcacctgcagcgacaagcttttgaatctcttcaaacccaagcccatcttcaatttcatgtaaactgtacattgaggaaccatcacttttagtcttcaagccttcaaactgttcaggatgattgatcttgatgtgctggtatagtatagggtaatgcttgatcaatactaacttaccatgttgttcttggcaggcatcacagcggaattcgtcgtccaccttggagtattttagttttctcctagaagaaggctttttcttagcaggctccttacgtactcgtttgcccttataattggcttgatttgtcaattgttcaaaatgtttcgccttgatatgattgtacagcattggataattgttgaagatgacatcttgctcatcatggtaacatgcatcacatctataacgggtcccaagtctcgtgtataacaaagccctctttttacctttggtggaaggcactttgggtttattgatgcctctagagggaattgagttcttggaagatgtgtagacatactcttcatcgtcgtcagcatctttctctgcttcctcctcattttcttcgtcatcaatatcatcatcatcactgtcatcatcatccctattgttaccttccacctggtcaataggtattttatcgttctccccctgttcgttttctgccatatcattattcaatccaccagaggaaactgaccccccaccttgctttccatcatcaaagggccttttatgcttgacatgaaatgacttataatgattatacatggcagtcaaatgatcataagaacggtcacatgatttgcactgatatataccgtcatccttgagtatgtaaaactctgtaggagcgtgagttgtatcaggaacagaggctaaattcttctgaggaactatcatctttgcttgctggctatctttaaaacttcttgtgatctcgtgaagcttcaaaaggttggtatctgtagcaacatgctctgatgagtcctgtggtctttgagaagcctccacatcaagagacgtttgctcgatctgattctgactgcgaagttgacttcttagctccgccacttcagtagacaactcagcaacagtttcgcacaggttcaaaaggagtgctgcataaggtggatctgcatctttggattgctcaacaaggtgcttgatagaagtttggagggaggtaagcttttgttcgtttaccatcgatccactaagtatatatgaaggaatttctgtatcaaagttgatttatataagtagttggaataggggaaaatagtatattcagatgttcactccagaggaagttgagacttgtttcgcggtatatcctagccattgctgaagatagaggcagggaaaggaattacaatcaactgactcaatgagaagcggaacaaagagaccactgaattgaaattgtatgcattcatacaatggtggtgcactcttgcttttcgaagactgctgaattgccaattgaccctcaacggaggatgttgccttaatggtttggacggtacacgaccataaactttaattacttcggagaaaaaaatgtcgtcaaatctacagctcaagcttatcacttccaccttacttttggcatgcacagagtggtcagaaattttcatcaggcagttcgtctactacaagagacgccattatttcttactcctgaaaaatggaaaggtcttcccagtgaaaagatctttcaattgtaccaagagcgagttttgtcgttgggacccaaatacaccaaggataaacatgaattagaggcacttctatcaacatccaaagatactggctttacctaccgtcagatacaaaagatttacgaaggtggagagatttcggcctacgaagtcgaacgtaaatcagtggcagacgattttaaacctcagcctttcatgtttgatgattatccatcgcaagcgcatgacctgatcgatgaacacagagaacagaggtattacaacagggtggcagcatatgagcttcctcaacttgctaagttcagacaggaattcaagaagccgtctccaactgagaaaccattgagattccgttataccacatacttgggagaatctcatcctgccgagaggaaagtggttttagaatgtcgtgtttctgacttacagttaggacccaaggaatcacacaagttcaagttgctcgctagtgtaagatacgaccacagcacaggcttgttcaaaatgtctagtgacagattccctgaacccacacagaatgcaaaatatttgactcaaatgtttaataggctattggctgaaagcaagaacctaaaggattctttcgaagatgttcctttagataccagacacacgaaggccaaactttcaaagaagcatcgcaagaaagattacaagtttccagccagctggaaccgaccagaagatgcaccgaaaccctctatggatgtcttcagagagatttatcaacagcaaaaggtttgaaactccttatgacggtaaactgtaaactgtaaatagcttaatcaatcaatacatgcaaaggcatcagatgaactttcgtgtgtagaccaatatctcggaacatctgtttcttcgcgttctgtatgtttcaatcagacctcttctccattgcaatactaggggccatagaatttgttagggaaccataataaaatggctgctaggtctagtactcgtcgaggaggccagcctcctggagttgctaagagtcttgggtcgaataaaagttcccctgtgaagaaaggactgggcgctggcaagggtaaacctaaggttgattaccccaaacagaacccttcatccactcttcatgatatcctgagcgagttaaatttatcctatgattctaatttgggtctgcttcaaggagatggtattgcttttccaccatcggtttccgtgttgaacaacgtcaaaggtttgtttgaacagttgattgaagagttgcaatatgtcagtaattacgatgacaatctcctcaagataattgataacaagctcaaagaaattgagcataagccttcaaccggagaggtgaaagaggaagagattgatggtactgagagtgaacagcctgctagaaaaaggcagaaagttcaaagtaccgataggattgaaatcccagacaccaaaccacaagggttgccattgaaggaaagcagtagtcaaaaagtggactcgaaaacatcggtaaaagatgaagccaaagaagatgaaattggcgatgacaacgatgatgatgatgaagatgatgcaatggaagaagatgaagctggtgacgatgatgaggatgaggaagaagctgaaatagaaggtgaggcagggattggaggggaacctggggctgaggcggcagtagaggctgacgatgatgaagaggatgaagaagttgaagaagaagaggctgcatctgaagctaaaccagttgtcaaagaaggattcgaacaagaaggccattatactcgtgagaacgataccagagtcaaaaatcccaaatcagaatttgttacatcccagacgttaccagtggcagcggtggaactgggactctacgatgaaaatggactggaacaaactggtgaagactactataagaggaaatatggagtcgcttcttatccaacgagcgatttgaaagagttcctgcctggagagcttccagatgaagattttacgaaaagcaaaccaccatcccaagtacaattcagcacctttcaaagctatttggaaccatatttccgcccttttacggaggaagatatcaagttccttaaaaaacagtataacttgccccaaaatcttccgaaaaactacgatccaaatgtgactccatttgtaatacctaaatttggtgctcactacagagatacatggtatgaggaggatatcaacacaggaatgattaagaaaaaacccaatgacgtagacccccgtctggctgaccaaaaaatgcgccaagatgctctgataccaaaggggagcggtgcttctttaactgatgatgtcttggagactgaaaaggtatcgtgtggtcctttagcatctcgactgctttccgctttactaaaaaatggtgacgatactgaggatggtgaaccagtggacaatgatgacaacaataacgtttcaagcgctattggaaatgaaggatggacgccctctgtggagacatccgattacgagactttagatcaaagattgaggcgagagctgaagtatattggtgtgtttatgaacgtggaacaaactttgaagcgtgaaggacacgctgatgaattagttaactctgttggagtaactagcggaaatggagaatttgaagaagactggctaaacagtagagaagacgatgaaatctcagctgaaatgagatctttgcaacgagagttacgaaggcttaccagaaaaaatgttcgaaggaaggaaaagttgattcctatagtcgaggaacaactagcatggcaggagtaccagtccattttggaggacctagataaacaagttgatcaggcatatctaaggcgtattcgtgttccccgcaagaacaagcgcaagaatgaaagccagtcttctggccaacaaactcaacagcagcagcagcagcaacaacaacagcagcagcaagatcaacaacaaacaggattcaaagctcttttggataagcgcacgcggtggattgaaaaaattgggcctctcttcaagcctccacatttaatgagacgaccaccatctgagagcgttttcaaagatgtggacttagaaaatgatgatgaagaactagaagaagacgatgagatgaaggttgacatagatctgcgatgaacaggttccagtgaagctgattattgtgtaatatatactacaaaatatacttttaatgtgtctaatgattaaccccttctcgaaaattcagcttatcatctctcgcacttgatgcttaaactataaggatatggtcaccagagatatatttcaggacttttatttcacaggatataacaggttgagaactagggagaacgctaatagtgaaactcgtcagacaatgctcaccctggagctgtttgcgtttggaaggttagagcattaccacgaacatcaagagcaattgttatcgctgaccccaagagaacttgctaagcttaaacaactaacattgttggattatgctgctgacaaggtgtcaataggatatgacgaattgaaacctttgcttggttttaactgtaacgttgagttggagcactttctgtacctgataaatgagactttaattcatttgaaggtagacgcactatctcaggtagtggagattgaaacgttagccccacgagaagtgctggtagagggcgacaacaccgtaccactagagttattttctaaagagaatgttaatacctcaagaggtttgattaagaaactcgatttattcaagaaagaccggatcttgaaagtgaatgaatctttacaaagacaactaaaggaagttgaccagtacaggaccaaatcagcgtcataatttccattttctgcattagtagcactaataataaatataaatatagaagtctgtgagaggaagaaatactcttctaagctttccatagtctcttgataataccaaccaaaccatccttctccttcttctcaatctggtagattccgtaacctgcaaatgcagttcctaatcctaggagatacatggcatagtggtggaacttaccgtacactcgcagaggaatataatcaatgatacaagactggaaaccagcataacagtgtatcagtaaagatccagccaaaagagagtccaagacaggagtagacactccagtgacaaatggtgtaacaactaaaggaaccaatccaacggcgatgaccttctcagtgacccagtgataggagccatgagttttatgtggcttcggagggacgtaagcatcgttgacagtaccgacaatgtatccaggaggctgtgggatagtctggattgccctggagctaattctcagtggcttaatcaaacttctgactccgactcttgacatcattggtgttagtagggataccgaagaaattgaatgtaatatggggaggaagtattcacgggataacggagaagatcggggattacgtaacagtaatttgattggttaaaggagatcagaggatggttccgaatgtcagcgaatatgtgacagacttcacactataattttctagctaatattattcaggttgttggatgtcgagagacagagaggtggtactttcggaagactcttaataaattaaactgaagtataatttaatgtatacatatttttcttcaaaggacaaatctgaacttatctctatgagcatcagcttcttcttctgctgtattctttagtccaaatccgacatagacaactcccctatcgaaagactctggagaatcatcagctttagtgtttattggttccactttcccatacaacttatcagccttacggttcttgtagaagtaatagctaaaggtggctatcaataccaagatcgaaaatacatcgacgataatcaacgccaaaaaccctttcttgtacaatggtttatcgttatctctgagaatctgtcctccacatactcctccaatattggccgccataatcagcatcgccagtgcaacacttctttctcttggactacggatgttcatactaagccaagcactgttaagaacatgtccaacaatatttacggtcactaagaaacacaatgccgtgaatcgttgggtcggagtggctgtgtctggtagctctctaacagcaatctgggaactaagcttccaaacaaaggcgaacaaaatcgaagctgctcttggtttgaagtacttactggtaagggtaagaattaacaaaagcgccattgtacaccatctgggaatagaagatctggcattagcttcaaaaacactaaatcccatagatctaatgatcagaggaatatagctgcccagggcagtacccgtttgcaaactggacatggagatcaaaacgtgaaaccagggaactggattcctgaaagtgctccatacatcttttaggttggttcttctagttgacacaacctttgaaggatcatcaaagatgactcttcggcgcagaatggacctttcccgggcatcaaaatacaaccattttctgttccaaaaagcagcagggtgttctgtcgattcagggagaaggaaaaagaagataatggcgtatccgacaccgattacaccctctattaagaagatccactgccatccgtaaagaccaccaacacctggcagatctctcaaaataccagcagctatcaatccactgacagaaagagcagtaaggttaccaaaaaagtaaagtgtgtgtcgcagtccaagttcagacttcttgtaccaagtactaatgtagtacaatcctccagggataaatccagcctctgcggcaccgagaagaaatcttgtagcgtaaaatgagtggatgttagttattttacattgaagcgttgcaatgagactccaagtaagaatctgaaaacttaaaaaaattgaaggactcaatctttgcaaggcaacgttgaaaggaatttcaaaggaaacgataccaatcgcaaacaatgcactggcaatatttatttttgtgttgttcagttccaacatgttgtaaaagttgatatcagtgtagacattactgatgttacctctgtctatctgaagaatgaaaaaggcccaaaaaagaaggggaatcaaaataaagtccaccctacgaacaagccttcgctcttcttcatcagtccagtcttttacgatcactgttttctcacctgtctcactattgatgatggtaacagttgggtattgcaactctgagccactcaaagaatgcacggtctcggcaactttttctgaactgttaatagaactgattttctcggcaagcctgtctgaattgcttagagagttgggagtctcggcaaacctatctgaactgtcaaacgaacgagcagtctcactgggagtctcatcccttcctgagttgttcaaaaccatatgaactgtatactttaaactgatatgaaaaattcgtcccaaatgctggtactttataatcagtcgaaatcgtggccaactgaccatcttcatctatcagcatacttaattcacaattcaatgccaagagacatcataatagaacgacatatcggagcgttagtgaaccatggggtgagcctttcgggttttggtttgtgtaagtaaacatgaaatatgtaagaggctaagcttggtaattcttaactgtggatccagccgttattcgcagatgacataataatattgtgcgtttcttctttattgttttcgaatctaaaccgttttagtctcagatctcactaaccaaactaaacctggatcaactcttactcctgaaagttcttccatcgcagagactaaggaagtacaattgctaggtccgtagagttcatcgtgtgagtcgctctggaattttctcataacagtctgagtaggaaatcatgagaggactgacatagtctaagaaagtgtggtgccagccacactttcgcagtcgcagtattcgtcttacaaaatgaaggacggagaaataaatgagtctctctatgcagggacagcatatgtagccaaaccccgttgtgcaatataataccttctatagacgaaactagtaattagcgtgtaagatctcactccttgagtgcttgttttcgttcgttatggcgttagagttgtggatacttgcaaacaattacccgattctcctattcaaatcaaaaaggcaattttccttatcgaaaggccgataaaccttaccgtacgattgttccatagatcaccgccacacctagtcagagcgtgagcaaggcattttatcttctcttcaatcctggtaccgagatgacaaaaaaaagattgcagcacctgagtttcgcgtatggtctcccactacactactcggtcaggctcttagcagcttaactacggttgatcggacgggaaacggtgctttctgctagatatggccgcaaccgaaagcctataaattatctgagtgtactgttttatttaaaatttctggtttatggaatacttccaatataggattgaactcgaggtgaagctttacatggtaaagcatagtgtagcctaccttgttagaggtttttcgcatcaccgtatatctctgtaaaataatgagcttgccgggagtctatttgatcgctatagaatcaacacctatgacaaatgaactcacattgattttcgttcgttcatacttgatgttcaattacatctagccacaactaacatgtcagctaaagatgataatcactatttaagctaccatagtgtaatgaataagacgatatagcacaatacttgaatctaaataccattgcaaagaaaaatggccagagactagtttgcgggaaacgaaatctattaaaagtccaaaagtagctatagttaataggatagcattgcgaatccaatagctacgacaattcaataaaaagtccgcaatctacctttaagtcaacaaagttgaatcttttactcctggtgatatagacggccattgtatctgattttatcatgaaatactccggtaaacgtaatacacatgaagtcacctagtgatgcaatggtgcaggcccctttttggaattctctttactttctgtaatactacaagtctccagtcagaggcttcgacaagtgataatggtctgtttcagaaaatagacaattcttctcggaattgattgaaccataagatcattttgacggctcaatttttggcatcacatgccaatttatttgtgggaaaggaagacatagtcgaacaagacacataggtatagaagaatcaaatctgccataaggcggagagctcatttaacattagatatgcttaaagttttccatgtatgatgcactagttactctggacaacttgggacggtggatgatagtcaatccttcgatcaacaataaggatgctgctaaatcaatatcaatctctgtcagtttcccactaacaggttttcctcgacatttggatctccgggtgatgagcagaagagatgctgggtcagcatttcaaatacgaacaaattcgaagctaacttcgaaaaacgatttcttgcggtaagttgaacgtagtcaactcgctataatgactttctgttgaatgacatctgacgactccaccatctgcagcttaaagccacgatttccgcaaaagagcagcctataacatgtaatttagaaaacaggaaatcgtgcatactctgggatctttatgtataggatcaatcgctgaattgtaaaagaatagggaccctggctctcgtagataaataaaaacagcgagaacacgatccagtttctatccactgaaactggatcttttcaagcaagaaacaaaagacttcactactagccaactaaagagttactcacccatataggtccgttcgcttccccaaattgttatattgaaacgtttcgagattttccatctactaaatcatgaatctcgtatggcacagcattaatcttcctcccaatgaaatatacctagataagctgctaaggtgtggccaggcattccgttgggtcaagaataacaatatatggtcgtcaactctcaataaccgcgtcgtgtttcttcgtcaaacggaagatcaactggaatacgcgtcgttgacttcatctcaaaaaaattcctcaaacatcaaaaagttacaaccaaaattagaagaagacactcaagacgacgttctgggtctcatctcaaattacctcaacctgcaaatcagcatcgttcagttgtacaaagattgggcgtccaaggatgctcacttcgccaaggtgtcggccgcgtttgcaggaatcaggatgctacaacaagatccttgggaaacactgatctcgtttatatgctctagcaacaataatgtgaagagaatatcaaagatgtgtcatgctctttgtctagagtatggtgattttatcgtggagtatgcaggaaccaaatattattcttttccaacccctgtccaacttgcatctcgagcctcagaagcgtcacttcgagaactagggtttggctatcgggcacgttacgtctacgagacagcccagatgttagcagatgacaaggcactcttcatgcaacttcacagcatgcgcagcagtagcttcactgatgagcaggtgcacgagtttttactccagtttaagggagttggtcctaaagtggccgattgcgttgctctaatgtcgctgaatagacattcgctcgtgcctattgatacgcatgttctgcagtttgcacgaagagattactcctataaattccgtggtagatcgaatgctaccctctcttcggccatgtacgttgatatgaaaagatttttcgttgacaaatggggcagctacgccgggtgggcccactcagttcttttcacccgggatttaaagttagaatagatagcaaaacagacaagttctttttccttacttttactccatcttgcatctaccttagaacgataaactcggccagccgactttagaaaaataagctgattcctgttatctgggaaatatcctttttcaacctgttcgcgcagaaaaccggcagtctccgtgaggaaccttgattcgggcacagataagctgcgagattacatcgaactctattgttcattctttgctattttttactataaaagccacgccaacccacttgacattagttgaatcaaacttgtcaaagattactttctacaacatattctctaaagtttttacctccaacagcaacatgtcgtatctatcagattctacctacggtaaggacaacgtcaaattcctcaaggtcaagaaggatccacgcaacccaaagatccatgaggtcatggaagcaaccgttcgtgtccttctaactggtgcctttgacgagtcttacaccgaggctgacaactcatccatcgttcctactgatacagtcaagaacaccatcttggtcgaggccaagaagttcgatatctggccaatcgaaaactttgccgcacatttggccaagcactttattaacaagtacagctgggtttccgctgtcgacgtgtccatccaccagcaccgttggactcgtatctcacgtgagaacggagcctctaagacttacgaccactctttcctgaaggatggagatgagctacgtttgtcaactttgcagtactctcgaaacggcactttcaagctctcatccggagtcaaggatctcactgttttgaagagcactggatctatgttctacggatataacgaatgtgactacaccaccttaaagccaactaaggatagaattttgtctactgatgtggatgccacctgggtttgggactccaagaaacttggaagcatcaacaacatcaacactctcgcaaagcacggagtgttcgatgatgccttcgaagctgccaggaaagttaccttagaccttttcgccacagagaactctccatcggtacagaacactatgtacaagatggcacagaagattttagacttagtgcccgaccttgagaacgtcacctactctttgcctaacaaacattacttcttgtttgacttttcattccagggtttggagaacgacaacgagctattctacccatccccacatcccaacggattaatcaaatgcactgttgctcgtacacctaaatccaagctctagtagttagattccacacagattagtataatattgaaaactgttcataatattcacatgtaggttgaattatataaacgatcttactatacagtaaatcgagctttgatgcatccaaacacctctatgaatactggatcttcgccatctttgtacggtgagaaacggataatccccagcacctagagacaatgctacgactaggattacgagctactttgcgaccagttcgttcttccgtaaccccattgaggctcgcaaattctgtgagattgcaaagctcttcggctgctaagaaacccaccggaataaagaaactttttcaggagtatggctactcggctttgggtgtttaccttggactcacagctctagatctgccgttgtgctttttggcggttcactccctagggcaagaaaaagttggagagctacagaataaggtaaagaaatttttcgggtttagtcccaaagaggttgaagccactgataaagaggaagattactggagtatcatactaacagaatttttcattgcttatggaatccacaaatcactgatctttatacgagtaccactgaccgcagccataaccccagccttagttaagaaactgagatcccttggattcaatgtcgggaagacaaaactaactacgattgcttccgcaacgaaggaatccgtttcccaacatgggctcaagcatacgatgagtactaaaggagcatctgaagtcgtcagcaaggccaatcaagtaaaacctatcgattacacggcatctgatccgaaattcggaaaatcacctaataagcgtcaaaaatggtggaactttttcttctagagtgaaaggtttaaacttctgtatatacatgtaaacttttagcgttgccatcacccccattcgaaccctctcatctaaactgagagtaaaatttctcttctgcaaaacgtttttcgaccaactgtataacctctggagggtatactgattccaacttttccccgcctttcagcactcgttgttcatgcaatttctgttcctctttggtcatgactacaatattctgaagagacagcttctttgccgggtcccattgtgatagagtcaatcttgtagagtaattactgataggtgactttccccggaaaatctcttcaacaatgtagatgatgtcagtgttgggtatgggtatcctttgctcagtgtttccgagcctggattgttgaccggccaacgactgtatgataccgtcaacttttgttcgactctttcctactataggctccatggggtagtcggctatgtcacatagaatataggtagccaaggctagtccaaacatggccggcatggttcccaaaacggggagaatacgcaccctaaaattctgcaaagcactcaattcaccaactttacctttctcgtactcttcatccggcaaaggcagcagggaagccttgccaggagctggtttttcacttgaaaacacaacaggtattttcttcagaattcctctctttttaagccttcttcttaccgaacgggctaaggagtcttcttcagtacatgaaatatctcccacgttgattctggtggggtcgctcttgcaggctgctcccatggaagacacgactttgagatttctttcacagcagaaagaaagaaggtctactttggtgtcgatattatctatgcagtcgacaatgtagtcaggggttccttccagaagtaactgctgggcattgttaatatcgaacaactcattatgagtttcaacggtgacccaaggagcaattctaagtatatgcttttttaaacattcaactttgggggtaccaacatcctccaactgagctacagcatgtctgttcagtgaagacaaagaaacctggtcaaaatcaacaattctaatatgtgatattcctgatcgaatgagagatatgatacagttggaaccaactcctccgcaacctacaatcacaacgaaagtattccttattttgtccaatccttcttcaccaaggaagctgtagtttctggcgagctgttctctaatcaggctttcgtcatactttctgggctttctaattgaagttttagtaggaggggtggtaacttcaaattttttgtggtaccaatccaacagaaaggcagttgccaacgccgatagaactgagcatgtcaggattttgctagacattatacattagagagtgtgcctctagttagtgcctggtacttaatggagttgaagattttgtaagtttcagaattttttttctcttcccattgccacaacaaaggaaaagtcgcggaacatctgtcatttacttaattatctataactttaggttctgggaagcacgggccttcaatttagcaggcccatgagggaactccactatcacggatcccaccaaacaaaccaataccaacaatatacatactgtaccaaaaatcgctcccatcactctgaatgctggcaatccaaaggaatgatacacttgtgtgcaaccaaccgaaagggtaccaatggggaaagtcatcgtccaccatgctcgtgaaaatggaatagggtagtagaatatacatgtcgctgtggagattgctaagatgaaaaatccaaacgaaagaagtattaaggaccaaaagaaacactcccaatggataacaacacggaccaaatcgtgattaagtaagttttctgtttcaccaaagaaattggacatattataagactggttggctatgccccacgctccttgtcccataaggcctatcggggcaaaagtagcgaaggtagcagctttgggagggagctttagcagtagcagtctaccaaagaagacataaatgaatccgaaccctaggcaaatggaatttgcccatagcaagaatgaaactatgctggtagtcatttgaagacttctgtggtcattcatgtctcgagcgaccagggctccgcaagctgcacacactgtcagtggtagaaccggcagaatcaatgaaaagttaacctgtggagggccgatcttggattttgaaaaaaggatgaacactagaaaccaaccacaaaagatggcaagaatgacatttatccaccagaacacaaactgtcctaccacaaactttccgtctgctagataatggatcatgttagtcagggtagaccaacccattgagtaaggccccaagaaaacactaaacgctggatcttgaatgaggtctttgcgaaatactggaaacttgtacagcttcaacgcggtgaaactagttaccaatataaataaaaggagcgagataccccacattatcagcccaaggacttccaaccatcttgcagggtaggggaatttgtacagtatcccggcacatattccagtggacatgaacgctatgttccatattggatggtattctttgatgtagtgctcccagaaaatattatgtccctggtgactcagaatgctgtgttcgtctgaaggggtgactaatgttaccgattgtgcttctaaatcttgaggagtgctggaattgggatctccatctgtgttttctctgggtaaatcattactagcaggcatcctgtttgctatcgattggtgtaaaaactgattccaccttcaataagagagcatgacgaagtgcccatcttatgctcatcctgccgtcatggtttttctgtaatgggaataaataggcgcgacaatgcctgcgatgatggccacggaaatggcagtgatgtggagaaaagggcttcaaatgaggagtccggtgcaacaaatatgagaactgaatctaccactttcttttgacaatagtcagtagtcaagtaagttcgaaagccgtcaactgagcctttgtaaagacgattaagatacttacaattgatggaacgagtccattgcgcggaaagttggtagtaataccactagatcaaggtgatccgtattagagctactgtccaaggcttgaagcttattttgttactgatatcacttcattacagaccacttaaagtccaatcattacgctgacagttacctcagcgtaggtgagacagagggcgcgaatgtccatcaacattcgccaactgtgttcaaccagaaaaaaaacttcatacaaatcaccaacagctagatgtatctgtccgtaagacagttttcctcccagaagccttgcagacagttgtctcaagaacttctcaacaagtttgaggagtatattgtttatcaaaaaaccccaaagaagctcaaaacaatgatatacagacccaccaattcacaacaattaattgcagcagacttgattgattctacggggaagccattggctccgcaaacatataaaggcccgcctcgtcaaaatgatcttgtcaaactgatcaaccagtgtgaatcttatgatgagtttctcaaggtccgccagctcatttttgatgttactagaaattccaagaagaagccttcagttttgacatccaagccattgactccgtttttgatcaaagcggctcaactaaaccgcctccctcattcgttgactactttgtggacgcttccgactgaatggtattctcagtttgatccctcgattgcatcaactgtagtgatgttggagtacctcaaagttgcagaacgaggtactacggaccaacatcttgaccatgcatcgttggataaacgtttacagaagtccgaaaagatactccgggataagtttcaagatgctatagcggagcaagttcagcaggatcctctaaccaatttgttaaaactgagctgccatatcaaagcggaggagatcaacaacttcaactcggtggtgcaacttgaaccctatttagaactccatttggctaaaggagccgccataaaactcccagatgtgtctcgttttgccttgaagtccgttgcccaaggctccaagttcaagatctacgcgcaatacaaatacgactactgcaagatccagatcgttaatgcttccctgaacaacttgcaggcccacatctcaaatcctgccattgcagaaatcatccacaagctaactcctttcttggatactatggaaacgattggtgagtcaattggatattccaatctcttggttgagtttgagaacaccatgcaattccctaagcatatccccccaccatcgtctgagtgatttatagtgacttcttgtatataccatagaggtggtcctaaagaaggagatccaacaccccccttagcctaacatgtacatcttttccacttccttcttccatttggctgatagaacttcgcgattgtagaacctatattttttttttccatcgcttttcttctagtacggaatttctcatctacagccaaacatgagtgaagggaccaagcccgaaactagtcaacttaccaataaggagctcaaagagcttaagaagaaggagaaggctgcaaagagagcggccaaaaaagaatccattggaatcaaacctgatgccccacaacgccgtggtggtgatagacccaaaactgcttctaacatcaagaaacaaattaaccagtccaagacccaatcagagaccttgaagatccctccattatttggtcatttagaaacgagagaacagagaattagcagtaccccaccgcaattggctaatattgtacacccctctattctcactctttgtttaaagtacagtacgttcaagatcgtgggatctacgcataggtgccaagcaatgctagaagctttcaaggatgtgattgaatcttacaaaaccccagagggtacttccttgtccagacatttaactggccacctgtctcatcaaattgagtacttgaagagtgctcgtcccctaagtacttctatgggaaatactatccgctggttgaaacaggaaattagtttgatttcgattgacgagactgatgaacaggcccaactgattttgaccgaaaaaatcgatgtttatattaaggaaaagattgagtatgctaacatcgccatcacagacagcactatccagcatattgtggatggaagcacagtcttaacatttggacactcacaggttcttttgcatatattcaagcatgttgctacggagttaaaccgcaagttcaagttggtcatcgttgattccagacctttatttgagggaaagaaacttgccacagaattaagcggatatccaaacatatcatgccaatacattttcataaattctctctcatcaatccttcaagaacctgttgatgtggtactgctgggagcgcatgccatgctttcgaatggaagactttattccagggtgggtactgctcttattgctatgagtgctcacaagagagacatacctgtattggtttgctgtcaaagtatcaagttcagtgacaaagtgcaattggattctgtgaccatgaacgaactctctgaaggtcaagatcttttaaccatgggatcgaaaccaacaaaaagaaatggttttgcattggagcagtttctgaaggaaaaaagaacgcaaaaagaagaagaatccaaaggaaaaaagaattccaacaacaacaacaacagtaatagtaacggtgtctcgttgacaaagcctgaagatcctttggcaaactacagagaaatagacaatgtcaccatattgaatatcatgtatgatctgactcctccagaatacattcaaaaagtcatcactgaagtaggttctttgcccccgtcctcagttccagtaattttaagagaatacaaaggtaacagcagtaacagttagagaagcaaatatatatgtctataattcagcgcttgccatctacttttatttaaaaacatttgatactttcttcaatctacttcttgactttaaaagtaccttcctattgttatctctactgttcctttactaattacctaccctgtccgtttccatcggcagaactaacgttctggtccaaagatgctttcctttcttctgccaacttttcaagttgctcccacttggctgctcgctgagcatcttgtttcttacgctcgtgggattgttcctcgtacaaggttgcacatttctgatataactcagggttaagttccatgaaaaagtttatggcaccgagggccaaggcagtaatggtgttgttccaatttcctcctgaaacatcgctctgctgattttggaactgggaaatcaattgctggtgttgaaggttcacatatgaattgctctcatgttcataatgactatccagtagttcatcgccgtctgcgtcgtcccccacctctactgtattggtggtgggagtagagttagcagtggcctgatcctggggaatgttctgcgagataatctcatacagggaagggtacagaatgctcaggatgttttcattgtcttctgcaattagtcctaagaatctgtctgaattccaaaagcatagtgctttctcactgacttggaaatgtggggatgagatacactttgccaattgggcaaataggggagtatcaatctttaggaattcggatggtttcattatctccaaaatgtcctcaatctcattgagaaacataacttcctttggagaattgactttgggccaatacttaagaaggccattcacaacatcctccgtgagcttctcatctttttcaataaattgaacaacgcaatatgctaactgtggatgatatagggaaagtgatcgtgccttatgcaaaggaatcaagattcgacataaaaaattcttgtgttcctctttaagtggaagagcaaatccgttgataattgagcctaatatttcaagtagttcaggaataccgttgaatcgcccagtctcatagatgaattggagaaagatattgttgatagaacggcgaataaaagctcgcaatgataaaaacttaccataaattcgatggagtacagttttcaggcagtctctttcttttggatcttcactgtcgaacaattccaacattgtgagaacaaatttatgatcaatgaactgtttggcaatggtgtggttgaagtcgggagactggacaaaagtgaggaaaaaatcatagaccgcctgcatgtgaggccacgacaattcaaagacgggttcatcttcatccggatcataaatgtctccgatgggatttacaggtggaggaataggtcggaaaatattggtcttgaacattgtaaccacatgctggtatatttcttcagtgtaagtaaactcgttagatgcaatgaaattggtcaactcttgcaacgtcatggttttcagttccttgttcgtaagttcagatgatggatcactaaagtcgaacatgacgttacattggtcgactttttcaatgaaaagatccaaccgttcttcaacggggacctcatgaaaggttggaagccgtttaaattccacagtgccacttgatggctcaaatcgggaagagttatgcctctttggagtctttattaaatcaatgtctgtgtggtgctgtggtgatggatagttctcaaaagagtgcaaactgtgaggcacctctagtggatcagtaatgggcgcatgtatatcaacttggacgccattcacgtttgaattgctactgggagggtcagtctgctgttgacttatggatacagcaataggagtctgaaccttcggagtgagcaatgtgggagtcgtaggagtcttccgtttatccttttccttttccttatccctggaattcttctctgagtttgtaggcttcttgtctttgctactggatgaagatgcacctcccgaactaactgaagcatccttctttttgctatttgagctagtagactttgctcttgttagtttcttgaagcttttcatcattttggatgtacaaatggtttagtagccactagtatattgatgacgctgtgttggactgttgcaattggaacggtgacgaaaacaggaacacttgtttgatattctggctgtgtgtattttggtgtcgggagagaatcaggatttgatgggtgaacgacgacgtcagtgggcagaggcgctgggtgggaggaatcaggaatagtggtggacggaaaaacgaggggggcactaatcctagcgagcagagtaatagggaacgagagaaaatggtgaaaaatcacttgcaggagtgatcggttttttccgcagattatttgaactcctcacttgacggcttacataagtataattgaatataggtcaatcaattatggagtatggtcgattaaacagacacgagtaatgaatgtgtgatgcaaaaatgtctagctttgtctaagtgtaccgtcctctatgacaggcatatcctctaaaaccccactgttcttggcagagagataacagttccaaatgatgctgatgacattaacagccagcaagcgatgctgaacaggaaaaacataaaagtttgccaattgaaacaggggccaaactttccaatttgcaaaaagggtatccatgtatttttcatcaagtttctgtttccattgctggatggtaaggccctccatcattgccatacaagagtagtataacgggattcccaccggggcccagaccagttgatctaccgctacacgagcaattgtatcgcttaccttctgagacttttcagatttgaacagcctgactggcatcctgataccgtttagaagtttgtaccaacggtctccaatgggcgcaaagatgataccgccataaacaacagctctaagtgtccttttatagtcaaaattagacactccatcagagtacaaagtctgagccaatacatctccggttccaaaaagaaagcctgtggtgaggccgttggtgatgatcggatttctctgcaaaaaattgttgtacactagcaacatgacaaggtttccttaaactgagttttttctttcctttatgaactatctcttttgtagaataagtctgaaacggacgtcactttcttgaatggattttagtgagttagattattacgtcaacaaaagaaaactgaaaactgcttttctgattagattgcgatcggacattgagaatcttcaccaagcaagcgatctgatccgtttgctttttctgataacagttccgcgaagttttactcttcccattatttcgtgttccccggatactcattttcacatgtctccctctatcgcaaaacgcatattccagtcatggaccatcacaagaattacttaaatacatgtgtttccacgtttcctgtcttctttcctaactgtaagcactgaataaaatccggctcgaagatgaaaccaagacgcctattaaagcattatagaaaccacagggacttgatcctcaggtcctcatatgtgattgtcctagctttatcggtggtagaaggtggcggaggcgacggaaagaaaaagacaaaaaaaacatcttcagcagccactccaaagctcagttggaaaaaatatcttcaattcatcagtgatacaatatgcatagacaggaaaacgcccatcctgttgggatcccaagttcttttgcttattatcagggcagtcatttccctcaagattgcatccctggacggaaaactggttgcaaacttggtatcgtccaaattcaataagtttttgaaactgttggtgttgtggatggtaattggaattccagcttcatttataaattcttctttgaatttccttcaacattatatcaagctgattatcagaaacaatcttaccaataagctcatcaacaaatatcttccggtttccggagataataccactatttataagctcatgaattctgcacaaattcacgatcctaatcaacgagtgaccacgaacattgaacagctctctgattcattggccaaaatattccctcagctactaaagccctcactggacgtcttgttatgcgcttatcagctatcgaaaacagcccccaacagcaatacagccgagggagtgcttatcctaggactcgtggtgcattttaccacgattttgttgaagaaattccagcccaactttactcggctttctatccagtcaaatgatctggagaacaactttcacatttaccattccaaagtgatagagaataacgagcagttggccctatcaaaatcctacaacttggaattgaacgtattggataaagcgttctttgaactggcccttttcaagcgacttgaatttaggagatttgctgtttacgacacgatgatgacattcatcgttaaatacacttggggtgctgcaggtcttttgctttgttctctgcctatatttgtccaatcccaattcaaagagatcaatgaccacctaatcaacgaattcacatcatcctttatcactaacagaagactgttgttaacaggaagtgattctttaggtaagatcattcagtcaaaaaagaaccttcaaaacttgcgtggctacgtcatgaaaaccttggaatttgaagaggagctgaacgaaatcaatgcatcccaaaccgttgtgaagtcagaaaatataacttataatgacaccgaggaaattatctttgataacgtccctcttgtcactccgtcaggtcaaacacttgtccagaaccttagtttccatatcaaaaaaggggatcaccttttgataattggccctaatggcgctggaaagtcttctttttttagaatccttggtggattgtggcctgttgttccacctggaaaacttggcatccccaatgaggatcctgtcagaaagaatttcttttatcttcctcagaaaccatattttaccattggaaccttgaaagaacagattgtgtatcctgattctgttgaaggctgcgaggtaacagatgaagaactatacaagctgcttgagcttactaaattggagtaccttgcaacagattgcgaagaattactacaacatgacatcgatacgttgactgcagatcacggtaaacctgatgaactgaggcagctacccatgtcaccatttgattatgtacggaactggtctgatcttctttccataggggagcagcaaagactggcattgtgccgattgtattatcaaagacctaagtttgctattctggacgagtgcacttcgtctatttcggcagatttggaacaagattgttacaaatatgccattgaagaacttggcataacagtactctcggtgtgccatagaaccactttgtggaaatttcactctcatttgttgcagttcaaggtgaaggataacattactactaccagcttccacaaattcagtccggaggaaagattattgaaacatgaagaattggttctattggacagtaaattggccgagaagcaggaattagagcaaagattgaagtttcttgaacagtcaacaaaatccagaccgagaaacagaagtatcctttacatcagtgatgatgaagatgaagaaatagattgaaaggaaggtaggaggattcctttattcagtaactatgcttgtgggaagagggtttccgtctttatccgtccagggaaacaagatggttccaaaccaaaaatgctgcaccactggatgctttcctaggacttcgccgaaatacatcttgatcataccctgattgatttttaaccaagttttcacgttagaaatatcgtaaagtaacggcgagtgttcgttgaaaggtcccttctttatctttttaataaatgaaatagagttaaaaaacatattgttcagacagcatctttttacagtggagttgtttaaaatactggatggctttattgtggtcagttgtttattttgtaacgtatcaacgaattgggaagatcctaaaatgtaaggaaggtggaaatggtcatccagaccccaaaccccatgagaacctgctggctctagtttgtatgttaagatcaatgttcttatgagatccaagtattttgcaaatagtataagaatctctgttccgttgagatctataggcccagaaagacacatcacagatgaaatgaaaagagcaagaaaagacagctcatggcctgttccgtaatctattcgtgccctagaaccgaatgcatttatcagatagtagaccgcttcagttttgtagctatcaaaattgccgattgccactatgttcgttaaatgtatgtcaagtagtctttccgcgtcgttcaccagatcatcaaaccattctctaaacacaagattaccatatctggaatgattttccacgggaggatgtagttcgatcttactcctgatctcttcaagtatcttcaagaaagcaatcaccaatttgttagcgacgtacttctcaactatctggtcggttgtatacaatgcattctgaaattgattctcatgtgtctggtcatcttgataattaactaagtggtattctaacaccccaggaggaacttgttttccggaacacaattgacagagtttgaataaaccaatgcttatacgctcaaaagctacagatttttgaaaaacttgaatgtctggttcgatgtttattttctttgttggcgctgttgcagatcgcttgaaatctattcttgggaactcattcatattattcgtctcccttataagcagcggtactatatctaggataggacaaaagcgcttagataatcatacagaagccatatctataaatttttcagattacataatccagggtaagagtgccaccatcgctagggtgatccagttgtttgatgagcctactaagacagcagctccttcacttgatgaagaatacaatccggaagaagcagagctcaatgtggttgctagagtatcctcttcaaggtcgaaaatccaactctgctgcactgatgcctcaatctgagaagaaaagtcagtgtaattagaaagaaagacagtaatggttccatcgcttccaaatacgacacctccactttgagtctcttcaggtgttctgagcatgtagccgttcaaagttagcccagtttggacttcgtctgttccttgaaagtcatgaatcgtagagacaaatttgttagaatcggtcgagttcataacttcaaaaatgtcaaactctccacaaccactagcccaacaagaacatgaagtattagttggatattgagaagtcctagcaatgcgggcatttagaagccatatagctggcatattgtaatacagcacgtcatcttctgagtacttagactcttctggggtttcaaactcaaacaggaacatcttggttgttcctgagaagccgtggaaagcgggaataccatgcctgtatacaccgcaatctttactccatcctgagctttcacaagttacgttggagtagatgataatctcttcatctgagtataactcgttatctgcctcgagaacttcagaagaactagcactcgaaattccatcagttccaacataatctagtgcttggcccaggcaggttgaattctcgccaacgtttcccataaaggtgacgttctctgctgcctgagtttcggaattgtagtatgctagcctctcccaggtagcatcgttattggtttcattctcagataaatagtaagcaaactgtttcaagcgcagtggtcccctcaagtggactgaaagctcctcgtctaatggagagtttgggccttcaaaactgaagggagattcagtattcagtttgcactcacacttgtccacgtttatactttctacgttgtagtaagttccttcatatccaacgttgttgaatgttaatgccccatattctcctgcttcctcttcagttgacctggccacccttgacaaaaacgatgtaccagttctagctctgcgttcaccggtgagggcgagtgcttcagtagtgaacaatagtaaggttagacttaataagttcatatgtgtaagaaagaaagtaagttttttttttcatttttcagggtttagacattacttatgtttaggacatggtgacggggctgaggtgagatcatgtcacgagaggaatttcaggaatttcacacaagatgcagccttaaagcacgaccaaaatcaagacgatttctgaaaattttacgataagatgtcatggaattatggtcgctcttaacctacgccgtttcaccccgcgttggagaagaaataaattattacagtttcttacttacttttgtctgacgagagagagaacaggacacttatagtacaaacgaatttgtcagatggcatttatgcttgaaagaactttggagtattgttcaaagagacaagctttcggtcttttcgaacgccagatctaagccccgacttgcgtcaattagatgcacccactgcaaactttctctctgctcatcgcagtcgagaaaatcatccttacatcactatcgtgctcatgtaatcttgtttacgcacgaaatctttctcttcgaaataacaagcaccaaacaatgagcaaagaatggtctaatattccattcattaccctttatgatgcaatcgaggggaaccaggccgaacttgtagcctctgctttgtccgagcttaagcaggatctgacaaatctcctgctttatcctcccaaatcagactctagcaggaaatctctggagtctggaaaagtcaagttcacctcgggcgatgagtatgaactaaacaaagaattcataatcgccactgttcaattgagcgacgaactcaacctggatgagctaatagcagcggagataaattacaacgtcagtgttacagacgaagctcaactagtaaactctctcttcgatggtggaaaagcttcattctatatgaggcgtagattcatattgctgatcgtctcatacttgaccaatgtgtcagattttggttctcattttgttgccaaggaattggttgataatttgctgaaatcctacgaggtaatcgaaagagaactagaatccataaaacaattggtagctagaaccaagatcctaaacgggaacatagttccaagaataattcaagacggtgttgacttcagaagaaattttttgtttaaagagcatcaactgttgggggaaatcattcatggagtcgcaaataataatttttcaaccatcacaaccgatcacttcaaaacttttgtttcccgcatttctgccatagaagagaatgatgtcttctcgctatcatacattcctattgtcttcgactactttagccatttgaacgagcttccagattcagtggttgaagagctccattcaacttacttgaaagagttagagaaggaaaatgttagcgtcaccttggcattggtcgtactagttttcttgatatacttcgtcaattggtgtaaagaaaaggattcaggaactacaaaatatgagttttcgtcaagtgttcaaaaccccctgttgaaatgcattgaaataggagctctggaaaagtttatggccattacgataattctttcaagagttgataacagcaccacattttttgattttcagtccctgctacagaatcacatacccgaacttacggcacagcgattatcggatgacgaaggtagcaagatagaagtgattctagaggataatttcaaggagcttttagtctcaattttgaacacttttattcaagatttcatttccaacggagcatttttattaacacatctaagaaacacagaagaggatatccttttggctaacgaggacatattggaagatttagatactttggctgagaatgctgatcttgaacgattctatctttctgtttactatctttactatgatcgcccaaatatctgcacgcagttttggctagacaaagactccaatgcgtatgggtttttgaaatgggcttcagtctgcaactcgcctttgattagttccacttactgcctgatgttatccggactatcttcaggagaagcaaacagcgttgagacattcaacttcttgactcaacaaaactcacagaatattgtctccggccctggacttaattcacgtattagttggaaaacaatttatgaggcactgaactattataacaaggcattactagagaatggctccaacagtataactcctggagtgttttctcaaaattttcaagaatcagtgatcccagaattaggagaagactcagtcatctttattgccggatattttcagttaatctcatctattgcaaacaatagtgaaatcaccaagctaaaattatttgaaaatgacttgcttaagatgctgtttgaatttttggagtctgctactcaaatcaccgctcctacattgctagttctacgctcattgatcggaacaaacatagaaagcaggcataccatttggagagctatcgataattggatttttaattttcctatgaataggcattaccttagcagtacgaagagttttgtggctaaggatgtgtttttcttatctctcagaacatttgacgaaattaatgcttttgttggcctaattgaagcattgttaagaccagtccaaacagaagacacgacgctgttagatctgacttttccatttgatttggggtcaacaactcgaaagaatggagtatggtcttacctggaattctttgctgaggaattactggtcaattccaataaagatcttcttgccccaaagagtcgtatcgcacttcagacctcgttattaaaatgttttaagcattgtctaacgtttttcgataatcaagttattattagtgctcaagtgtgtggcctacagaatctcaactccatcgtcaaatgcaaggatttttttaagttcataagcaacgaaccaggatcaattgttacgtattacttgtacgagaaaaaagtttatgatgttctcctcgatattgcttcattgggaatcgatgaattaacggttaaaaatgagtctagcaaagaggcaaaattactttacttgagtttagaagttattgatctgttattagaaaaagaaccattatatcttgatgaagttgttccattgatgaagaaatcaaacatggatcttggtactcgaggattgagttctttttatgatacatttttgttcaggctacctgttttgattcacattggtctttatattggatcgcaacacttatcaatcgcaagaaaatcactacaaatccttagtaagatatcactgtctccacagttctctgctggttcttccttctcatccgtggtgaaaaagaatcgactactttctacttttgaaactgtggacgaatcaattagactccgcaattccataattgatcagttggagaacccaaattctttggcattaaagattgaaattttagaatttctgaacaacaacttgagctctgcagagtctactgtttctcatttttttattggttttgataccagaaattctttaggattgggtaatacccaggacctcggaactattgcgtccacaagatcgacacttaaaaccttagtattaatactggtagatactttggaagtgttaacagaaggcaagaacattccctacaatgcgattagaatcctgaaattaatttttgatattgtgttgcgactgttaaaaaattccaacacgtccagcttgattacaggtttcctgagaaacgatctgcctttcaattttttcaagaaaatatgtatttttgaaccgaaaattgacgtccaaacacaatgggatggtctattgctcgatccagctctgtcgctatcaaacactttcatctgtgaaagttacggagcaggcgcattgcttgcctttattagtcagagagcgttgttgcttgagcttttatcgcttgagctgcacaatatagcgtccactggatctatttctgcaagaaagagctatgttgatccgctaattggatcaagtgaactcaatcatggattcccaagaatcttggattttttggatttcttgaacttgaatcttgtcaataaactggacccattagatagttattatcgccgttttgactttgattacattctgaaaacattgaagcttaaaacgattacactagatggtgatgaacgcaagagcatttttgaattaaattcgttgaaccaaatggtagaattggttcatttggaagaaggcgacaaatcttcatctacgttcgaagaacgacgaaactatctggttaactatttctccaacagcattttctacactaattttaaggaacaacaattcaggacgctccatgcatgggttactctggtccagattattgttaatgaaggtaatttaacacacgcggaaagatcaaactttatcctggaagtatttcaatccattgtgcccagaatcaacgattatattgacatcgatattcagtacacagaggaactaatgacattggtgttactgttggtggattcgtatgaaaaggaccgaaaatcatttttcactaataatgagacgagtgagaccacaaactcacttattgattcatctaggctttatcctttgtttaagatttcaatcgacacaatactaagtccgttgtccaccggaatgcttagatccaaagcctatgtgttgattagcaaattcctcaactattcagaaattaataagggagtttgtacggaagcattgatatctattcggtcacacgatgcaaaacttttatcgttggtttgtaatgactctatcatgggcgaaggtgaacctcgcattacttctatgctgttgcttgatgcattagtaaagatatcatcgagatttgaaaagaattcgttacaaagcaattttgtgatggaccatatgattaaaaccaacttttttttgatgctgattcgaagcatcaaacgaactgacgaaatatttggtttgtgcttttccaagaaaggacctacaaaagtccctttggatgttcttctatacgagttaactgctttcaaaactacgatatacttcttgattcgagtcgccaaaacaaaaacaggagcacagcagcttgtgaatggagacgtctttggggtgataaaaggctgcaaattcctttctattgatccagacttgggtgtggagttgcaattggtggaaaatcatgatcagactgtcaggctccgcctttcgctggattcaccattgaacgtttcgtcagctgtaggagacaaaatttcttattttgagttgcttgtgcctgtttttcaactcactttggctgttgtcatatctctagcaggtaccaaccaaaatgcagtcaaccaagttcaaggagttatgaagcatttcaaaactttggtagttggtgttctgaaaagagaagtcctgattgaaaaagaagcctcccaggctccaaatccagaaaattatcaagggttgaaacagttatctttgctgttcacccaattaaacagcattttgtagtttacgtaacatacccacccaccttattaatgaactctcagaaactacattataggcgatttcgcggagtacgaacccacccaccaaactttactttacgagatctcctggaatagaacttcagagcccaactgaacgctcaactcctcatgtatatcccttcagagttggcaaagcctttgaacattcagaagcccactgcttctcagtacaatacttttctcaataacaatttacttccgatacaatcgctggaccaaaatgttctctttatggtcgacgatgaagagtttcagttcacccatgtcgatggggtatatcatcctgatttggcaattagaatatcacggacgtcacttttagcccaagatccaagcacatatgtggcgattagcaagtgggtggtgtataaccttcgaaagtttcataatactagcggacctgcatcccaagatcccattaccaatccggtgaagttacctcctgaaagtgaagatcctggaactctgccattcgggtgtacacttaacccacttgtcagtgaccattttcagccagtccatctaactcctggctgcgtgagctgcatcgctgaattttctgaacttccagccccaaccttaactaatggtactggctcctccaaaggcctcggtagattgtggtcgcggggaggtgggtcaaggacttctaattcacctgggcccaccgataccagcagcagcgtcagtggaatggcccatgttaacgccaatttaccacctagtcacaatgcccgaacgagaagctcaacgttgtgttcttcgctgaatagtgccaataattctacctacaggttgttggaatctcgtactaatctcaacccacccaaatcatcaatcatgagatcaggctcaacttacatctccaaggtctccaccacggatggtgttgccaaaaaattaaatgctttcaattcgtttctcattagtggccacggaagggttctcaacatcgttaacctgtccgatgaccataagacaatggacgtcgaagtgccgctcattcgtgtctttgttaaccatggtgttgttacctgtttagatcacaaggcatatgtgatgtcaaatcagagaaacctggatatcttagtaggttattctaccggtgacatactatggttcaatcctttcaagatgaagtactctcgattcaataaaaagggtcatctaattcatgaacctgttatgtcgatttgctggtcaactgacggacagttcatcatagcaggattttccaatggagaggttttattcttcaatagagatttggaggattgtgacgatatttctcagcggcgtaattcgccgaatcttgataactctgatacggcagacacagacactgagaacgagttaaaaacatcaataacaattaccaacacaactcctgcttcgtctaccccaatggcttcacgttctgttacttctccttccccttctcctgccccttcccctgctttcattagagtacatgtcagctataaaaaccagagtgacgaaaaccctgtgtctcattttcagctctcagaaaagtcaataacaagtattcagcaacatccactttacgagaatttagttttttttgcttcagacgattccagtataaaaatggttgacgtcctcaaggaaactgtaactgatatccacacctcgtattatggaggcatcttatccatgaaaatcacaaaagatggaaagtatctgtttgcatcatctcaggatgatttcataagtgtctatgaactattgtttgttaccaatatgtcatacacatgcgcaggaagtcccatccacggaaacttacggctagtagcccgcctagagggccaggcttcatgggtaagggacattcaagttgattgccaaaagtcgtcgttaggccttctgtaccgtattggagcagttggagacgacggaagaattgtgttctacgaatttcaacccaagaatttaccgaatgttcacaaacaggcctctactcactctacttaccaccatcatagaacccaaacatcgaagagtttagcagctaggtcaccttcaccgccacccgtggcgaacggtacgttcctctctataccccgtaagcctatgcaccatcgtcattcaaattcagtgacatccatatcctcacagcatcaatcacttttagggttgatcaagagcacatcccatgtttctgatcaacgtattccccccggcaacgcaagtgacactgcatttgaagccagtttttgttgcaaggttaaccttttaactggcgaaacccccttagttcactctgtccgaggactaagggacattcctattatacaaccgattggtagcagtgatgtgaaactgggacgtttagcaggtctagtgttccaaaaaaattacgtctgggtgttctcagccggaggggatttgttgagatggaagcgtcctggtgaaaaaattgacccactataagcggtaagtctcatcttgattccgacgatttagttatccttttacatatagacccatttcatagacattttcaacggtaacaaccagcatctagatagtaatgggtgagggaccaagcttctacatattgctcgattttcagcactccgcattttatctttcacatgccttttcggctacttcttgcatatgacaattgccccagatgtctctctatataaagactaaaggtgctccatctcttttcagttatagtaaacagggatggaaagactttcacaactaagaaaacatttggcaggtgatgatcctgtagaacggttaacggcaaagaactctgatgatgtagtaattgttgccgccttcagaactgctgttacaaaaggtggaaagggcaagtttaaggatgtgaattcggatgtgttgcttcagaagttgatcgaaggattgttcgaacaaaaactgcctcctggatttgataaaagcctgattgaagaagtgacggtaggaaacgttttgaatcctggtgctggtgctaatgaacatagagccgccatgttggcagctggaattcctagctctgttccatttttggcaatcaacaggcagtgttcttcagggctaatggctgtcaatgatgttgcaaataagattctcgttggtcagatcgcctgtgggctagcggccggtgttgaaagtatgtcaagcaactatggaccatcagctatgcctaaagtatctaaatcagtattaaaacatccagagggagccaaatgcatgattcccatgggaataactaatgaaaatatcaactccaagtttggcatctccagaacagcccaagatgaatttgcttcgaattcttaccaaaaagctgaaaaagcagtccgtgagggtcagttcagagaggagattattcccatccaagtagaagtggaggacgaggatgatgaaaatgacgatgatgatgctcccgcaaaaactaagactattactgtggaccaggatgaaggtcccagacctaacgttaccgtagagtcattaggcaaactaagaccagcattcaagaaggatggttctacacatgccggaaatgcatcccaagtctcagatggtgctgccgttgttttattaatgcgcagaaatatggcccaggatttgaaccttcccattcttggcaagtatattgcatgtactaccgtgggagtacctccagagatcatgggagttggcccagcatatgccattccagcagtcctcaaattggtcgatttgccaaaggaaaaagtgacagtttatgagatcaacgaggcgtttgcaggtcaggcactttatgtataaataaggttggtcttgataagaataaagtgaacccgaatggaggagcaattgctctgggtcatccattgggttgtactggtgcccgtcaagtgtcaactatcatgcgagagttaaagccaggagagatcggagtcacatcaatgtgtatcggtaccggaatgggagcagcagcagtgtttgctagagaataggagagcaacaattgttgagacttttggatcagcaggagtgaaacgaataagtaattccttagtggtggacgatgctctatctgcatccagattcctctaatcttagattgttcaaaaattatgtatccctactatatactcattggcaatatacagattcgattctccaaaagaacagcagggtggtgcagcgggacatatgtgcccattagacaagatagagaaggatagcttcagagtgtagtagtttgttttaggggagcaagaaaaccacttagaagcttgttagttgctgagaagaaatagaactttagacggttttacagaacacttcaatcaggctaatcgaagctcactgtgacactgcagctacaaccaagaaagaaaacaggatatgaaaagccttggaacgtagattagccaatgactagaactcaaggcgtcaaagggtaattaaatacatatggtcgagtattaccagaacttgaacaaaacttctcgtcaaaatcagatgacagagattgaatgaattcataacaaacatctggattagacatttcttacgtgcttgatgcttaatcatccggcaaaactaatatcacatagttccattcatttctatcatccaaaaatgaccaaagctcaacttgctcagtttttcataacagcgaccattgcaaatcagatacacggtaataaaatgtcaaggagtctggtttgttcagtttttcattgattttaatattatccatcgtctttcatgcacttatttccaacgaatatcctacatttaaacttaaccattcaatgtattgttgatgtacaaattgtcaatatgctttagatcgatccagatctcttcaactgcacatagcaggcgaagaatggaatacccattccaatggcaaaaaacaaaaagtgtggaacggcatatggaactcttctgttcttgaccttgaagggaaggttggagtatggaccaacatcgccgtgagcaccggaagcggccactctggaagtggagaacattctctttggggtttgtctagcggctaatctgaacattttgtgtttgttgcaaggtaatagaactaaagagagttactattggagaggtatcgtgcaagaaaagagtagtccgggtaacaacgatcaatagtaggaggtgagaggtcacctcatagaatttcgtgtatttcctttacgctttttgccaatcttctgattggctggatcccccaaaatatgtcgcgcgcagcctctcactggagggccagtcggcccatattcacgtgacgcaccttcgaacccaaagggtaagctaactaaccaagaaaatactactttcccttttcaaataccaacacatagaaacaatggctgcagcttcattaaccagaattcaaggatctgtcaagagaagaatcttgaccgacatctcagttggcctgaccctcggtttcggctttgcttcctactggtggtggggagtccacaagccaaccgtagcccacagagagaactactacattgagttggctaagaagaagaaggccgaggaagcttaacttatttaaacctgtgacaaagatcaagagctgcacagtactttatattgtgtatttttaaagagcatattttgcatgacttttattggtgaacacggagatggactgtgtctttgatgatgctagcgtggtattgcaaggtgaaattaatggttttggagggcagattttagtttagcaaacttcttgccttgcgagtgaccgtccgctgtccaatccaaatacttgtagaattttctgacctggttctccccagtcaacctagaaatttgctgacatgagcccttcaaatgaagaacgttgatactttaaaactggtggctatgctgttattaaccctggtatattctctgatttctgagctaaaacatggaaggtggaaagtagcctttttgctcccaagagcacccaaagtgactctcgaaataattcttatccaaaagtaatttgttaacactgatgatagatctcagctcagttgattccaagccagtcgatgatctgtttgcaatctttgacgagatcaatcgaaagcttaacatacaatgcgatcatctgctgatcttggaaaaaaaactatctcagccaatcaactttttgacgccgttcagcgctcttcaaaaggtcaccagaataaccaaggtcatatggttagagaaccttaccgatgaaactttgcatgcagctctgaatgaatttaattctgttgtgttcttctgcgaggatagtttgcaaaacgttggacgggtggcaaaactgttccgatccaccattctacccatcactgagacgaattcaatgatgaacacatcactaataactctgggatccttaaaccaatcaattcgtctatatctgtcagagctatcattggagaatgacattgactactattcgtgggattctattctgttcagaatagacaaagatctactttctctaaattcttcctcagatttgaaaaagttgtaccaattgcaatctatcgaacctttgtatgccctggcaaatggtttgctgcatttggtgattcattctaacttcaagttaagattcacaaataaatttatcaagggtgccaattcagccaagttttatgatatctatcagaaattatacaccaactacactctgaataaattgagtccggaaaaaagaaaaatcctggaagatgtggacgagacattgttcatggatattcactcattctacaacaatcaatgcgacctgtttgtttttgagagaagcgttgattttataaccccgttattaacacaactcacatactgtggtttggtgcatgataactttaacgttgaatacaacaccgtcaacttgaaatctgaaacgataccactgaatgatgagctctaccaggaaatcaaagatttaaatttcactgttgtgggatctttgctcaattctaaagctaaatcgttacaagaatcatttgaagaaaggcacaaggctaaagacattgcacaaataaaggattttgtttccaacttaacgaacctcacaaaggaacaacaatcgttgaagaatcatactaacttggctgaggcagttctagcaaaagtacatgatgaaacgggcaacagtgaaaaccactcggaggacagcttgttcaatcagttcttggaactccaacaagatatcttatccaacaaactagacaataaaaccacctacaaatcaattcaaacttttttctgcaaatacaaccctcctcctttgctacctcttaggttgatgatcctctcctcaattgttaagaatgggataagggattatgaatttaatgcattgaagaaggatttcgttgattactatggtgtggactatcttcccgtaataaacacgcttgccgagctctcacttttgacaagtaagaagagccagcccttagaacaaaatcctaattcacaactcatcaaagacttccataatttgagcacttttctgaaccttttgcctggaacggaagaaacaaatcttctaaaccctaccgaattagattttgctctcccagggtttgttcctgtcattactagattaattcagtcggtttatacccgatctttcattgggccgaattccaatcctgtaattccatacattgcgggatctaacaaaaagtacaactggaagggtctcgatatcatcaacacatacttgactggtaccatgcagtccaaactgttgataccaaaatcaaaagagcaaatattcacccacagaactgcagcgcctcctcattcacgtaagggtgttctcagaaatgaggagtatattatagtagtcatgctgggaggtatatcgtacggagaattgtcaaccttaagggtcgccatatcgaagatcaacgagtctatgaacttgaacaaaaagcttcttgtgctcacaagttctgttctcaaaagtgatgatataatcaagctgactaaataatattgttgccctattaacgactgtacagttcatatctccttcgcttcgattcctatccctgactttcccttacagagatagagttagatgcctttagaatcagatactctagtattatcgcgcgcagtaagtgctcctaaattttcttttttttctggtttcaaacttagttaagaaagagtggacatgagaaaccttgtggtcctgaacaaaggagagatcgtggttgaatcacgaacctatcctgagttgagagtgctggattcagtatttgactccatttcagacacaattaccgtggcacttggtaagaatgaatctggaataattgaagttcaccagttcatgaaggatggccaagttttggtgttagcttccttctctattgacccaaacgacaaacttttaagctttgagcattttggtgacagctctcaattggtttttgtttttgaactgggggatatcgttacagcaacatatgatattactcgtcctgattcagatactaccctggttgaaattgtgggaagtatagattgtggaatcgctactagttgttggtcaccagatcaagagacacttgctctgttaacaaaggagcaaaatcttattcttttatctcgtttatttgaacctattgcggagagattccttgatccaaatgacgttaaacagaatactcaagtctccgtaggatggggtaagaaagaaacacaattcaaaggtaaaggtgcaagagcgctggagagagagaaggagtctttgaagcatgcgggcttggagaatactgatgagctgagagacccaactttaggaacttaccaaagtggaggcttgagtcccttcgactcgcagtctattaagatctcgtggagaggtgactgtgaatatttttcaataacttcaattgtcgaggtggagaataataatagaagagttatccgagtgtactccagaaatgggcagttagatagctgctccgaacccatagatggcctcgagggaaatctttcttggaaaccccaaggttctttgatcgcatcaacgcagagaagacatgatgaagatattctggaaactgttcttgacttggtgtttttcgaaaggaatgggttaagacacggagagtttggaagcagacttccacccaattctaaaattattgacctcgcttggtcttgtaacagtgaaattttagccttccaattggaaaatagtattcagttatggacttccaaaaactatcactggtatttgaagcaggagttgtttttaagttcgagtgctacgattgaggtatttcaatttcatccagaaaagccattaaggctcatgattgcatcctcgcactcactggaaattgttgatctagccttcaatactaagaatggccccaatatatccggttttgatgttgggatgagcttggtagtagatggtaccacctgcatgattacgcctctttcaattgctaatgttccaccgcctgtagcatttcgggattttgatgtattagaaccgattttggatcttgcagtctcaaaatcaaacacgaggtttgcaacattaactgcgaactatacgtttatccacgaggctgcggatcttagagcagcaccaaaagagatgagtcttataaacaaaacaacttattgcagttttgatgaacaagctagacaaatcgcagttattggaactgatcacgtagctatattagtggacagcttggatggattgtccagaatcgttattttcagcattgaggatatctcgagccccgagattgttggcataacggaaacaatgaataaagttgttctattaaagccccgatctgattttagcgtactaacgtatgaaactattgatggaacagtttatgaggtagaaatgtcgaacttggccgaaacaaagcccattgttactttcccgcaattatgtttcgactacgaggtttcaattagaaaccctgagctgtgggcggatgaagtttcaagtgtttgttttggtatttcttccaatggtaaactttatggtaatgacgtattgatttctccggcagtgacgtcaataaagattacagaatcgttgcttgtgtttacgactgcccagcatcagctgaaatttgtgcacttgatgaataaatttgagactgctaacgatattgaagatgacgacgaacgaactcgaatgatagaaagaggttcattacttgtctctgtgattccctctagagcttctgtggtccttcaggcaccaagaggaaatttggaaaccatatatccaagaattatggttttaactggtgttagaaaagatatcaaagctctccgatataaggaagccttttcaacgtgtcgaactcatagaatagatttggacatcctgcatgattatgatcctcaactatttttcgacaacttggagctttttgttaatgaactgagtagcgttgagtatctggatctatttttatcttgcctccacgaagaagatgtctctgaaacgaagtataaagaaactttgaatttgacctccaaagttgaaaacttaacactcgagcattcgcagcctccagttggaagcaaggtaaacagaatttgcgaaggtattttaactgttcttctaagacctgagtatagcaagaaatattggcagagtattctaactgcttatgcttgccaaaacccacctaatttagaggatgcattgagattgattggatcttttactgaagagtcagagatcgaaaaatctgtacagcatctgtgttttctccaagatgtaaacaagatatacaacattgctttatctttgtatgacatacctttaactttgatggttgctcaacaatctcaaaaggatcccaaagaatacttaccatttttgcaaaatctgcatgtccaaccacaattaagaaaagagtttttaattaacgatcatttgaagaattacgaaaaggccctgcgctcactctctaaaatttctgctgaggagcaacaggatattgaggaggagatcattgattacattgtcagtaagaagttgttccaatatgcattaaatctttaccactatgataatgaaaagagcaggaaagtgttggaaaaatacgccgattatcttcatggaacccaggagtttgtcgatgctgctatcacatatgagatgttgggagacaaagattccgctttggaagattatattctggccaaaagatggcaggaagccttgagtatcgctactacacatgtggaagcccaaccccagcttaaagatatttgtgaaaggctgattgctggactgaatgatatgcatgattattccagctcagcagaaattgagctaaagtacttgaataacgtggaggaaagtctaaggctatttggcaaagattatcagtttgatcgagccatcttgacctgtgtagatttgaaaagacctgaattgatagaaagtataatcgatcctagcatcagagaaggatttggaatagttgcagaattgctggccgattgcaaaggtcaagttaactcccaactgaatagattaagagaactgagagccaaaaaacaggaagatccctatgctttttacggtgataccatggagcaagacactcctgataatgtgtccattgcagcatcagaaacatcgactaaggaatcatttttcactaggtacacaggaaagactgcaggaacagccaaaactggagcctcaaggaaaacagccaaaaacaggaggcgagaggagcgaaagaaggccagaggtaagaaaggtactatttatgaagaagagtatttggtcaaatctgttggcagacttattgaacgactggagaataccgaagctgaagcagtacggcttattgaggctctaattagaagaaacatgagagagcaggcttaccaaatacagaagcagtttgtggaagtgttaaacttgctaaaggctaacattcaagaaatttacgacatcaaagaaaaggacagagaaagggtggatgataacggtatggtttactatgtgcccgagattccggttccaactatccgagactttcccgaaaagcttgtattgaaattctagacgcacgttctagagttgcgttccatggtttttgagagaatctgtggctaactgtatttttaaatagtttttgagttggataggtaaatttttcaacagaaatggtagctgaatgcagggatccatcataatcattaaaggtattacgtaattgttttccgatgaacaaccattcgacttcatttctctgattacttgccagatcgacgagattgtcagcacgatggagaccaggattcaaatctggaatcatcagaagcagcctgcttcaagctgattgaagaatataatggtgtctggattggaccctgggagaagatcatactcttaactactcttgagatatccaataataagccacgtatccttcattatgtatctattatcttttaatagtcgctattacccttcgatcctaatttctgactctttttcaaacttcagctttcaacattcacccctaacactctccttaactttcttgattatctaatccattctcagaataatccagcatatgcgtattatcatatatgtaaagtgattttcgctggctgattcgttccactcactaatgtgtattccagttatttttggatgtaagtagcaacgatcccttacacggcaaatactaacgaagcagtcgacgattacgatggaaagatgtcagacctagaagggcatcactactattgttccaggtgccacaatgtttctatggaggccattaagcatcgaaagttcttctccttattttggatccctgtagtgccaattcacctgaacaaacggttaaagtgttcaatctgtggggcatatagggatcttccaaaggaggaggtaaaaagaatgatagcggagaaggtttagctatatactaatgaactatgtcaaggggcttaccaatactttgtagagatgcctggataatgttagaacttggaaaaacaaaaacctggagaacctcatcaagtattcgagccagaagcaaagaaccagcaaaaacgcagcttgctgttcaacttttactcttcccataatctttctcctatttgttcttgcccaatcaagaattggacgcttattcgtatttttattagttttgaggagtagtaagacaatgtgtattccaggagttcctattccaggtccagttatgttcttcatattcgggtttcccgagtttgacagcaacataaagaaatatgaaggtgtcaagctccattgcgatagatgcaataacgattccatggaggctatacgtcatagaaggtttttttccatgttttggatcccgtttctgccgttacatttcagcaagagaataaaatgcaccatctgcgggtcgtttagagatgtctccaaaagtgagattgatcaactgttcaagcgttaattaccagtatcaagaataaacactgcatgttcgaggtttccccacctatgagaggatgtggtcattggaataaatgagaatggtggtgctggtacgcagattatttatctgtatccgcccatgaaccccagtaggtttgacgcaattttcgctaagtaaccagcttcagcttgctccaaatctcaggattattattcacaacttattctgttatgacgccccaaaaacggcaattggacgacgaggtcaacgaaaccaagattgatttgggtaagaagaaacaggtcactgtgcgcaactttaaaggagttaaactggtggatatcagagagttctatactacttcagaaggggaactaagaccaggaaagaaaggcatatctctgactgaagagacctggaaaactctcgtcgataacattgggaaaattcaatctgctctggacctgttggatggtgaaaaaccgggtgaggatgactcaaagaaaaagacaaaggtgaaaggaaactccatagttacatcggaagatgatgccgaaattgaagcccaaattaagcaagaaattgaagacaagcaatagtttactgttatagtaataaaatgatggttagcatcacacttacctggagtcgtctaggaatcgcttttatcgccgcctggtcgtttgttgattgaagtcagttgcttcttctaagcaggcaaaagagatcactcgcgcgatgatttctcttatcaactaaatcgaccaatattgcttgcagttttcttattagctctagccaatgtccaaacacgatgattcaggctccgaaagggatgccttaatcagggaagacgaagtagtggatgcgatgggcatggtacacgatgactcttcgcagccgcaaagtcacttggcagattacgttgttgaccataccattcataaacaccaaaggcgcaagaaatcacttgcacggcggtatagcatgggacctaatcgtccatcaaccgctcgcacacagtcggcttcctcaagtgggtctcctagtcaaactactaggcccagttttgcagaaaaatgggtaaaaagacactccgtagcaagcatccccccaccccagttccaccacgaaagacagaactatggatcagttgccggtattgacgctaacggcagtgctaggattgatctggatttactgaacactagaaaggagtcgcacaactcaatatttgaagaaagtgatgagccatttgagttcagtgattctaatccttcctctcgaagatcttctactggatcatctttgaatgacgtttgcttcccggtagaagctttggatgagcaaggtcagcaaaaagtttggccggatatccaggtgttggaagactttgccaaagaggagtcactaactgatataaacgcaaacgaggaacagagtttcaaggctcctgataatactgatgttggatttcaatatcctatagttacatcgatcgatacgggtgctgtaccttccccgcaactgcttcgaagattgggatcgtctcgtgttgatgaaacggaacctatcaatggaaggctgagaccccccaaagtgaatccctggaaacaacgcaagtcaagtacctctctacaaaattttccccataaagactctcgggttctatttgaacaatacagattcacgtactttcgggaagatttggaatcaacagtccattctttatcgatctctggtttggttcaggaggagaacatgtcttttgatggcttattcaattctgcaacttatatgaagaaatttcgggccgctaattccaagccaccatcagtgaataacctcaatatctcaaagtctgcgactccaatcccaaatagtgattctggtgccgatgcagataccgatagcagaatcattcccttctggctggatgttcttaatccgaccgaagaggaaatgaaggtgatttccaaagcattcggtattcatcctctaacaacagaagacatatttcttggtgaaacaagagagaaggttgaattattcaaagagtattattttgtctgttttagatcctttgacattgttcaggaacgttataagaggcgtaaagcagctgcaaactccaagatttcccgtcctagaagttataatgaagttagtgaagagaacacgggcgtcgctggagtaatcaatagactatttcacaagaatcatggctacgtggaattggcggacaacagatcaattgtttctgagagtacgagttcattatcatctaccaataccaatatcagttacagaaccaaaaagataaaagaacgtaaaaacaaacaaaaaggaggttaccgacataaacccaaagaaggagaactcgaaccactaaacatgtatatctgtgttttcaaagatgcagtaattagcttccattttgcagctaccccacaccctgtcaacgtcagaagacgagcccgtttattgagagattacctgaccgtaacatcagattggattagttacgccttgatcgatgacatcaccgatgccttcgctccaatgattgagagcattgaggatgaggtcaatgagatagaagatgctattctttcgctgcattccttgatcaatgacagttcttcctcggacgaagatgattctgatcttgaaaacctcacctccagatcagagacaaagactttatcttcaaagctgtcaggttcttctaactctactagctctaatatagtggggtggaagcgcaagggtgatatgttgcggagaattggagagtgtcgtaaaagagtcatgtcactgctgcgacttttgggaagtaaagccgatgtaatcaaggggtttgctaagagatgcaacgagaagtgggatgttgctcccagatccgaaattggaatgtacttaggagatatccaagatcatattgttactatggtccaagctttgaatcactacgagaagttactagcaagatcacactcgaactacttggctcaaatcaacatcgatatgaccaaagtgaacaatgacatgaacgatgtgttgggaaaaattaccatcctaggtactgttgtccttccaatgaatatagttactggtttgtggggaatgaattgtattgttcccggtcaggattatgatggacttgcatggttttggggaattacgttgggaatgttttcatttgccacgtgcttatatctctatgctaagagggctacaggtatatagtttgttcgtcgttgtgcttagattttcttcaccaccttttgtaatgtaatatatacctcattgaaggtctgtcaagtagttgcttggtgcaagtccgacgtctcctgttcgaagtaattcaaccatccaccatccatctggctgcatgttcaataccagcatgatatccttcttttggaaagaaacctccccggcaacatcggcacgataactgtaaagagcccgggagtacttgagtacctgatgaccagaactagaaatctcaggcaatccattgactcctataaactggttcagagttgtagcagacttcgatctacgataagatggtctcttttccaacggggtttgtgacttgattgaatgtgaatcaagatgcattgacatcggcctactcgtatttgagctttttcccaatgactgtctcagtttattcatgtcaccatttcctcccagatttagatcttccaagtacgactttaaaaggtcctgctgtaactgaggtggacctttttgggaattctcagcaagaggcttggtttgtttggaatgatcatattgagggaattggtgtgaatattgatgtgaagagttcactgctggtgtttcagaatgtttactattcttttgagcttccaatcgttggtacatcaaacggcttcttcttctagttggggaattccagcttttttgagaactcttggagtaagtggttggtgtggtactactggaaaagatcccgctctcggtggttgtgaattcggtatttggtggtgaactggaaagaagtgtgggagacgatggagggtccaagcggacatttcctgataagcttaaagactctggccgtgttttatactgtttcatgttatcattatggcggtcttcaaatgcagctctgttttggtcttccagggtaggatcagatgggtttactatgtttcgtttcgaataactatctgatagaggtagagtatccattggattcagaatgttaatattggaggttgccaagattttgagttcttcttcctgctcattatggtagaactcaataaaccttggagaagagtagattgttgaccccgttgctttgagatccacaaattcttgaattacttgtttcgactcacatttttcaagagatactctcacattttctgctgaggaatcatctgaaagacatgtagttgaaataacgtttgcaaaagtccagatgtttgacttcatgaacttgatacgttcttcttccagttgttgtaaagtaactgacgctaggccccattccctaatccacatttcattcaactctgtgagctccttaacatactcatagtactggcgtctatgatgattaaggttgactttcagttttggaatttttgcttctagtttctccagttcccgtccatcagctagcattttctgagattggtaaccctgaagtttttgacagtctgcaagatattttttcttggaatgctccagtttttgagtgacaacagatcgatacttgcatattttttccaaattcaactcaattggcttccttttggcgttccaggaagagatgaaagtttccaagggcccagaaacctgagtggatatctggtcagcctcggccagatgacttgcagctatttgtcggctctctaacgtcaacgtatggagggcatctttcaacgatccgaactcctctgaacctaggtactttttgctcaacgatccaagcttacgagagtactcttcctccaactggattttttctttgtagtaactgtacagctcttcgcacgattttctggatttgtttagttggtcgatgacaatttggcttccgtgatcatttttgccccaaaagttattggcgtatgttccatcggtgggaacgggcatcttggggattcaagaactgagaaagcaattgcaagaaacaggaaatacagagctgtgttttgagtctgtgggtggtcctgggaaactttgatggaaacttcctatttggggtaaacataaacacataaaataaaactgtctcgattaggaaagaaaactcaacaggaacatacattagtccctactaactaaaacacagctattaatccattaaacattaaaccacacacacccaatcttcaataaatagtagaacgacttttgtatgggcgttcgtaaaagtaaagtacactgtttccaatgaaaacttggaataacacctggacggcacaaacacccactaggaagagtagaaaatacatgaggttgtagttgtccaatgcatgattgatgaatgaattgccttcaaaattgtctaagtagttgccccccgtagcgttgaaaaccttgaagctaccagtaaccgtggcccagtacaaaatgttcacaagaggaacggaaataaagggagctccaataaagtaaaacttagcttgcaggtcgctgaaatagtacttgaccaaacaacacctgtaagtagccaaacttgccgccagcaaagcgctctgaatcacggacagcaataatgttccgtttagttctcgagttggataaggctttccataggccacgatcgtgagcagtttgaataagggtatagcaaaaggaacaaagctaataacttgcgatgaaagttcaaccagggggaacttaataaacttggtgtaaaatgaacgatgaaggctccgattgcttgcagtctttgcgctaagcaggtctgtggaattgttctcactcaaggggaccatccaatacccgactagacatcctggaattaaaattgtagtggtaaataataatatgacaaacaaagtcctgaaaacatggaatgagctggttaacgcttcaaggaccaaaaatgcaaccaaaatggtgaagaaaacaacaccagatgcacacagaaccacactcgatgtgtcagggaaactaatcgaaagttgtccatatggttcagattccgcctccttttcctcgacggatagctttggactaggcgctttaaattccaccagtgaattatatgcggcacttgtagcaaaacctagaatgggtgataacaatgcaagcgatgcagcaaacgaaaaaaatggttgaccagggaagatcaaacaaaatactaacgtcgagacaagcgttgaacaagtataagcactcaaccctaatactatactagcgcctaagatagtcacatggttgcgtaaaattgaagatacgaggtgataatctgcaacagttttatcgttaatcgccaccagtttagcattgatcgagtttgctatattggatggatatgtcactgctgcaatcgttacccaaagaacaaccatgtacattatgaagttacgagtctgggttgctatagttgggaacctctcattgaaatgatcgtaaattcttgtgaagccggcctgcctgctggatgactctctctcggaaaactggaccgtgtaatagaatgcaactgtggtgttatgtgtttccgaaaggtatgttggtgggaacaaactggccttgaaactaccatgcctggtactgtattcagatgaataagcagcggcactggctgcattgattttgtagttatacaatgcaggatcttccgtcatcaaaggctcattgtgctgtttctctttttctggttgtggtccttcatcttgatttaatttttcggtcaactccagtagtttttcgtacaacttgtcattatctgggattttggtgtaattgatgataaaactgagataattgttaaaaacgaccctattgtaatcgtcaacatagcctaatggaatacctcgacgagacagatatctgtcatcgttattcagtatatccatctgcgaatgggtgtacgccacaggaagtttgtcgatgtaaaactggtagccataacctttcctgatcaaggtgttgattcgaagagcttcttgtggtgtgtacacaatctcaccaagtttccagagctgttgctgatggttcatttgtactctatacggaggcatgtacaaatagccagtactcttttgaagtttagacaaaagcccggacttgggcatggaaaaccgtgattctatatggtcgaatccatcgaagagcagttccttcgttttgctgttgaacagggaggaaaattggaataatgggtcgtaataatcgattttttgaaacgacagctccctattataggaatttcctataggtagaatagaatccacgtaaattgggatatcttggccatattggtagtagctgccgaaattccaactgtcggatgtatttgaaaccgaaacatcagcctctggggaataatggtactgcagcctctcattgctattcagaccactgagcaacaggtggataaaagtgaagctgacaagcaccacaaagtagaacttgaacacggttttgggtatgtcatctctgctagcttgtgctttaaacaattcaccaggacgcagcaatgtcacaacgatgaccctcgctgctttattgagtatcttgatcatgcttgaagtactgaaaagaaaacttagaagaaggtgcacgtaaactgttggaataacagtgaaggttgaaaaggtcgtggatgcagggccaaaactaacgcgagctcgaattgtttaatttttttcttattgttctcctttgctgtgcattagattgtgcatcagattggtatggagtcacaagacctctactgaggaatcatcccctcaacatataaatgttggtggtttctgaagaaatcctccacgacacggtctttgtaactgcaattgcaaattaaatagagagagagaaacggagaggtactgcagattgcccacctaatcgcatttcctctgttcttcataacaggtgcctggcagtctacgctacaagatttctaggaaaggatggaaaccctctacactctacaagtaaaagatatggggaaacatcgtatattccgaattcaatagctgatagctaacaccgtaacgtctcatgtaatagtactggtaatcctaatacacggtacgcctagagttattgatctttcagttcatacaaatgcccgatttcagacacagaatccaaaagcttaggcagccatggaaacttcgacatccacacctggctcaacagtgatctgggtgatctgcttgatgtcagtggaaggagcgtgcaagtcaatgtatctcttgtggattctcatttcataggtatcccaagtcttggaaccttcaccgttaggggtctttctggtgttgatcttcaagaccttggttggcattctaacgggtcccttcttgaacaaacgtctttggttggcgttggcaatgatgtttgcagagactctctccaactgcttaaccttggtggaggtcaaagtaattctgatctttaagatctggacttgctggtcttgagacttttggtctttgatttggtcggacatgttttctgatttgagacgttcagtaggttagtttcgaagtttagtgtgaaccggtgaaaagtttttgagagtagtgggcgggtccacgcgaaacctaaggatgtaaagatgttagggctttaatttgtgatcacctgtgttggtgttcggatgtaatttgttgctcttgtttttatccgccttaatgcgtcggtagagcctcctccccatacaatcggtatcagctatggtggggcatccatatccatataagttccacctcatatcctgggttgtaaccacccaaaaatgaccaattccactggaaaccagagtgatatcgagtatttgttatccatcaggtcggttagagaaacaaatagccccaccttgaaggcattactggagaataagctcaccaattttgacgttgacatctcgaggctagatgatatcgtgaagtatgtttctgagactatcacctccagctatcccacaaaggaatctctattaaccatccctgttcacggacgttatcaacatttcgaagtcggcggcaacccaagattgacaaatctgatcactgagtggactaaatctggtctgacggattatgagatatgcaaacgtactttggatcttttcgttgtaagcgtgttgattgatgcaggtgctggcaatgaatggaagtttgatgagaatgggaccattttcaaccgatccgaaggaattgctgttgcaagctttcatatgtttgttaatggagacttcagcaatgatcagtcctctccttaccaagtcaatggactcaaattggccaattactcgccagagctactagaaaaggggtttcagattaccgacaacaacaaattatatggtttcgacggtagactaaaccttattcgcaaaattggtaacattctagagtcaaaaaaggagatatttggacaggattccaggccaggaaatctgctggattatctaatagctctgcccacttgtgaaaaaatcggtgagtccggatataagctgaatttagaggacttgtggacaacactgatgaagggtctacatgacatctggcctaaagattcaactcggaccgttgttgatgggttttctgtgggagatgcatggaaattgaagctaaacgattctattgtcacgttccacaaactcacacaatggctgacatactccttgctgctccccttgcgcaagtttggtcacctagaaatttacaacactgagttgttaacaggtttaccagagtatcgaaacggtggtgttttcgttgacttggggctactgacattgaaagaggaagctttgcagaaaggactggagctatcgaaggagtcaaagacagaccaaggaatacctagtttcacagctattgatgatgttatcgtggaatggagatcttcaacaatcgtcctcttggattacatactgcctcgggtgaatgactatttgaagattactggaacggaataccagttaatccttccccaattgattgaagcgggatcgtggccttctggaaggcgaattgcagcttctttaagacccaaaactagcggtcctccaatcaacttgattagtgacggtactgtgttttaagtagtgttagtgtgcccttttctactttctaaactaatagagtaattttccccacaacataattcactgttgcgtacaccagatgatgtacatggttgagctgaccagagcagtaaagttaccactaccttggacggacactcttttattctagtattcgatactggattactgcttacgaattgcctcacgctttcttgcatccctgtgaagcgtctccgaacttgccttaaacaacaatcaacccttccgtttgtggcagcatcttcaaatggagctactgacactgtctaatactgatgcgtctttacgcgtatttccaaatgggctacgcaaactaaaaaccagatactccagctgggaacgatactatacacaaatctacaacgcttgcataaaaaatgctccgaacgagcagttcttcacccttatagatcatcactactcttcaagccatttctctttaacctcagacgcaatgacagttttgtcttttaggggaattgagaaaaaaagcccatcaaatgttctgaaattaatgctcaacctggctcacgcagttctaaacgtcttcctctcagtgatgcaaaagaaaaagagcaagaaggataaacccccattgttgaagtgaacgaatacaaacctccgacggcaccaaatgtcgtcaggcggaatatccagttgggaagataaaacctcacactgcattcaaactttgagcctcctctaggagaagtttcctttttatatcgggtccccatctgtaaccccctagatcgccatccttcctaagaatacgatgacatggaattagtattgatattttgttggctccaacggcatttgcaacagctctagaactgttggcacccaaacccagtttctcagctaaacccgagtaggtaaacgtttctcctcttttcgactggattaaacaatcccacacgtttctttgaaactcggttccgaataggtgataggagtattttggctgtggtgtctcttggttattgagatagtgttttaaactctccactgtcttctggtcaacatttgcgtttatgggctcatcaatcgctttaaaatcacttttcatctcttgaactaattcctgattgtcaaaccctaaagagatgtaaacgatggtatcatcttcgtatacagccaaagctgttccaaacttgaacgtaaacaccgtataattcagcattgtgcgatagctgtgttacttacggaattggggaaggcacaaaatacgtaaatactagttttgataaactttttttaaaccgccgatattgctgatattactgtctaactgattaaaccactgagattcttgatcaacaagaattcgcctaccgttcaatcaaatgaagagatgagacacccgaatatctccaaacacgagaaaaggaaagattggactttcgcgtccaggcagttgtacctggagcgagttcgactgtgcgggcagacagacatctctaagttctgcaacggctgaagccgaaaacgatgccatttcatggcgagcataacctgaacagtgcacacggttatggccaactataggtctgtcgaggagctagtttcatagcttaattgaagcaagatattccacagttgtggttcactgaatgtgttctcaaccagggttttatttgtgaagaatcagctgcccggaggtaaaactcgatgttggctactggttgttctaatgtggaaaaaagaaaaaaaaaagaaaaaagaaacaaaaaaggacaacattttcagtttattccaacaataattagaattgtctagatgaatgttgagaattacattttgatgatggtcattaaccgtttccctttacaatattctcttgatagaacatcattgctcattcaataattagtgacataattttgtcctcagaatgaacgctttcctcaaatttctaaaaacattcaggtagaagagaatcatggtgccgtataatttctggtgtttattcacgaattgggacctgttagggtgacagagataagagaataacttttagtccgtttaaatcacaccccttgccccgtagtattatgattgacttttctccggtggaagaagtgtgtacagagatggtaaatgctctcctttctactcttaataccaaacatagtttttcagctgctccagagacagccaaaacataatataggctccatcatttattggtacaacaaaacaacatcaataatcctggcttcaaaggctgttttttcaaatttgctcgttttggtaagatttttcgttggatgtgtgtatcttccgcacccttaccttggcttatgaaacccgatgcgcttgatgcatgcacaaattatgcacaatagttctagcgaaagttgattccatgtaaaaaattatgcatcaaactttttcgggtcgcatgcaggaggttggcctggaaaacttggtaagattcgattagaaggttttctaccgcttcttattatggcaaaactttcctacaaatatgaaaagctgtcagtgctacgtgcttcttttcatttgaaaataaacgttaatttgtggtaatcaccaacagctacgtatacagcaagttatgtcaggctcaggtcctagcaaattcatggaaattgtcgggtaactagcatggctgcaagcgtatgtatcttgatgcaaaatgcctacccaaataggtaaaacccatggtagtcatggccgcgagctccaaaatgtggaaagttgtattttccatttgtttgacgagtaatagccgatagaattggacttatctatgcgacattatcaaaaactaaattatgaggaatgatgataatcctcgtgggttgtactcttcagctgaaggccaccacgggcaaatccgtttccacttacatagattcttcagatctcgaaaatgagatctattcgagaagccaatcacagtatttgcattatccgtgtcttgcacagcaagcacaattcaatttctacgctatattttaagacatcaaatgctttgcattaataaataatttatgtaggaaaataatagaaacagatagaaggttaaaatagttgatttcttataggaacaatgcattgaagagaagtgcaactgctccggatatcatagaattcttcacagtatttgcgacaccttcatggatggtgactgatgggaagatggaggaagtagcagaagcacttgatgattgtcctacaacagttggtacaacaacactggtagctctggtttcagaggttgaagctgttctttgatgttcttcagattccaccagtggaacataggttggaacaacggtaattgatccagtgctgaaggttatggtcttttctgtgacaccagtaactattgtagcaactgagcaaacactgttgtaacacacatctctcacaatagtggtggtagatgggcgggcagtgacaacggtcttgatttcatcagtggactggctttgcaccactgcagttgtcaatggtgtgtggactacgacaacagtagaagaacctccaacggtaactgtcttctcaacggcaccagtggtgtagacggtggtcttagtgacactttcgtcagcataaatggtagaagtaacggtgactggggttggcgtaactgtttctgttggcaaaggacagtaagtagttataacagtagtttttccatgagtagtgacagtctccttggtaactccagttatgaccaaagacttggtgcaggttttggttccacaatcagtgacagtcaacaaggtagttgagacgtccgtttctgtcttagtagttggcactaaaggctcctcggtagttcctggctcctcatcggaggtagttggctcttcaggttcctcagaagtggttggttcttcaggctcctcagaagtggttggctcttcaggctcctcagatgtagttggctcttcaggttcatcagaagtggttggctcttcaggctcttcggaagtagttggctcttcgtcggaggaagttggttcttcaggctcctcagaggtagttggttcttcaggctcctcagaggtagttggttcttcaggctcctcagaagtggttggctcttcaggctcttcggaagtagttggctcttcgtcggaggaagttggttcttcaggctcctcagaagtggttggctcttcaggctcctcagaagtggttggttcttcaggctcgtcagatgtagttggttcttcaggttcttcagaagtagttggttcttcaggctcctcagaagtggttggctcttcaggctcctcagatgtagttggctcttcaggttcatcagaagtggttggctcttcagactcttcggaagtagttggctcctcagaggtagttggctcttcatcagaggaagttggttctacaggcacctcagatgtagttggctcttcaggctcatcagatgtagttggttcaacaccacagtcggaggagcacttctttggccatttgtagacagggtggtgttttcttgaaacaccgtcctgcatgttgtcacatccaatatcatagtcgtaactcttaggccacttccatgcgctgcatccgtcagtagaagcaccagcttcacaccagtcaacttgaatctggaatgggtacatttcgacgtaacaatcatccgctgaactctttgtataaactcttagagttgtggtccattttgctgggttgtcaatgtcatatatgccggagttcaaggaccaaacaacctttgtaccacctgtaggactgttaagaccaataatcttgagctcagtcagattctctaactccaatgactctgcttcataagagagggtcacatcatatatattgtcttctacccaagtagcaccagtaatttttatgtcggaaggagggaaggttgtttcccattgatcggcataacaggcaggagagacctcagaagtggggcaagtaggaccttcaggctcctcggaaggcgttggctcttctgacgaagtggttggctcttcaggctcctcagaagtggttggctcttcagaagtggttggttcttcaggctcgtcagatgtagttggttcttcaggttcatcagaagtggttggctcctcatcggaggaggttggctcttcaggctcttcagatgtagttggctcttcagaagtggttggttcttcaggctcctcagaagtggttggctcttcaggctcctcagatgtagttggctcttcaggttcatcagaagtggttggctcttcaggctcttcggaagtagttggctcctcatcggaggaagttggctcttcaggctcctcagatgtagttggctcttcaggttcctcagaagtcgttggctcttcaggttcatcagatgtagttggttcaacaccgcagttggaggagcacttctttggccatttgtagacagggtggtgttttcttgaaacaccgtcctgcatgttgtcacatccgatatcatagtcgtaactcttaggccacttccatgcgctgcatccgtcagtagtagcaccagcttcacaccagtcaacttgaatctggaatgggtacatttcgacgtaacaatcatccgctgaactctttgtataaactcttagagttgtggtccattttgctgggttgtcaatgtcgtatactttcgagtttagggaccaaacgagctttgtaccacctgtaggactgttaagaccaataatcttgagctcagtcagattctctaactccaacgactctgcttcataagagagggtcacatcgtatatattgtcttgcacccaagtagccccagtaatttttatgtcggaaggaggaaacgttgtttcccattgattggcataacaggcaggagagacctcagaagtagggcaagtctttcctgagcttccatgagctcttgtcagacctgcagctaagatagaagaggtgaatatcgatcgcagtgaaaccatagcaaagaaagtttaatgagcaagctgatgatctctttttagatgaaccgttggaaaggacatgaaacagtatttatatacataattctggatcggattgaggaagatgtaaggcttctttctaactaacctggactggtgtagaagcaaaaattttcgaaaacttctgtggttgcaggatcttctatgcatgcatatacatgcatggtccggatatgcgttctccctcggtttcactttgagttctttttaacacttttgctattctaaaataagaaagtggtcactatcatatggcagccagataatagcctaagtagtccaatgatttagaaaaaaaaaattttcagaaccaaagtcagacatggaacgagtttgacagaatttttaaaggttcgccgtgctcaaggcccaaggaattgaatttatttcaatttactgattaaatattattatcatcaaacaatccaattgtgttcatgcagacacttgaaataggcagtataggtaagtttatggccccggaattatagagcgtctgcgcccagtccaaaagaggatagtgctttcatgcccaaggctacgggcttattacagcttggcatagtgaaaacacaaagccataatcaaattaccccacctttcttctttccaaacacaactaaatgttctgaggatatactagacgaactgtaattcaacaaagactactactagtgatagagattaatgtagacgagaactctgagcgaaaataatctaacgaatcgaactacctccatcagaaaattgccactaaacttttgctcaagctgcattttcctttatttgaaagaatgcgtacacgggattgaggtgtagctacgataatagcaaagaatgccaagttaaggcagaagagcatcaaaacagccaaaaccagctaaacctgttcggagtcgaggcatccatctgtacacttcagtttcagcataatatgtattccttttgttctttccgtttttgcacctcctcaagactttgccaaccccaaaaaggttataatctcatcaatctcctgactggattcggaatcacaattataaaaccaaaataacaggccatcaggaagttgaagtgcatatttactatcaccaaaatagctatctctatacgattatagccacaaaatgtgaacgacctacagaaataatagtgacttgcaataggaatgttcgatgaaacaattagttgcagcaaagtacatcggtaattaatcttacatgcttctgcatttacccgcatatcgcctggaaaaaaagtgagatcttgaccttcttcatttttggttggcaaacgactcatgtagctgtttgcttcgggtttccgaaaaacttgtgagcagcaacggttatcaagagaggtttgcaattagtgggaaaattctgcggacaaactactcaattagatttgtaacataatttagtttctcatcttctttttgcttcgaagtagacaacatcggcaacgcatcgttttgagtcattcctgtttgtaacatgacctcctctttttggtaattatcgattcaatgacttgatcttcaagttttctcgacgcatgatgatgttccttgatttattttttttactttttcttgcatgcatatagtgtagccgagacgacgtttattgtcactgcctgcatccggcatggatatcagctaacaccccccgcattggaccagagtctgcatcttgggttttttgcaacagataacagcttttttcggatactacttccagagtacttgcatgaattattttctttttcttgttcacttacagagaggcagagtggatgattgatttttctcgggaacttatccgaacaaacatgcttgcttaacggctttctttcaagttggtttagcgtagttgttatatccgttcaatgcggtgacacattttttgtggctgttgaatgcgattattttaagaaaaagctagttttggcagtcatgtttcggtgtgagatcttttccataataatacttccacactttaaaaggccaaaagaggtaaaaaaaattgttttctgcagatcagtcatgttgacgacggcttgcctgattccagattcctttttgtaacactgttgctgggactttgttcattggatatttgcagagactgttttccctgacgcattatgcgaccagtctcggttccgtcaaatgcaaggcctgattagttgcataaatcgcttttcacctattcaggaaaaggcagcaaggactatttttatgataatagtaataaatccgaaacaagtctagaaacatttaaccggttttcctggttattcagctatttacttagcaggtagcgcatgcacgtgcagaaacggtaatttgcaagttcgaacaatccgagagaaaagacgtaagagtgttgtgatggaccgagtgtaagaagatattgtatgagagattcagcgtagattacaaaacttggaaagtatcggcaggctttcatatcatctttatattgttagtttttcgttttcttgtattttttttctggatccttttttatttctatcggtcgacgtcggctgtttcagattaaagcaagcaagcaatctgaaacttgcgaattcctcgtcgttctaatccagtaacatcacggatgttgattcccgtaacataggcggcgggaaaagctcagtgttggcatttgcacaattaaatacactgcatcttcgtgaattgcttctctgggttctagaataatgcttcattgtggaattcttgttagcttcgcaacaaaactctctattcccaccgtttattagtgttctcagattaagagtaaattcttgggcgctctgcgataaacgttggagaccaaaaattcggttgagaggatagttgatcactgaacacttttggagctcaaactactatcccctaggctacgggatgctatttttaacggctgcacaataatagcgctaaagcttaaactttgtttccatcttgggggagtaaatgattataaagctttacgagatcccaagacatatctaactaatcaactgtggacagaacccaaaagatgttcatctaactactagcacggatttcagatccgagattcactgcaaggcaacattatccttacacaagggaaaggggaaggggatgaaaaaaagagattgcaacacctgagtttcgcgtatggtctcccactacactactcggtcaggctcttagcagcttaactacggttgatcggacgggaaacggtgctttctgctagatatggccgcaaccggagtcttcttttttcaattttatgtgtagtgtacttagtttcgattattaaatatatacttccagttatcattaattgcgttgttgcttccacttagataatactccaaaaaagttgagcgtccccagaagagtcattatcaaattgaaatcaatttgcaaaagtttgataaacgagttggaatttttcagaaacaagattacatcctattataatgcaatagctaacccgttgaaaacagttcgacagaaatatttgcaaggaaataccatttactctaaaatcgacccctaatttatctattgagatcttttaactcatatatatacaaccccgtttaatccgttttaatgttcttatccctgtcatttttgtgaacctctccaaggaatccgtagtgccacaacaatgaatactgcgattgtctcccctcgtgccacactttaaggatttcactgtagagaatgaaatgatatatcccaagggccgtcagaatgtgccaccatccgtgcaattccagaatcaccccgaatggcagattccaataccttcgaatttgtctcaaataagtgcaatacactgtatccagattccacagaacaaatcctgtaagaaactcacccagagccaaacccaagagacgatacaagtctcttcttgcggctgcatcaggtacgtgacgttgaatcaacaccaacgacctgagaataattccaaaattcaatactgcataagaaacctggtgaaacactggattcttgtagacagaacaataaattatggtcaatacagccataagaagcgccatggcaacgtacaaagctaccctggtacggtagcccttatccacgccgtaaatatacgcaaacggcaatgctgtaacgtatatcattggcagttcgtctaaaagctgaaattcatacttcaaggtcatatgaaacagccaggaacctagcccgacaacacaggcacccactgaagtaaaaatgaataggaaaccatgctcattcttaatggccgaacggagatggtagaggaagaggaagtaaaaggccaagtttgttgtggaattgatgaactcagcaaaataccaactaatgacgtaattctcttcacaccaatcaatggtagcagttgatggtccccaataccctgagatttgctcttgatactcaaatggaaaactcattacgggagaagtaggaatgagtatcccacaaagctaatcgcttatcaaaaagttacgtaatcaccatgttcttgcctcatcaggcaatgtaatgaaggtatgtacgagacacagtacgagagggcggagtgatccaggtggtctgagagtgatgaacgcaagaaataccattactacggagaacatcgacacgtgagtaaaccggctgggctaggccaatcctggaatcgaacatcatttcctcagctaggcataatttcattatattgagggtcatcctattgatgatcggtacacacatagttaccatctataaacggactgaatccttttttccaatactgtaattgctgctcatttacgggttcttcctcccaaacaacggtcgacgtggcttgcaaatcggttcccagcgatctttctgtcacaattcaaacatgtgaagtattcagtgtctgtcgtcccattgcttgcatctgctcccgttccattgtacttattctccgatctcttgccgttaatatgattaaatatgtccttatcgtctttcacaaatttcaatctttgagcgttgatttccttaaggctgatctggtcatcgttggaaatggctttaatacttgatcggagtgcctgttcttgcagaatattgtttatgactatttggcgcaggatattggacatcagacagtcccatatcgtttcctgcatcacttctgaagacattgtacggcacaacctatgaagccggtcaatagtaagaaaagcaagaagatgcgattctcttcagatgttagatggacgacacatagatgcgcgatcctcttggatcaaagtggaaacagagatgaggaagccttattcttagattcgtagtcactgtcagcactattcagccaaccaccatgctcgagtccgattgtgatgcgtctgatgacgaaatccaagattggaatgtggtgctctctttagctgatcagaaagtccccaaaagaggggagaaagattatgagccattggagggagattacgattcaagaaaccttcttgaagcccagggcgccatgtttcaggctttggaggctaaaaaaaggggatttgcctgtaatattggccaggaattgcgatatacaatcagatttaataaaaggaaccagtcctttcatatcttaaacgcccagggcaagtttttggactctatgggtaagacagatggaaaccataaaacttggtttacaaagttcgaagccttatatttgatagagagaggaacttgcaggataacgtatgacgaggataacaattacactctaagtttagaggagtgttacacagtaatcttgaccgatgatgaggacattgataaatacaacgtttacagccatttaaagaggaatggatacatcgttctggaatatgcatcgctaagcattgaaaaggagaccagatatgttaacatagataaaaatattcacagcgtttatgataaacctcttttcaagtatacctttacaaattattcaacaatcttttgcaatttacaactggacatttacaatcgtcacaaagtatcaccagcaccgacttctccatttgagatatgtttcagcgtttggaaaccacaggtcaactttcagaagaaatcacctccattaccagattttcaaatttcggtgatcaacattgaaaactataattttccaactttggatgacatttcacatcttttaggacaggcaaataccatactcaaaccgagtcgtaacccagttagtaacctcaagtttggtaaagagaatattattattgcgacagtagatcatggactgttcaattttatcaagttgagtaggaccaattttcattctcatggattgatatgggaagatggatggctgaagaggaaacaaaggagagcaaagaacatacaacttccaaattctgattggaaatcctgggtaagcacaattaggaactcgctgaggatgttaactcttcgctgtggctcagtggaaccataatgacaaaacaaaattaaaactagaggaattcaatgaacctttcaagaccaaatgtgagctctttagtcttatgtacagccctcaatacaaggataatttatttcatcgtttagctggtctggagtattccagttcttacatccaacatccccgagatgtggtgcgaactgaaaaattaaacctgcctcatcactgctaataaaccccacacaactagtactaagacatgttcgtccctaggaaaatctttccaaggtacaatatatcactggctgatttcaagggccaccatgtgaaagccctcacgaagcttactcatcttgccccccagatcgacatggtcctagaagttagagatagccgggcccccatcagtactagaaatgtcttattcgataagcctctacaaggcaaagaaaagatcgttctttacagcaaaaacgaccttagtggagttcctatagatctgcttaaaaagtggcacaataataaggagcgattcatgatgattgactgtagaaatggtggggatatgaaacgattaattcaaatgatcagagagaaacatgaccgaatgcatcccaaaccaccattaggggtccgagttattatcacgggaatgcccaatgttgggaaaagcactcttgttaatactttgagaaagataggtcttaatcggaccaaaaacgtggccaggactgggggtcaaccaggagtcacgagatcaaccagtgaaattattagggtccaccaaaaccccgagatactagtttatgatactccaggggtttttcttcctaaagtgaaagatgttgaaaccatgatgagcttggccttggtaggcactatcaaaccaattaagattgatcctgttatggttgccgactatctactgttcgtactgaacttgcaagatccgaccggatccaagtaccgtaaatacattaaacatccgacaaatgatatctacgaactacttgaaaagattgcggaaaggataaaaagggttcgccgcaccaagaatggcattcaaattgacgaaataggcagttcgctccatttcattgatgagtggaagcaaggccgaatgggcaagtgtctgtttgatctggatgctatcaaggagattgaccaacttgaatttcaggagaattacgacgaagaaagactaagggttaattacgaaatcaaacccaaggtcaatcggcaagcgaatgcttctaatgcccttttcgaattgtgaaaccttttccgaaattcctacatagtaactgatatgaccataaactggtttcttacccctcaagatgctgatttcgttccctgatgtcttggcccggaagatatcttcgttttgtcccaggttctgtttaccgtttctagcaattgttatcaaccgatgtcttcaattggttataaccgcttcagataagaattaataatagattgcatactgttatggtgcatgaattttatgcatcgtgcgaataggctgaaattttgactactgaagtaccgagagagaagctttctccggtagatgagatagagtcacaaagagtatagctaatacatatgaaactgagatggccaagtggttacggatcagaattgagtgagagcagcaaagctctgtccttacgtggttgatttcaatatattcggcccatccatcgagctaaagatgtgtcccccacctaaactcttggctaaacggtaattcgtgaaaaatcatgcgcatcagaagtagcccctaaaagtaatcatcgataaggagattctagtacaagaatggtatgaccaaagtagatgaaatttcatttttgaaccactagcttgcttataaaaggcaaggaaacctcttctctggtcaattgctcagctcaaccaacaacactcaccaaatgaaggtttcaactttgcttacaattttcactgctctagtatcatactcctctgctcttccaattgaaaagagagagactgaatacaacagttctcttccattggttaagatttacggtactggtggtaccattgcctccagaggatctagtgcttcgcagacatccggttactctttaggattaactgtcgaggacttgatcgagtcagtcccaactttgcaagatgtcgccaacttggagtatctgcaggtgtcaaatgttggctctggatctatcaatgataccattctgttagacttagctcataacattcaagctgatttggatgaagggaaagttggaggtgccgttgtcacacatggtaccgactctctggaagaaacttctttctttttagaattgaccgtgaagacagagagtccagtcgttattgtgggtgctatgagaccagccaccgccacttcggcagatggtccaatgaacttgtaccaagcagtttccgtcgccggttctgaactcagtaaaggccgtggatctttggtcgttttcaacgaccgtattggtagtggtttctactccaccaaatccagtgccaattctttagacacttttaagtctttggaacaaggatacttgggcttcttctttaacaacgacattgagtactattatcctccagctaggccaaatggatatcactacttcaatgttacagaatccacggaactaccaatggttgacatcatctatgcccaccagtctatggaccctgctttgatctatgctgcagctgaaagcggtgtcaagggtatcgtcacagcaggaatgggtgccggtagtattactgctccggccagagatgctttgaacgatgtctatgagaagtacggtgtcataactgttcagagtagaagaatgcaggagggtaaagttccagaaagaaccaacaacttcataggatctggatatttgaacccacaaaaagccagaattatgctacaattgtgtctcaacgagggattaaaccttaaccagacaaaggatgtgttctccgctgtttacggtggttagttcactaaataatttctgccttatgcctttctgaccagttctcaccgataccattaggatttcttctactagaattttgaatataaattaacattattttgtatcacctcttgtactttatttatatcctccaggggtacttgtgccaatatcaatatcttgactctccaactctttcatctgtttctctctttggaataacctccatcttgtcaactgtgccgactgatgaacgtggaagccgaacatcttcggcgtatatatgtttaagctatgcgtgggaattaattcaggatatgtttgaaaaaacattgctgggaaggaagttccgaaaaaggcaccatccaacctcgagtgtcgcacagacttaggattgtaaatatcctcacaattagggcaatacagtttcactgtagataggttagggatatcactcagtccaacaggcaacaaaggctgcaatcgacagaattcccgaggacaatatccaaaatcgctgtctgtatacttctcgtacatttgactcaaacccttgatggttaagatataacgagaatgaatcaatgaatataggaacttgcaatcatcttcaatttccctcctctttttctcgggcaatgaatcatcaatcacggaaacgtctgttatgatatcgatcagagtggttagcctattgacgtacttgttgagtcctgtgaggttgaaccggtccctgatatactctggatctatgtcacagaagtattcatttcctttcattcctaagaaccagtctatccagtactctgtatagtccgatccactatcgtctttgtccatcttttaggtgagccggaggtcaaggggagattaatttttcctactattaaagagaagtttgatgttgtggtcacttcgccttgttggacttgaagattcgcgaaggataatctattctaaggacgaacattccggagatatgatgttcttcgtaggtctcctcctgagagttgctccttcgcgaacagaccgatttttcggttttatacatctaggaacatctttaacaaatcgaccaactgttgacatgaaactggtcaggctgccttcccgaggtatcaaagatgtcagtgtgaattctgacgatcaggttattaccgcaggaaaacagctgacgcttcatgatcctccttccatagattccattgacttgccagtgaaacaagttttggtgaataagccagtggatctggctaaattcgccaagttggatgtccacaaggagcaaatatgttacacagcagaaaatgaagtctttctgctgccttcatttggaaaagaacctcaattgctgatcaaggaccaaggaactgtccggaatatttgttggtcttcagatgatgtttttatcgctatcacattgaccaaaggaaagattctcatattccaagttgaagaaaggcaagttttcaccaccctagaattgaaagaagaagttagaggagcggtttttgatgataagaatgattttttttgtacattgagtgacactttaacaattttttcactccccacatttactgtcagacaaaatcttgattctttactctcaaaaaatctacttgccaagtcagtcgttaaaatgcctagcttttcccacgacagtaaatgcattagtgttcccaatgcttctaagagcaccaacttggcgttggtttccattttacacaacacgagaaaggattggaagacttggtgcagttttgtgggccataaatttctctgcgattatacatctttcaatcctttaatatttacaaacacggcagctgactctgacctgaaattgaaaagcacgccccaaaataatccatatttttacattttggccacaggaggtagtgaccagacacttgccatatggaatacttcgcttacggaaccggtgcttgtagtcagagatatcgtaaaaagtgaaatcaataacctgacgtggtcacggagtgggagcgttctttatgtgctatcaacggatggagaactgtgtatcattcagtttgtccccgatgaattgggcaaaaagtcagaaataaagatcaatgttgcaagtcataagagacttaaagtgaaagaacaacctcaagacaaaaatagcattccaactccgattaagtctccatccacgacacctccagataatcaaatttcgaaaactgatcccacggcaaagattacgacatttgaccagccaaacggcttagttcccagtacaattaagcaccaaatagagaaggatgaaaataacgacgaagaaaaaagagacgaaagctagactcggtagaatttattggatcttctgttgtcatcaacccatctaattgtttttcaaaggtaaggctcggaacaccaaaagttcgattacattttacattagaatcagaatctgacaatttaacattagacgtcaagaatggacagggaaatgaatcatcaccaactaagatcacactctacaaaaagataccagacaatacgtacaaagagatttttgcggattttataccgaaacgagtgatgttaagtactggaggctatggacccttttggagtgtgtgcacaacagacggcactgtcatagtgtacagttataatggtcggcgggttctccctcctttggttttaggaactcccctatcatttttgcaaagcaagaatcaatatttgatggctgtaacgtcccttggtgaattgcatgtttgggatcttgaaaagaaaactgctctttttgatccaacttcactttatcctatcctgaaacctagattcgacaaggacgtactaagtcgaagtgaaaacttaacattgtgttctatcacttccgagggtgtgccagtggtgactttaagcaacggtaatggatacctcttcaatatatcattgagaacatggaatctggttagtgattcttggtgggctcttggatcccagtactgggattctacaaacacaggtgacaaagatagaggtgttaataatctactggaaaggaacaccaacgaggagctcctacgtaaaggaaaaggtcaaactattgctaagttcaataaattactcatgatgaaggaaggatatgggggcttggaaaccattgtttcgttgtcacatttggagaataagctgatgtgttttaaagttttaaaggaaaaggacaattatcacaagacttttatgatatacgtgaaacgaatttgtgaattagggataaaaaacaggttacttgagatctgtgaagaattgtatgaaactgacaagaaggttttgagggagttgattgaaacgtgcagtgaatacagaaaagtccaaagaattctgcttaaatacaatcaaattttagaggatgacgaaagtaattaatttatgtttaatctatgagtaatatctcattaatgtatcatcgtctgagtccaaccaatgagtagacctcatcgatggttttttgtgctttctcagatgctattctggaaccttcaatggcaattttttctagcaatgcatggtcatcctttatctgtttgtacctataacttggttcctttaattcgtcgataatcaaagaagatgtgtaatcttttagttgcgcttttgtaaagtctgaaatctgatgttcaatattttgtatggactggcccgtaactgcggcgatgagatttatcagatttgatattcccggccgctgctcctctgaataatacaacggaccttcaatggagtcagtgacggctttatttatcttgtgaacaatgtttttggaagattcattaaaaaaaatcttagacagctcatcggggtcactctttgacattttcttggaagggttcttcaacgacacaattttctgggtgggagccagcattgtcgatggtagaggaaaatactcacgaccgactgtattgttgaaaagttgagcgatgtccctggttaactctaaatgctgtgcttgatcttggcccacaggaacatgggtagacttgtagatcaagatgtccgcagcttgcaacaccgggtaagtaaacagtccaagtttggcagaaccgatatcctcagacctcagggcggccttggatttaaactgtgtcatgcggttcagttggcccatgggagtaatgcaggagagaatccagttcagttggacatgttgaggaattcttgattgaacaaacagattgcaatgttccgggtccaagccacaagctatgagagaggcaatggaggtttcaatgctatcattcaatcttaaaggatcttgaggtagggtgattgaatgtaggtctgctacgccaaacatcaaatgagaatgacagtttgatggattcgcaagttgtttccagactcgaactgcaccaaagtaatttcccagatgaaacagcccggtgggctgaatcatagaaaaaactgtagaaccatgggataacttagtggagaccaccttttgaacggtagctgccgttttggacatgttggacatacgagggaagtatcgtctagatgagatgggtgagaagacaatggattacgtaatcacagtagcttcagatcctaatctcataaataaataaaagtgctccctcatcaacttgacagcagaaaactttggtgttgacttcagtttttggaacactgttttagtgtttcccgggataattttaggttctcttccttaactggttttaaaaggaatcaagtcggttaattttacttcttaatccctgatttcaaacgcaaacaattatcgaaactacaggacggttaccacaaagagttgaaacaactattgtttatgaccaacacactactgcaaaacgtaccgccggtccctattcaattggaaaatgacgaggaatcaaataattggtgtactaaagtttccatccccaattattctgccatacaagatagctatgtcgtgtttcacattctagtaacgacaagacgaggtaaactggagctttttaaacgatacagcgagtttgtcaagttcagacaaagcctgcttacagaggctcccttcaaggctaaagcaatcccgaagttaccacccaaaattatggccaaaattccttcaaaaagtcagctagagaagaggcggaggggactagaaacgtttttgaactttgtgcttttagatagtgatttgatggggtcaagcatcaaggagttcattggagctaaaagcgagaggtgatgcaaaaagacaagtcatcgtagggagtggagcgtttacatgtcgtatgagtaaacgttcacacatagattactacttataaccaattcctaatgccggaaaaaatgttgtctggaccgatgccctttgattatgtcagataattccgtcatgtactttcggccccaacctctttccctggatctccgaatcttgagtctatatctcttccagttcaccccatgcgaactgtactgtatgcataagcattaataaccaacaaagcgattgtatagcctatttataataacacatgtcactttatgtcccttttcctttcagatttgtcacgctgttagatctagaaaactgtaaaattctagatgcgcgctattagtaacggcgaaaaaatataaataggcaactctttcctttgcttttaccccctaatttatgataaagagtctaaaaatggtgcacaataaagtaacaatcattggatccggaccagctgcccacactgctgcaatttacttggccagagccgagatgaaacccaccctgtatgagggtatgttggctaacggtatcgctgctggtggtcaattaaccaccacaactgatgttgagaacttccctggtttcccagagggaatcagcggtacaggtttgatggacaaactgagagaacagagtttaagatttggcactgagatcattaccgagaccatctccaaggtcgacttgtcatctcgtccattcaaattgtggaccgaattcaacgaggatgaagctccaattacaacagacgctgtagttattgccactggtgcctccgccaaaagacttcatttgccaggagaagagacttactggcaacagggtatttctgcctgtgctgtttgtgacggtgctatcccacttttcaggaacaagcctttggcagttgttggaggtggtgattccgcctgtgaggaggcccttttcttgaccaagtacgcttccaaggtttacatgattgtcagaaaggattacttaagagcttctaccattatgcaaagaagagttgaaaagaatgaaaagctcgaggttctgtacaacactgtttccaaggaggcaaagggtgatggaaagttgctaagtgcactgaccattgagaacgttgtcactaaggaagtcaaagaccttccagtcagcggtctgttttacgcaattggacacatcccagccaccaaaatctttgccgaccaattagaatcggacgaagatggatacctcaagactatcccaggttcttcccttacatctattccaggtgttttcgctgctggtgatgtccaggacaagcgttacagacaggccattacctctgcaggaaccggatgtatggccgccttagacgctgagaaattcttgtccgagaacgagtaaacacacgaacttacttctcccccatacataatagatatttttttccaatagacgcacaaggaaagaccagttttccagaacgatataaatcagtagacagacctcggaccaacctcaagctattatgtaatcagagctgttaacccaacattcgcgtgttttcgtactttgaccttctaaatgtgttcgcgctgatgtcttccctcttcttctctttgtttccaacagtgatttttgcctaccaatcatggaagatatactcaactttaacaaggaattggacatctcgctgttcgataacgttgtgaatgttctttacaacggatctggaaaggagcagcaacaagcacaaaccataattgctcagtttcaagaacatgaggattcttggacaagggccgaccaaatcctggaactcagtacaaacagtcatagtaagtacatagcactcagcactttagataagctaatcaagacgaaatggaaggcgttaggagtggaacaacggctcggaattagaaactttatcatcagtatgatcatcagtatgtgcgaagatgaccaggtgtttgttagccaaaaggcgttaatccaaaagtgtgacctaacattggttcagattatcaaacaggactggcctaagaattggcctgaatttattccagagttaattgcgtcttcaagggctagtttcaacgtctgtgagaacaatatggtaactctgaagttgctgagtgaagagatttttgatttcagtagtgagcaaatgacacaggcaaaggctcaagagttaaagaatagcatgagtagagagtttggagagatcttcaaactgtgttttgaggttctggacaaagcagagaagccctcgcttttggaggcaactttgaattgtttgctcaagtatattccttggattcctctgggatacatcttcgaaacggatctactcaactatttgagtgaaaagtttttcaaggatcaacagttcagactcactagtcttaaatgtcttactgaagtgagtgcgattcgtcccacccaagaatacgagcaatactacctgaaatatttcaagaccattctcgaagctttagtcactattctacccccagatatcgatttgagacaatcttacgaatatgctaataccactgatcaagttttcctgaatgatttggctatgttttttgtcacatttttaccaaaccacgtgttgagcttagagaaagacgaaaacctcaaacaaatgtcaatcgtagcccaccagtacctcatcaatctatcaaaaattagtgagcgtgagctgttcaaaacatgcttggattattggaatgaatttgtctctgacttgttctcagaagttcaaaaattaccttccaaagaactatctcccttgtcacagctacaattttccagttcattggggggaggcgctccagatcccgagcttttaaatcaatttccgctccgtaagcacctttataataagattctcagtgagctcagagttgttatgattgataatatggtcaaaccagaagaggttctaattgttgaaaatgacgaaggagaaatcgttcgtgagtttgtcaaagaaagtgataccattcaactttatcaatccatgagggaagttctagtgtacttgacccatttggatgctgtagacaccgagaacatcatgagagagaaattggctaggcagtttatgccctccgtatggtcttggaacaggatcaactgtttgtgttgggccattggatctatttctggtaccatgaatgaaaaaatggagcgtaatttcctagttacagtcatcaaagatttgctggctttaaccgacttaaaacggggcaaagataacaaagcagtggttgcttcaaatattatgtacattgttggccagtatcctcgtttcctgaaagctcattggaagtttttaaaaactgtggttaacaagctatttgagttcatgcatgaatctcatgaaggtgttcaggatatggcttgtgacacctttatcaagattactgaaaaatgtaagagacatttcgtcatacaacaggcaggagagtcggaaccattcatcaatgagattattctcaatctgcaatctatcactgaagatttggaacctcaacaggttcatactttctacgaggcttgtgggtgtattctctcagcgcaagaaaacaaagatgtgagagataagttgttgaacgatctcatgagtttacccaacatggcatggaatgcaatagttcaacaggctggtgcagaccctactttattgaccaactccgaaacagtgaaaatcatagcaaacatcgtcaaaacgaatgtttccgtctgtaagacaatgggtcagggattctacccacagttgatactaatctacgttgacatgctttcattgtacaatgccgtgtcaaccatgatttctaatgcagtttcaactgacggccttattgctacaaaaacccctaaggttaggggattaaggactatcaagaaggagattttgaagttgatagaaatttacatttccaaagccaataataaccaagagatagtgcgagacctgattcctccattattacaagcagttttgagcgactacaataataatgttcctgatgctcgtgattcggaggttctgaattgtatgtctaccgttgttgacaaagttggtgctttaatacctaatgaaattctgactattctgcagaacgtatttgaggtaaccttagatatgatcaacaaggacttcactgagtatccagaacatcgtgtggaattttacaagttattgagagagatcaacagagtaaacttcaacgctttgttacaactgccaacccaggcattccagtcctttgtggactctatcttatgggccttcaagcataataatagagaagttgaagagtcaggattaacgctggctgtggaattgttaaaaaacattcaggacctaggtaacaatgattttgctacagccttctatcagaatttctactttagcattctgagtgacactttctacgtcctgacggagcccgatcacaaatctggcttcaatttacaatcggagcttttgagtaaactgattcaactggtgaccgagaatatcattgctgtaccgatctattcaccggatcaagctccagctggaacatccaacttggagtttgttcgtaattatattggaaacatgttaatgaacgcattccctcaattgcaagagcagcaactggttaacttccttgacgttgcattcaaacaatacaacctacacactagatttaaaggagtattaagagactttttggtgcagattaagcaatacggtggggatcctacggactatctgtttgctgaagataaagcgaacgagctggctgagaagaaacgggcagaattagagaaggcaaaacaaattggaggcttgattaaacctagtgaacttgacgactagaaggcctacaagatatctaacaacgttatagtatgatgaatgaattgttattactatccattgtagactcgatgagggagaaacgaattacatatttgtgatgttaaaccgtatttgatcaattaccattcacaggtgctcctgctcttgaatcttatttatctgtgttctgaattcacgttctttttggttctgttagagacatccgtggaccaattgtcttcccaaaaaaccttaaaccccacaatagatatcgcggcgtttgaacacattctagactttcctggctcacttggtgttattttgggatcttcgcgtcaaagaattttcaatatttaccttctgtttccgtgtttttgcccagtatttaccgaaataatcatgataactttatccccatcacccactctatatgctagggcggatgagacttcgaccacgacttccagcggaagtaggacgaccactccggattgttccaatcacagatgtgataaaccctctaacatgagcagcgctgccatagcggtggctgttgttgttcctgttattgttgttgctatagttctaggaagcttgttctattggaattatcgcaagaataagcaagaagccctagatgatgacaatccagatttcaacgctgataacactattttgccagacttccattacccgggtgatgtgatgaagaacaagactgatatgaacccttttgaggatgaatccttaagatatccaaatcacatggactctttcatacttccttattcaactgagactcagtcgaaaagatccttggactcatattccaagaacttgggagattatcctgcttacagacaagctactcctagttcttccacaaaccccatgaacaatggtttaaaatccgagatatctttgacaacgtttacgactggaccgtctatggacaagttggcttcctccactaccggaatccgatctcctgtgtctaaaattgctagagagtctaccagaacatctccagtgagaagtctaagaagtttgggaatcagtctggttgacgagaatttcagtaaaagtccagttcgttcgcatgagcctgaacaagcttttgatgatggaactaaacaaggatcaacttataccgttcccaatgacagtcaccaggaaggccctgatgatgaacaacaggtggaaaacacttttcaaaataatgattactctggggctcagctttacgaccatgagactggaatttctgacaacgagacccaacacgtagaagatgaagaattatccgaacatcttactaaagaaggcatacctatggttcctataatacctcagctaccccagaattctgatgatgagtacaacaacgatgagtttgaaaacaataatgcagattacctacaacctcaagcgcatgaagacattaattctgaaaatgatgatctgactgcagaagaggctgagcagattagaagaatgaaatcggtttacaacacttacttaaaaagagaccccacaatgacccataagaaattaccaatagaaagaaactctgtcgcatcttccatttatccagcaaattccacagcagcaccagcagaacaatatttcccgcaccaacaattcaattttgttcctcaagctcctgctcaaagtcaacggccgttagggaccaagaaactcaacaagctgaaaaatcttccctctcctcatgaattcaataagaacagaccattttcaactgctcaagacctgactgagtttcaacctcaaaggaagttttccgttgagaaacaggagaatcctgttgccgttccttacaatcatatggacgcttggaacgacatgagagacggtgcttcagctccacatcaactaaggcagtccattgtaatgctcaaccccgtagaaattcaacgaaaagaagtgcacaaacctgccggtggactaagatcctggaaagaaggctctacaaccggatccaaccctggatctccaattatttaactacaatcatacccgacatgacatttatgggtgaaatcttgattatatagtacacttttgcttctgaatgaatatcatctagtctttgattaactgaagtcaaaatcatccaccttatttctaaacttgagcaggttttgtttgattttagaactatcaacccaagtcaggtaatcttccatctgccgtgttaccaagtaggctggatcggtgataacattgggtccaactctgacgtgcccttgctcaatgaatgttactgcatctttaatcgattgtgccatcttgagacgaaacatcacaactcctattcttcttcgacagaatgagcttaccattactttgttctctagatcactaatttttgacttactttccaaaactcccatagaataaagcttgtctaataagagttgttcgtgtttgattctgaaaggatcatttggctgcaaaagagacaactttcttgctagttttcgaatctctccacagattttattgtacttatgataatcttctcttttctgaagatgatatttagccatcacctgagtgtccctatgcccttggtcctgcttccagtctaaaaagtcgactttcttcagcagtttctgctcatgatgcttcagttttcgaaccatattgaatatagataggaagagaatttatttaatgcagtgaaaaaaatattctcattcaagttgattatataatcaaacgtgttaataaaagaatgaaatagcagaaaaagcaaaagaagaaagcaagaagatcaagcgtttttatctttgatttgagatttgaaagtagtcgcttaaagtcgtcagtgttctgctttaatagtggaagttctattttaaagactccttgtacaaagtcctctacagtggacgtcctaattcggtatatagaggcggttgggatttttctcctatttcgatgttttttcaaccgccaaaccatcctctctgaattacaaagcaagactggaataataccctacaatgattggagttagatcattcagtaccagtctgaaatctttatcacacatagggtctgccgctatttttttaccaaaagaagtaactcttaaagttagcagtgttcttcatccaacaatcatcaagaaaggtaaaaacacaatcaccttgaaccagcaatgtttcattgaaggaccaagaggcttattgaaaatggagcttcctgactttgtgcaggtaaaatctgataacgagtcctctaagttgaccgtcgaagttgaaaactccaaagatcgaattcaaaggtcgatgtggggaacggtaagaagtacattaaataaccatgttgtgggagttacggaaggtcatctgactatgctgaaattacaaggtaccgggtacagggtttcattagtcgaagaagaagatggaaggacctttgtttccatgaaaataggtaaatgtatcaacgaaggtttctacaaaccggaagggattgaattacagaaccctcagccaaatagattggttatttccggtaatgataagcaaaaggtcaagctatttgctggtactttaaggaacttgcatcctccagaaccttataagggaaagggaatatacattgataacgaaaccatcaaactgaaggacaaaaagattaaatagattctacttgtaaatagtaactgtgcttcagtgaggaatatcaccgcttcaaaattatcagccaggcaataaactactatcaatattcattgacttgcctgaacgctcttaccaatcgacattatgatcacgtgccacctccatacacctctatccatggaaagtttttggttaactgagaagaacgaataacctccaccagcatacaaaccacactaacctagaatgatggggatctttaacacgctaaagcccttaatagctcagcgatttaaagctcatcttacgtctcccggggccattccgtttgtcgagactaaggcagccgtattgttcaagtctcctgaactttcccgattgaggaaaagacttttgacaagaccaggacttattggtgtaaagagaggaatggtgcctttttatacaaacgaaggcctgagaataccttgcacagttttagaaattgaccaggtggaggtaacgcacaacaaaactgttgcgaatgatggttactctgctgtccaagtcggatatggattcaaattgaaaaatcagacaaaaaaaatgctgggccattttgcaaaggcgcaggtttcacctaaagagaaagtagtggaatttcacgtcaaatctgatgacggactgttgcccgttggaacattattgaaggctgatcatttcaaggtgggagagtttgtggatttacaaagtatttccaagggtaagggatttgctggtgtcatgaagcgttggaacttccatggtttgaaagcatctcacggtgtttccaaagcacatagatctgctggttctactggtggtaaccaaactcccggtcgtaccttacctggtaagaagatggcaggaagaatgggtggtcataatgtcactctacaaaatgttgaagttgtggatgtgaacgctgagaaaggatatattctaataaagggaccagtttcaggcgccaccggctcttatgtcaaaattcaagatgctatcaagagataccattaatgagaaggaagaagtactatcgactgcctttctttgtacatagatttacgatacatattagctccaatcatctacaagtagattgatcgaaacagtgaacatttccaaaaattatcgagtagacccaattgacaaagacacatcccggatggttctgggaaaagacaagaaccatgtgcgaagaatgtgatcttcttgagttagtgttcccaagtagaattttttttgtgcttttatagcagaggagagggagcggtgctcataacatacgcgaaaaatatcaatagtatcatatcgatgcctgatgtctcttattatacaagttaatagtacatattatataaccttggtaaattgcaagggttgttcatcacctcctcgggggcaagaatcctcgtttaatattagaatttcgattccctgaattatagggataacgacgtggttctcgggtgatttggctaggaggaggaagacggcccttcttaattggtggcccatcatctcggttgtgtcctctgtggtttcgtttttgaggcctggagtctccccttgggtcttctgagtctcttttcccgctaccatacctcggaggaggcactgcagaatagttgtatgagctggtggatcgacgaccatctaatgttgaataatattgacttcgcagagattttggtaggtttccaccgctaaatgaactaccatttagatttggggtacgagatgatcgctgctgaagacactcatccccaaaatgtccttttgaaccacagttatagcaccatatctgaggcattccaatcttatcttttgtcttgatggtgatatagcacctccatatcgttggacatctatcagacgaatgtgctctactatcacatacacgacagtatgaatttcgcatcttgcctttgtcagggcagttgttccggaagtggcccttcgttccacagatagagcagacaactgattgtggacattgtgtataatagtggtcatcaacagcaccacaactgtggcacactaccactttacattgctggcgtttatggccttttctatgacaattggcgcagatagtttcatgagtgtctgtgacaccaaaatatcttccttcacctctcatagcaacaagttcctctggattctcgttgacatcttccattcgaagggaaaagaccttccccttaggggctacgtctggttctgtcatattagggatgatgaagttgtaggcctcagattagaaagattttctttactgataataagtggaacgctcgcgagagtttttccaacctacaaggaacaaactggtgaagaaatcctgtatgttccttcgcgaaacctgccgagggtaacagcttggccatctctgagtcaacagatatgacagattacacgttcagaagtttttttctttcctgccaacgaacttatttttgagctaaacatcatgtctgttgaaaaaaagttggaggatctgtctattaagaatccccaaaagaaacaaaaaggaaaggctaaagaaggtgccactaagacccaattaagattggatcctgagccagagtttcttcaaagcagaatccagttattcgacgagttgaaagctaagtatgatgcggaggtcgctgctaaggagagatctcctatcaagattactctcaaagacggcaccgttaaagaaggagttgcttgggaaacttctccttttgaaattgccaagtctattgggaaatcattcttggagaggcaagttatctccaaagttaatggtgagctttgggacttagagagacctttagaggctgattcccaattagaattctttgatttcgaaactcctgagggaaaacgtgttttctggcattcttctgctcacgttttaggtgaagcttgcgaatgtcactacggtgctcatttgtgtatcggtccaccaacagaagatggatttttctacgaaatgtcaattgacaatggtgaaagttttgttactcaagccgacttccctagcattgaagctgttgctaagtctgctatcaaagagaagcaaaagtttgaaagattggttttatctaaagaggacttgcttaaaatgttcgcatacaataagtacaaagtcagaatcatcagtgagaagattcctgatggcactgcttccactgtttatagatgtggtccgttgatagatctgtgtgttggacctcacattcctcacactggccgaatcaaagctatcaaggttttaaagaactcctcctcatacttctttggtgatgccaacaatgactctctacaaagagtgtatggtatttccttccctgacaagaagcagatggacgagcatcttaagtttttgaaggaagctgccgagagagaccatcgtagaatcggccgtgaacaagaattgttctactttaatgagatgtcaccaggttcttgtttttggctgccgcacggaacaagaatttacaatacgcttactgatttgctgagaaccgagtaccgtaagcgtggttatgaagaggtcattactccgaatatgtacaactccaaattgtgggaaacatccggtcattgggcaaactacaaagaaaatatgttcaccttcgaagtcgaaaaagaaacttttggattaaagcctatgaattgtcctggtcattgtttgatgttcaaatccagggaaagatcttatagagagctgccatggagagttgctgattttggtgttattcaccgtaatgaattcagtggtgcattatctgggttaactagagttagacgtttccagcaagatgatgctcacattttctgcactcaagaccaaattgaagatgaaatctccaacatttttgacttcctgaaatttatctacggtctttttggattcgagttcaagatggaactttctaccagaccagagaagtttgtcggagatattgaaacctggaacaacgctgaagctaaattggaaaatgccttgaacaaatggggaggcaaatgggaagtcaatccaggtgatggtgccttctacggtccaaagattgacatcatgattagtgatgctttgaaaagatggcatcagtgtgctactgtccaattagacttccagctaccgcaaagattcgaattggaatacaggaccaaggatggacaggacgatttaactagacccgtcatgattcacagagctatcttaggatctgttgagagaatgactgctattctgactgaacattttgctggaaaatggccattttggttgtctcctagacaggtcctgatcgtgcctgtcggcgtgaaatattttgattatgctcaacaagtccaacaggagctgaagggtttggatctatacgctgatgttgacctgtctggtaacaccctacaaaagaaaattagaacgggtcaattgcaaagatacaactttattttcatcgttggtgaacaggagcaaaatgataagtctgtgaatgttagaaacagagatatccaggagttacagaacaaaaacgaggccgttcccttggtagatgtgatccctaaattacttcaactcagagatgagagaagattggacaatctgctatgattatgtatgtacaagaccaactattctattcatttccctttctgattttttcccatgatgaggactttacaacctttgattcctggtcaacgtaatcaccagtggttctaccttcgtaatcaccttgatcgctctgattatcctcattggtgtccttccacaatttttccccccattgaggataaccttccgattcagaatcaccttttattccgaataaatcaccactagctaaaagcccaggttttctcttgtctttattggctcctctaaactcaattgctctagaggggtctttcgccgttatagcgtaataattccagttgtgaatggaaaagtagaaggggaaaaaagtagcaatcttatactccacgtctttatctctcagttgttggcacctcttttcataaattccggggcccaaaagggttggagcagctgccattccaagcattcccaaaaggatactgtgcttaaaattgacacctacagtggtccgatgtttcgcatatcggtagataaagggagcaaccaaaccacctaggaagccggcataggtcaattggttcagttttctagtaaaaccgctgaagaaagtggcaagttccaacctttggtcttgatttagttgcttatccaactcctcaaattgctttaggtctgaagccattgatatgaattggtttgtgagcagtaaaagttagggctctgaaatctcgaagaggaaacgactaggaactacagaacagatgcagggcctattcaacaacagttatctgaaaagctcaattgctcaaagctttagtgtgaaaactcatgaagctacaattcacactgtctggggttatccttggtgcgtttactcctattttcctttgatttcaactacggtgtctgccccgcttgaaacccctttccttcgattctcgcggctattaaggttgatggtgaagggcaatccgaaatcaccttactgatctggtaatataaaatcggctgttgcgccatcccaattgtcgccagaaaaactctaattttaacaatgtctatcccccaagaagctcctaagattccaggctggagacctgtcatcttcctgaatattgaggcagatgaaccaaaatccatatacgttaacaacactggaagtctcacaggggtgaatatcactggaggctttgcaaagtcgattgaccctgaatatccatttgatgctatcattgactccggctatgatgacattcgagccgatccaggtgcctctacatctcgtctggactgtagagtatatttgactacctctgaaggtgcaggtgtgttcttgacttatccaggtgtcgtaagaatggagaagtcagtcgttgatgttttgactcaaaagagttcattcatggatttcaacgacggttatgttacatgtacacccgtagtacatttggacgaaaaggccaagaaggaacaatggattactaaagagactatctttggaataggccgcttcgtcagagataacgagggaagactcagggtacaatattacctgtatgtcttagcttgaagggttgtttgcctacgttttctttatgtttatccttatatgctcttctttatgccgaagaacaattgatttgtttctttaaataaatagtttatcaatgagccgtttagcccagatcttcttcgtcaatgtctaatcttcatctatacttcttccacttcctgaacttcctggtccgtttcgttaactagttttggctactctcaatgtcctccttgaatgcagcttgtgcgaacctgagtccacagtaaccacacggaatagctttattctggtctaggttgatgtaaactttgggatgtccttgtgcaccaccatttccatcacataccgcaacattatcgtgctcgatataacgaataggttgcttgtaaatcagatcaatagcagcatatggacggggttgcttggccaaatccttcactgcaaatctaacattatcttgagcttctgctcttggtttttgacttttggaccagggcgatatacggttaggagcctgctgctgaaggttgttctcgtcgggcttagaaatatccttgattctagctgtggtcaactctttcgtcgaaattcttctgatactggctcttgttagtctcaacatggtgttgtatatgtgcaaattttgattgggtctttcgctcgtaaagtgattaacgaaatgattgtgcttaggtaatctgaaatttatgggatgtgaggaaggaggtagtaaaggatgctagtacagttttgagtttatttactactaacttgcgaatcaggaaagtatgaaatatcaataagatttcgtaaatcggcggcaattgaaactacagtttgtgatcgttctctttgagcgagattttgaaagtttctgttgtaccagactctggggtaatttttcaatcttaggcaatttctgagttacgttaactggctagtatattccagtcagctctctccttgctagaaacgtaatgtattgcattcaaatgtagctcaataaaattgtaactgccaaaggtagcagggagagcttccaccatacttgacgaagattttcactaaggactgttcttctttgccaaaaatctgaaaaacagctcagttcgtccccagatactaacagtccacttgatcaatcttacagtaatactccgacgaggagattaatacgtgctaccatgtcatctggtgttcaagtaccaccccgtgccccaagaatactctgatcgcgcgaatatctctttatctagaataaatttgatccaagtccaactaaacgttgatttctagttcacaaaatggcgatacaagagaccgattatgacgcattgtttagtagatactctgctactaataagggctatcttgaggatgagtacttggccgagttgctgcagtctttaattgatgtctctccattatcggcacaatccccacatcaacagatgaataccaaaagaaagctgttgagaatgaaaaaatccataaagatgccaattatcaaccggggaacttatataagaacttttgccattgattcagtcattgaatcctttttgaactctttccccaatgaaaagactcaagttgtttctttaggtgctggtagcgatacgagggtattcaggtactctaacaggccgaatctcagatggatagagtgtgatttcgaacaaacagtcaaattgaaaaaatgtgctatactgaaatctacaaagctgcggaattgtcttggaattgacgagcaattgccaaccaacaatgaggaattcaaatctttaagctcaaccattgataccccctcctacctattgcaagcactagatttgaacgaatttacagactttcgacaattggacatacatgatgttccaaccatcgttcttgctgaatgcgttttttgttatctccctgattcaacttgtaataatatattgtccttactaaacacaagcatatccaactgttcatttcttatttatgaccccatgggaggcgagcagagtgacaattttggaaaagtaatggttaacaatctagctcaaaggaatatatcgatgccaaatcttatgaagtatggaactttagatgctcaaaatgttagatttcaagcactaggattgaatctcaatgttgctttagccacaatcgatcatgtaatggaaacttggctttctcaggaagagctagcaagaataagtaagctagagttccttgatgaactagaggaatgtaagttactgtttaagcactactgtctgattgtattgtacaaaggctggaaacctgaacagagctttcaagtaaaagccatcgcttaatcaagcgatgaatgacgttaaattaaaatctttgaaagatcttaaagtgatcctccgaatccaacgggctgaatttggctcccgtttggcaatacagctaaaaacttatagatactacccatatcaccatgacttttacccactagacgtttatacgctttgatgatcttttgcttatcgttttctgattttgcaatgtgaacaagctgatccgttctaaatccaagtcccaactcatgaagccaatcgccttgcgctactgggccgtgaacttgacaagattggttttcaaaaatttgtttgagttgtccaaaatccacatcagctgaaaggtctacattccccggatcatcaaatggagaaacaattttgtgattcttaatacccctgatagtatttatcggaacagtatcagctggaccgtagtcaatgatcagacaccctcctgctccacaaccgctattaatcaaagccgctatgtgtttactatatgtgtgggcctcgggacatatttctatacgtgaaccaactggcagtgcttcgtatcttggattatttttcggtatgtatgatccaggagtttcatgtggagaaaggacagaatgaaaattaaacctcaaggccggattttctagctcctttgacgttatagtagttctgttaggcagagcaagagggtccgttttagcccttataacatttttttcagaaaagtctaccatatactctctccatccatctttagtcttttcgtattgttgtacgggcaaagcatcaaaaaattcatgagcaataatgtaattagtccctgttttctttatgtccagttctgtttcgacccaatgacaccttttaccagccaaagtctctgcctcccacgttccatcctccaggacgtttagagaggtatctccacatagtttctttctttgctcctctctcaaaataggtgatgcctctaccagaattacttcatataaaactgtgcctttactaagtcgttcaaacgttcttatgcaatcaaaaattagcgtcccctttcctggaccgaactctatgaatctgacttcttttggctttccttgcaatagccaagtagtatagtgataaatacctatcatttcaccaaaagtttgggagatttcgggagatgtgacaaaatctgatgtctctgatattggtgaaaggggatccctagttgtgtaatatccgaattctggatgcaccaggcattgcttcatataggaggatactgggattggacccgttgtttttattgcaaactccaaaatttgactcaaattggtataagtttttggttttgaacagtcaattttatttaggcatctcggaagagtactgaaatacctccatttgcctagctttggaaaggttatcctatttctaggaagcatagtaggggactaaaaagatcttcttcttgaaaagtggaaatctaattggtgttagggccttatgatagagaacaagcttagttggaatgcgagagaatcagtgacatcaagagacatgaaccaacttgaagccgtactccagggtaaaccagtgtaaccagtccgatcaattgattaacttaataagttactgctattttttgtcaatcctatttcattgtaacacatgttcagggacaacctgaaaatcactactcatccaaaccattacacttctcaatgtatcttttggagagcaggcaaacgtagttttgcgttcaaggaaattgttaaaaagatctcccaaagtatcgtctcaaccacattctgcagcaatctcgtttatgtacactagagtgccaaagggttggtctgatttaataagagctggagcttcaatggtttgttgaaaatcaccttaaaaatggcacagatgaaatttccagagcttgtcagttcataaggcgcatttaatttacacgatcactccacgtagagttgatgtaacagtctctttgaaagcgagaatcatacttcagatctccacattgtgaatgccccgattaggtaattcttatcaaactacctacgatatacttacctagcagcatgaaacttggggtcaagaagtttcctcaagcttatttgccgacccacttatgtctttgaaagtccaagagaaagttcattgttatgataccttgttctacattccggaaagttgttcgcatagaggccacagactaatccaattgagaaatggtttgatcgttcttctggtttcagatcctttgaaggatgtttcagcttgttcgttaactgtagctacaggtgctcatgatgacccctgtgatctacctggcctcgcccatttatgcgagcatatgttacttttgggaaccaagaagtacccccagccagaccatttctacaaattgatttcaaaactaggaggaactcaaaacgctactaccaccggagagactactagtttttattttgaaacaccttctggggtaacgaatgatggcattcccattattgatcatgtgctggacgtattttcccagtttttcaaggagccacttttcaataaaagcaacagtaacagggagatcatggcggtaaataacgagcataccaacaacaaaacaatcaaccaaagattgatgtaccatgggctacgacttttaagtagcagaaatcatccatttcataggtttgccactgggaacatttcaacattgctgaacacacccaaggccaggaggatcaacgttagagaaaggttgttgaaatttcatgccaagaattacaaagctgctaacatgtctcttgtattgaaaggtcctcagtcgttgaatgccttgcagaaattagtcatgacccatttcattgaaggaattcctggccaagagtttcctaatgggtttagccttaccaacttgcacatcaaccaacgaaaatggaactataaacatccagcttttgagcgcacgagtcaatgtgatgtgactcttattaacagatcaattgacaagccttggtgtcgcttgcacttcccggttggtgacgatcatctactctcagtgttctgggttcatatatatggtgatgaatcgcccaatagtatctgtgatatgttaaagcaagagaatctcataacttctttgacggcttatccacttaccatatccgtaggtgaagttttgttgactttagaaatgaaactaaccaccaacggggctaaaaaaattagtcaaatactgaacatcttattttcattcactgaagagttgatcaaaacagatttgaaagattatttgagaagcataatttccttggaattgtttaattatctcaattctgaagggcaaggttcctcaatggacgaagttcattctctttccttgggattattaaataactttgcacgtctaggccctaactggattatacggcaacaatccggctggaattctctttatgaagagcacgaaacaaacacaattgattacttttttcatgaacttttaagaagagtcaaatttaacaattgcaagcttatattcatcgggaaagaaatccacttcaagtatttcaagctattgaatattaaattcaaccgaccccgaactgacccatattttgatttcgaatactgtcttggatcatcattgacagccccagctatggacataccgcttgcggtatcgtttccaactttgaacacatttttgccagctgaattccatgatcctatgaatgtgctgaaacgcatacgaaacgcttcaatcaatgcctacaaatcgcctttgtcattagtcgcaaaagctgagggagttgaggatcctataccaacccaaattgaaaataatcatttccatcaattgtggttcagaaaaacgaacaacgagaggaatggaatagtttcagtagatatggttcaggatataataccttgttctagcactgcgactattttcatcgatataatatgtgaattgcttgcaggtttattgaagaaaaaattatacgaggctgagctgctcggggttacatggactatctatccttcggtgaagggggactgctcaataggattgactgtgtcagggttctcagaaacactcagtgaaatgtttaaagcaattatagatcaaattcagtgtctattagcaaatctttccactttcaaggatgagtatattgatgcaagagtcgctgtaagaacaaggtacgaaagcttaaaagaccagaattcaatcatgctagccacggcaggattgatacacgttatagaggaaaacacctggacaatagacgaaaggctggaaaaattggaggagattacgaaagacgaacttaaaaactttttgggtacgtttttcggctctccatgttcggtgagtatgctatatgagggaatgactgatttttctatgacatattcacaactattgaacccactgactaaacaccgagactgctttggagacccaagtgttagcttcaggtgtttccgaagatcgtacttactgaatactggcaattatgcttactataaaacgtccaacgatgccaccagtgcaatttcatattttgtgcaaacgggactaagatcagatgtctataatcgaacgctgactaaagtagtttcctttttaatgagcttgcaccttgagcccaaactaaggacagaggaacaacttggatacattgtgatgggaagtataaaattgtttagggcaactacaggaatctgtatcagtgtgatgagcagtgaatttgaagttgaatatttgcatttcagaattaaatgcttcctagagtatctgtatgatgtgaccaacaggatgactcaagacgaatttaaagttcaaatattaaatcctatgttgaccaaaatacagaatgacacaagctcttccaaactagattccagctctgctataatgaagatgaatatccagggaataactggggtgaacgaaccaaatacactagccctgatatcgcataagtcgtgttgggagcagatatcatctggcacctacaacttttgcagttattcatttgatgatttcattgacacatatcgccttgaaatgttagataaatgtgagtttgttgagtggttcaggtcaaagtttcttgaaaaagagcaacaactttctattatgataaaaagtaagttcaacaaagaacaactgaaaatggagatgctcactctacgtttatcggccttcttgaatgttgcggggctaagaataaccgacgaagatttagaacatatactgaaaaagtcgaacggggaatttggagctcttatcaaattactcgtcaaacatttcaaaagtcgaagtcttaaattaactggctttgttgtccatgaaatgatgacaacagtggcgtattcactaaacaaaaatagcaaatatcaacggatgcttgccaaaaggattgataacatggacaactttcattcatccctgcattgtatagattacgactgattagtcagaactttgataatatcaacgaaacatgtttccatctccaccaccttgccgcctccattggttgctaggaagtacgttcgtttcaagctgatataatctccaagcttcccttatatcctctggtgataatggttcgtccttaggaatgcgaattctttttgaattcatgatttggtcgactaccgactcatcaagatctcgtttacgaatattttttatcgcagctttgcgttgagaaatctgttctagtatctgggccttttgtcttcttgattgaacttccttagccttttccaccatctccccaacaaacatttttgaaacagtggacaccaacaatgctacattattattgatactttgtcccagaacggattgcacaattctcttggcaacactcttgttaacattggctcttctaaagaactcatatcgagtcatttgatcctgatcaaagttttctagcaatagaccaaccttttcctgtctacttaactcaaactcatcttgagtagtgtctctctgtgtttctcgtaatcgaattttttcatggatatcttggaaaagataattcaaagcatatgatatttgatcgtctacaatttcttcctcttcttcttcatcctcttctgctgattcttctgattcttcttctatatcgcctttagcttcgttttgctctttttcagttttcccttcctgccccaatgtgtcagaaccttggggcgcagatactagcccctcttcagccttagggtcttcatgtacatctttcacctcttctaaacgagatttctcttcagcggaggtcaccgacacacttggcccctgatcaatttctgattcaggtttaggactcattcaatgttaacaatcaacgtctagttgaggtatccgagataccaacttctgatattggtaagtacacgacatacgatataccaggtccatttatgaccccatgagcaagaatatacaggagaacttcatcagcactgtaacaatatgtggctttgttacaagatgaatattataaatatttagctttggttcctataaatacaaaacaaacacgcgtggtaaatcaagatttaatgcaaatcttagattgttccgctagcctagcggcagtgccgtttacctccttgactggagcttgctttctgttatgggtcatatgactttggactaagtgaccagctgcaagggcagagcacaaggacagctctgcagccaagacagcagaagcaacgatcttagccaactgccttgagtttgcacctggattagttgggtgaggacctttaactcctaatagttccaacattgatccttgaggttccaaaacggttcctccaccaatggttccaacttcgatagatggcatagagactgaaatttgtaaatctccatttgggagcttgttcatcaaggtaatacagttggaactttcgacattctgggctggatcctgtcctgtagctaagtatactgctgtaactagattggcagcttgtgcgttgaaaccaccaattgatcctgccattgcggatccaatcaagttcttgctaacattcaattctaccaatgcctcaacatcggacttcagaacgcttctgacaacatcggctggaatacgagcttcagcaacgacagacttaccacgaccttcgatccagttgattgcagcaacttttttgtctgtacagtaattacctgaaacagaaataacttccatgtcaggccagtcacattcttccgacataaactttagtgaatactccacacccttagaaatcatgttcatacccatcgcatcaccagtagtagtcttgaatcggatgaacaataatgtaccagcaagggttgtcttaacatgctgcaaacgggcaaatctagaggtggagttaaacgcacccttaatggtcttttgcccttcttcactatctagccacatcttagctgcacctgcacgagaaagagatgggaaagaaacgcatggtcctcttgtcattccgtcggctgtcagaacagtttctacaccgcctccagaattgatagctttacaacctctcatggttgaggctactaagcagccttcagtagtagccatgggaatgtgataaggtttaccgtcaatgatcaagggaccagcaacgccgactggtaagggcatgaatccgataacattctcacaacaagcgccaaatacacggtcataatcataatctttgtaaggcagcttttcggttctcaagaccggagcatctgctaaggaagcaattgccttccttcttacaataactgcgcgggtcttatcaacaagttgtttttctagggcgtacaagggaagttttccttgaacaacgagagatgatacctcatcattgttcagctctcgtgttttaccttccttcagcaatgaaaccatctcctccaatggtcgaatgcttgtgtcattttcatttggaagcggttctactgtgggaacaacgtctggcgtttgaggctttgcaattgtagagacagcaatttctctagacgagtggaatcgagcagcattcaacaagtaaacgttgattgtggcacttattccggtaattatgaaaagaagtttgctaatcaaaggatcagttatgctagccgatatcttggaaaaaatgttcagaaaatcatcttccaactttagaagtaaatcaacaggcatgtaaaccctcgtaggcataatggtcacaatagttccttcggatccaataggaatatgtttggcagcagctttggataaggcagatacattgctcttaccaaatatagaagagcttgaaacgtcagagtcatagagccatgaagttcccaacacaaataaatggaatccaaggaacccagcgatcattatcactttgaagctgacgacgctggtactacgggaaaacatatttcggtttgaagcagcaatgcgttcagcaacatcttcagcaattccatcttcctccagaacttgctgcaaagcagttgtttcgtgaaccttattaatctgagcttttaaagataatacagcggtaaaaaatgtgaaaatcattataaggtcaaacgttaagatattagcggagagaatgcaaaagtttttgagtccttccatacggggggcataaaaagaacatgctaagaaggcggaaatcataatgagatgatccttaatcagaggccaccctgtggtttgttcaatcactgaaataatggtgtcaggaatttctttggctttttttgaacgggaagcttggagaataggaacagtgaatgcaactttgtgtttgaaaccaatggtagctaccaaaaatgggacaccttcagttaaagatgtgagtggaaccttgataccgtatacttttacagtgacggccaatgcaaacacaaatgcacaacctgaagacagcagagagccgaaagtcagccaaaagttagagttggcctttgttttcatttcataatagagctgcaaaaatgtgtaccacatagcaacgtaagcaaaagcaataagcacaatgtcgaatggttcagcaccctgaaccagtctcaaagtttttgaaaaaacagatctgaagtactcagaataacgtcccaacctattggggtgtctgactttccattggatgccatccttaccctcaatggttgaaattgaatcaaaatagtcaaatgatttgtcaaaatcctgaacgacaaatatttcagttgggtctgcgctctgaaaacttcctgccagatcgggaatctgatgtccattaacccttttaaacttcaaagcgcatacagagagatgctgggctgacttgcttttgagcttcacagagtcatccactggaatccaattttggtaatcactgtttcctggtgggtggtaaaacgatataaaaggattggataatgaagatctcgatgtgtactcctccacaatggttaggtatgctaaggaaactaagagagcggtcaccactatggtatggattggtctatgcgcacatatcttggacaacccagtaagcatcttggtactcttgaaaaaatggattctggcgtgcaccggttggcgtttagtcttgaacaaagaagagaagaagaaggaaagcctaaaaaaaaatacgagcagtacgactaagttaaacgcgtagcgaaaaactacgttggggattttaaagtttcttgttcgcgctaagttgagaactatatgctcatctcggtctggttacataataattttcttgagcctaattaaataactgttctatctatttcaaacttacaagcttaacatcgaaagttagctcactgttggctggaattcctggaagagacttctttccgtaggccatggaagctgggacaatgattcttctctcacctccaatggccataccagcgacaccgacatcccaacctttgataacctcacctttaccgagtccaaagacgaatggctttcctgaggtattcttgtcaaagaccttaccgttcttaagcttaccaatgtagcgaactccgactttgttcccagacttggcagtttggccttttccaatggttctgtcttcaataaccagaccaccagctaatgtcttggtcggaaacttcttcttgtcgccggaagtctccttcttgctagtaggaccttgttccaaatccttggtaaattcaacattcttctccttcttggccttcttagacttctttggctcttcgacaggtgcttcaactggttcggctggacgcttcttatctttctttggagactttatctcttccttgttcttctttttctcctcctcctcctcaacaatctcttcaatcttaccttcaacatcatcgacgtcatcaaggtcatcgatttcatagtctccaccatcagagatgatctcgtcttcatctggggtgaggtcgtagtcttcatcagaatcatcttcatcgtcttgatcagattcatcatcataagggtgctcaacgtagttaccagtcaaatgaattgggtatgaaccagtaacaacgaagtacacttcttcgtctggggtgatggtcagatcaatagtttgttgatactgaatttttggacccagtgtgcacagaacaaactcctcaatttcttcatcgtcctctaagtcagagccatcctcatcggactcctcgtcatcgttttcagactcttcagcggaatcatcaaccaatttgtcgtcctttttggatttcttggaaaccttcttgggttgaatcttcttttttggttcctcttcttcttcctcctctgcgtcctcttcatcagactcatcttcactgtcggattcatctccaaacaggttcgattttttcaaaattctcaatgtagatggttctgccttttcatcaatggcttcaggatctaaagcagcaagagttattctaatagtaactgggaaatcctcctccaaagctggagttgggttaaatggttccaatgccagattgtaagacgacagcgggattagggatgacatttcaaagtgtttatgattgaggttcaagacagtaggaaaggaatcgtttgcagttaaatattatttcttattcctaaaaattttttagcgatgagcctggtaagtacacattaaaaggggttgaaatattgccatccaacatcctaacagatatactaggagatcaacaagaaaggagagaaaagtggactactctacggataagcatttggatatctggtagaatgaaggaaattgcaaaagcggctgaattgagcttactgtttgccaaaaaagtaatctgaattcagtctgcagttgatatttcatttccttggccagtatcatttaaacacagcattgtctacccttttaattattatctaattagaataccatttcatgaggtttgtcacccttcttcaaagagaaaggagcggctaagtactcggataacaaagagatcttcttgatctcctccagcaatactttgtcaactgacttttggtcctcaatttgctctggagtagcagatttcttttcagtctcgtcaccaaagaaatcagactcggatttctcctcagaaacgtcagaaccttccttgttgaagtaactggcgtcaaacttggaaacatcaactccctccacggaaaccttagtggaggtgacaatgacgtgctcggcactaacttgcttcaatggaacaccattgatcttgaatggaccagtcaccaagagggtattgtcttctaaagtcttcaagtaaaccactctcttcccgctgaagcggcctaccaagaggatgacgacagttcctggaacgagagtcttcttagcgttgttgttctctgtactctgcaaatgttaataatcacattcagtctattttcttgttagccaggagggtagttttgtacttacagacaccatctatgctcaattatatgtagatccaaggtcaatggtcttaggtgacgtcgttgaagtgagaagtgcaaaacgtagtgcaccaatcatatgttaatggttggaaaattttccctgccacgacagaacgaggtgggcagaactggtcctattaggcgcatcgcccaccaagggaatacacagggtgagctgaactatgagtgcgacactcaaccccgtttctggaaacaaccgtcacagaagatctgtcaatccttcagtaggtacagatcagagtagctatcatgctatcattccactgtccgaatcaaatcttgctgtttttgtactactcttttccactcctcaggcgaaataactgggggtgtgcaattatgttgcagttcttttcgtaggatgacagtaaagtcacaaccttttctacctaaagattgtgagcagtacagggtctgtagtagtaaactatctttgctaattgggtcagaaactttgggtaaactttccttcaatatgtcacaaaggcgagaagcaattgctttgacataagacgagagtaacatggcagttagttgacggtcattaactgatgattcttggaaaatggtctctagtgacatcaatgtagcaaaagaatgttcccttatgacttctatacacctcttcaagtacttctcatgcagattggaatcttttagacccttgagatcatctaattcttccattatgaagttgtatctagagtgtaagaagattgtcttcaaatcatcggtggagaatacagaagtttcctttttcaagtcatgtccattcagctccgaggaatcgctcttagtaattgaaagccttctcaagtagttgattatcttcaccacattggactgtttcaggttagtagtcaacagtttcagtaaaccgttgatcattatcgtaatctcgctttgagtgtctgtttcgacctttttcatgacttctagatgagggaaacggatacatagtctccttaggtgggatgagatgtccacacattcactatagtgcccgttcttaatgcaaatattagttaaagctggtagctccaggatatccattacatcatcaatactgttcaagactgatgaggaaatttcgatttcaacgttcaaattactcaaattcttaagctcttcatcttctctctgtcctttcatatcgtagattgacctgtcaatctgttgaaataaatccaaatattggttgacctcattattactctcgatcaccagatcaatgtttttcagtaattggtctttaatttgtttctctagagctctctgtgaattatccagctccgccagctcttccatgacatttttggaatttgcttcaaacgaactacttggttgtgctggtgtcagcaaagactcagcatcctgggacagcataacatcgaggaaggagagtaattcagcttggttattcgcattggctagaagaagtttatcctgtgggtccaagtcggaagccaaagtatccaagagaacctttaggtcttccgctttcatcgtgctatgatgattgaactcgactgcaaattacctaaaccagagcctatacggatttatttgtagctctgtgcaaggagagcttggaagggagttcctaggaggatacaaaattcgtgtaccgcccgtaattggatttatattcgctggtccccaaaaacttggctgccaaacaaaccttgaggataacgagtcaacttacaatctgcaatcaccatggagggtttgttcttcaacatagagaatggttacattgaggctttggtacgtggttatcgttcaggtctgttaacgtcaagtcaatatatcaatttaacccaatgtgacacattggaagatctcaaactgcaactgagttccactgattatggtaactttatggctaatgttccgtcgccactctcaacttctacgattcaacgcaaagccagtgataagttatacgacgagtttaactacattcgttctcagtctacggattcactagctaaattcatggattacattacttacggttacatgatcgacaatgttgctctgatgatcactggtaccattcacgaaagagaccgtagtgaaattctggacagatgtcaccccttgggttggtttgatacgttgcctaccctaagtgtagctaccgatattgaaagtttgtaccagacagttttgattgacactccactggctccttacttttacgattgcctgagcgctgaggatttggatgatctcaatattgaaatcattagaaataagttatacaaggcctacttggaggatttctacaagttcagccagacacttccaagtcctgcaaatgaagtcatggatcgtctactacaatttgaaggcgataaaagagcgataaatattacactaaactcaattggtactgagttaactcctgaggtcaaactagaaatattccctcagttaggaagtttgatccctttccatttagaactttcaagagttgaagattcggagactctgaaaggtatcgtttctaatgtgggaacatacaaagattttttcggtagtgatgatgataaaaacttagaagaccacttctaccaacatgagatgaatctttgtcgagacgcctttactcagcaattcaccatttcaaccatctggtcatgggtgaggtctaaagaacaagaagtcagaaatattacatggatagcagaatgcattgctcaaaaccaaaaagaaagaattaacaactacatttctgtttattaatcaattatcatttgtcaaaattgaatagcccttaaattcatctcatttccgtgtaatacttgtagctgtccgcaatcttgtttctgttcacaattcgacccggataatgcgatctgatggtgctacctttaagtaaacatatcttcctgccgattttttgaacggttctagtttcttccccatgtaagtattactgtagggacactgtgagatgtccaggtcgttaatacttagggagttgctcaacaacatatctattccttgcctggtgactctgatacatcccttgatcttaagattactcagatgctcgagtttggacaacgcgatcaaagagttgtcacttactgcgctgccacaaaacgacaggttaagatcggttagcaatggaaaattctgttgtatgacataaagggaagcatctgtaatcacgcagcaaaaagtcaagtccagttgctccaaatttgggcacgatgatgcaagagaaattatgctattgtctgtaaggaatgtgcaatctttcaacaccagtgttgttagcttgctgaacaaagtttcagaccaaaaagaaaagccgttatcagtgatagaggtacaccttgttaggtccagagactttaatatgtcactagcattctcagaaaggtgtagcattgacttatctgtcaaatatttgcaataacccaagttcaagtgttccaatttgggacagccaaatgatgggctattatcagcgtatgtggataatgaggcttgagggttttttctaccattgtgtccaactaatcgttcaacgacaacatcacgaactttacggcaatttgaaagatcgatgctagtgaggttgtgtccaacacttggcacagttagatccatgattgccatcgcactaatgttccaacagttcttcatgtttaatgtcgttattgatcctcttattcccacttcgttgattaggttagagaacccttcgtctgtgatgtgatagcaatttgaaatgtcgatgtgcgtgggtcttgacccaacaaactttgtaatcttagctaatatctcgtcatccatcaaagtgttccaaggagtcaaatccaaaacacgacagagtttgtcacttagatatgaaagttgcttccatttaacacagacggaggcgcatttcatcagttcatccaaaggcatcaggtccatgataaacaaaagaatgctttctggaaatggtcccatattggaattgatgacactgtgtctccttcctgcattgacggagttcaatctcattctatgagcatgtggggtgtattgaaatgtaggagtcttgtgcgatcggaacgtgttgattgatggtaaaactggattcattcttggggtattgtagtccgcaactggatactgaacacttgtattaggagaaatggctcttggtgaaggtgataacagcatccccccaggggatggagaccttgatggagaaggcgtttttctgttacttttgccatcattccactcattccaaccaaaatttttcttgaatacgggttgcagaataggtaaaacatcatctcgatcatcatcgtaagaattatttaggatttctgatagtttgcctgtttttgcttccttgaccaaatgttcaagtggagatcctgctgtaatggaatagtttctgatcttcctctctcgagctgttctttgcatttcctctttgatactaggataattttctattatttgtgttaactttgttcctggcactacaagtaattgtgtgtttgaaatggcccgtatatctgcacttctagttggttgtaagttggggctattgctatcattcaggctgagaaaactcatttctccaaaataactcggagtagaaagcctggcaaggactctgtcaaacttagaatccagaacttctacctctccgctgattatgaagtagatgtcgcaacctgtgtcatgttttttaaaaacaaaattcatagcttcaatttttttcaactccacagcaagagccaaatcatgaataatatcagaaggaagattatcaaaaacaggaagatgttttaaaaacctttgaatggaaaaagagcgatctactagatccaaatgaccttctgctaaggatctttccgtgtttaggatagatctcaaaggaggaagatttggccctggtattggggaattatcaagagcgttatcagaagccataactccagagatgctgggaaatactgcaggggtaatggaagtggtgaatgacctgacgccagctcttttcttcttttcctgcaccgccaatcgttcttgagcttcatccctaataatccgttcaatttggggatatcctggaagaacttgatagagagcatcttttgttaaaatccctagaagaacttttgtacgagcaacaactgtagcagttctagggcggtggaaaagaattccaatttcgccgaagaaactaccagcggcaagctccgcatagatggactcaccatccatggaaactacacctacacttcctcttaaaatccaatacatggccttcgcagtttctttctccctaacaatgtattcttgtgggtggtattggacaagtcgtagcttttttgttaaatctttgaagaatgaggttggtgctgtcttaaatagtgagaaactagataacacggcagtgagttctggaggcacagcgtcatcaataactggctgttgctgtttatctgaatagttttcattcaccgtagtattgtgttgactaatctttcgcctcttgtccttcgcctcttgtttatccttatctaatcttccatgatttgaaacatagaagaagtgatggtgctccggctgagacaagggagatggccgtaaaggcaaatggaaattgtactccattgagatatcaatgggtatcgtttgtaaattgattgaaaatgtggtttttcgaaagtattgtgggttttaaaattggagtcctgagcaaagaactaattgacccgattccgatggtatttagggaccgagaattctggacgtgcgtgaaccaattacgatttgaagccaggggcattaatgtttttcgatgcggatgagcttttccgcatgcacgagagatgatcctttgcatgatatggcattaagttgctaagaagctaaaaatgatgtttacagcgtggaaaagataacaccaagcccaaaaaggcgactgctactatactcattggtattcaatcctattgataaaaatttaatttcttagtatcaaaaattgattgaaatagcgcagggactatttttccagattctgccacagccacgcgatatactctcgggtaaatgatcttcccttttttctgtgcatacatttatgcaataataaattctaatctggtaaccagtttgtttttctgtgactcaggcggaaaaagaaaaaatgacgattctatacagcagatagcccgtagtcacccccgaggaaaatcagatcataacatgccaatacttgtcaaaagtaagatgttcatctatgtacaacgagcaaagagccatatgaggtaaacgactcaggtcacactctatggaaaaagtaggcacggataaattttttgatgacgggaagcgtgcatgcaacatgccaataatagttaaaccgctgataataatctgcagcagcttatttagtcccatggtggcagatcggagtttgcttgaaaaggtcagacaatgttgcaccaccacaacattctctttcgaaagtggggggactcggataacagtggtcttagccacaacatatgcagcactgactatgaatcgtctgagacaacagtgctttcaaaaagaaacaattcttcaacagtttgaggtcagctgatgtcatcagaattgatcaactggcgtttaatggctaagcatgcctttaaaaaaaaatttgaatttagataaagtccccattttgggtaattaattcatcagcgccattgataaacgacatattcttgatgaccatcccctctttgaaatcaactggagataagccattcttcactattgtattcagatataagtctgagtatagttgattcaataacccactgagatcaccaacgttcgagtcgcttattaaaatgaacctcaaaccagttgcagtttccttcagatgtgctttgtactttccggttctgaaactttgaagaacgtttccatcgcttagcttcgaacttagccttgacatggagaatattgcaccgaacaaaagtttagcctcgtctttatcgttattcctattcacagtatcttttgatgcgggcttatgttgagcaaaatccctattgtaaatacaattacctaaaagaagttagcattggctaggtaagacaacaaaatcgtactacatacagtgtctatcaaatatccaaaacgagtaaatcatgagtgtgaataggtgaatagctgagagaagaatgttatggttttctcgaaagagaattagtggagggcagggggagggacgaggaggcaaatagtatccacgaaaagatcatactaagttcaggtacacacgcttcggagctgataagtttatcagaaaaatgctgggtacccagatgagctggtcccaactattggattacacaccgaactaagtttctaccatctaacgtgctatccatcgtagcatcaaattgactataaaggtcgtcctgccaatatttcaattatcaacctgctgccccgtaattgaatcttctggtaaaaagtagaccgcccttgacgaaagatcaggtacgaacaaagtacattaccaaaatggattatctacctgttctcccattgacattgtagtgtcctcaccaaccaaccaccattcaagccgtgaatagtgaatcatcagctgacttctagtctcccaatcactgaaaactatttcttactggtacaatgaatttttactatcaaggtgaatcatcgcttagtattgactcctcgtttacacaggagacagtggtctcaaagctgagggagatggacctttcagttgtgtcaagactggatgtagcaagtaaacatatagttaaattcgaactaccaccagatatcactttccccaatctgtcgtactgttcaatcggttttgaaagtatgctatccgatggtagtattcgaacaagtccactgcaagagatagatattgactttgcgagctccttcccaaatatcaaggagatttacatttcctgctgttctgaattgtccaaagttgaattgttccacggaaaaacctccacactggataatctttctatcaactcaagctttgagtcatctgacgcattctcgcaaacgttagatcatattttctctcattgtcccaagctggcccagttgcaagtctcattctgtaaatttgatggttccaatgacaatcgatatgtaatcccactcgaaatgtgtccccagctgaacgatatttctatttacgataacgtggctttctctgaggttcagattcgttctcaggttccccgcaagttgaaacgtcttttctttcgaaataatgtaggtttgaagctcatcaagatagaccctgcagtgagcattgttggaattttggcgatcaatgattatgacgaggaaacaagactagatgctgattgcaacacatatagcaaatgtacaagtatcaacatgtcgaccagttgtttagtagagctcaacttcaataatgttgtgcttgaccacctggtaacattagctcttcttcgaccaactgttgttaaccagacgaaacatgcaggttcaaaagaggaagggcagcttagtaacatcaaagatctaaagttggaagaaaaagttttagatgttttaagtgatccaagtagatttccaaatttgaaaaccatacttagtgagttcatgccaggcattaattcctacattgactgcttagaccaattacctagcttagacatgctgaatctgcgtgataattcaattgtcacacctttggagtttgtcaagccttctcagatatctttcctgactcttgaacttggcagatatccctctcttaaggttgcaaaccaggtaaagttaagggagctaaccatcagtctccttgatgaatgttcaataatcgagatatccaactgtccgaaattggagaagattgaactttatggaattgaacgaaggagcattttgtcagtcaagaattgtcctctcttgtctgtcttcaggtgggaaagagttgactccatagaatcggttagttttgacgaaagttgttcaaacctaaaggaattatacattgaaaacgaaaaacctttcaatatgtccattcccgacattgctttgaagaatctcaagtccatacacttgggggagatacacgagttgtcaggcagttttccgaatcttcaatatctagagataaaatcggaatcacccttcaaacgactggaattaagagatactacgaatttaaaagaattaatcgttcaaggaattcccaacaccttcagcatagacgacacttccagcgtctcatttgtatcaactccaaaagaaacagaagttcacaaggtgtttcaaaagcttttggaagaaattgctaacacagattgtttaagaaattactcgattctagataaacttgatgactcgctggaggtgactgggacgtttttcggcggtaagttatttcaaaaaagcgacaagaagctttgctactttgaggaagaaactcagtgccctatttgcttagatcagatgagcgaggaatgtgtcattcttgggtgcggccatgcttctcataagaagtgtattagagaactattggtggagtcagattgctgccccgtttgcagcaagagcaccgagactagaaaattaacactcgatgcatactagaaggtgttatctccccttatgtatcaggtgtcagattcccctcctttctaccccttatatagagatagtgatatcaataaaaatagaggttatagagattgtactccggataaatccgaactcgctcttatctcgcgaaatctgacatatcagacagggtagtcgcttaatattttacttagataagcttgccagtctcgtctctgaggttcctctccataactgtgaattacatgaacaataaaaggaatagtgacgaggcgggctcatctctatcacctagtactcctgttgttgaagagtttaggaaattgaaggcatgtgctcgatgtcaccgactcaaaatacgatgtaaattcgttgaccattcctacaaatcctgcgtgaattgttatacagccaacttagagtgttccatgacgcttgatcctactttggccacagctaagccaaggccaaggaagaaaatcaaggcaatggagaagcaaaatgctttaagtgagttgcactcacatctggatttagggcttcaagccctcaataacctgaagaatgaacatagtgacaaagaaacaatagagaaggaatctacacacctatttttggctcagaagaagctaactaatatgataaacttagtaagccatgaaattacaagtagagcaaccaactcttctgaaggtaaaactgcctccagtgccaatagtatgaaggaaggtgttgtaagagcagtacccaagttacccttgttcccctttgaaagcaacatagttagggagattaccaaactaggtctaatatctttgaaggagtgctctacccggtttagctttttcgtcaatgaaatgttggagtactggccctgtgtgaatctctcgctatatgcagatgattttgagtctcttctggataaggacccgttattattgttgggatgtatctctgttacatgtcttaataatcctgatctacatgacacactgttgtactacttggaaagaaatctaacgcaaagggtgacaactacaggagacatttcgataagcatcatcaagatctatacaatcctatcactttggtcttcacccccaaaaagatggggctcatacaaacaccagcttaacttattgacagcgatgaatcttaccctgtgtctagacctgggcaatgagaagttcagaaacaacagcaaagtcttagagaacagttcagaggagagagaaatcatcagaacttatgtcggagtgtactgttgctgttcatctttagctctttctctccctcgttttaaagttgttacatggaatgacagttttgaccaatcggtaaagctactgctaatgggagagacaaaccaaaatgataagtttttggcatattatgcacagtttttgaaagttggacatgactacttcaccatattctctcctgatctttcgatgggtacacttattacggacattgagcagttgaagtcgttgtgtgaagaatttgaaagagcaatctctaaatgtctcgcgtcaagtggtttgttatcaggatcttgcaagcaaagatttctcatttccatcatttattatcaagttttgatgtgctgttatgattttatcgtatgcaaagtcatatttcaaacatctctttttttgcactacagtgaagaccatttttacttatccgtactaaataagttgatccgatctgctgagaaaattattgatagcttcttaaatatttgtgaactatcaactaatttccccacatttttttactatcggccgatgcatgctcttgtctcgctgatcagggtaagattgctggttgtgtctcagaagttgaatttggagatcgacgtggaacgggaatacgatcgaatcagtcaaatcatgaagactatctccaagaagtcacttgttgccaaaaagatgtcaacaatactttcgatagtacaaaagtggatgaaggtcagccacaactttacccagcatggatctgtcaactcaatgacggttctacttgatgaacttggcactgagcatgcagttgaagtgcttaaagagcccacgataaaatgcgaggaaagttcaaagccgagaccttcattaagcttcgctacattggctccacctctttctgacgataccgggaaagaaagcaaagctacggatgaaaatcgtatcctaaacgacatatttcagcagattgatgatgatataaattcattctttccttctttgcccacagacctcaaccaatgggatttcaataacgagtatctagagggagacattgaatcaatgtttaaaaatgacagcaacagtcaattttggtagtggagggattgttctaaactatttacagtataaatgttggtcagtctttatttatgtcttagtagcatgatatctctttcccctaaagccaaatatctgctggttaaactggaatacctcttgggggttaaggtcatttagctcccatttagtggaaccaaataggttagatctcttttcaaacaaaatatccaaatctttgtcgtagttgttcaacaaccactcataatcgttatcgatatcttgttgatgatatcccgtaacaaaaattgcacatttggaatccagcaaacctgggattgatttcttccactgatcattggcttctttggaagagagaccagggtggaataagaaaaagcagtctaagtatgggtcatatggaaagaagtcttgagcctcatgcaatgtgtggaaatattctgtatggtgaacataacaaaggttctcatcatatctctggacaactggtctggggttatagacgtattgagacttatccttatcgtacagacattcggggccaatgaaatgcaactcaaaagaagtttcaggaaacagatacgaaagttgtttccaaacgtggccaggaagttgagattcagctcttgctcccagaataaaaaatctcataggtctgtctttcaagggtgacgatctactttctgggtagagagtataacgcaaagcagccaaagattttagaccttctaaagtgacgggacccttcggctgtaacaagtacggagagtattgatgtaaaagagaggcaatagtcatcggataactcaacatctttgtaactgccgccaattgaaactcggtgtccatagagaagaattctctggtgtaaaaataggtgtcccaacttgttagattaatgatcttatcaggatgctgttcttgagggaaatcaaactctgggaattgtcgtccgcttctcagatcatgttcgtatatattaactttcttcaaaatgttgtaacggtgtgattgatggtactcttgatcttgctcccaagcttctttggaatgatgtgtaggaattcccgagtagggacaagtaaactcaatatccttactagtgactggacacaacgctttagctctgattgtggcagctctttctctcagttgagctgacggggagctttcccaaggatgaaatctgttctccggagtggggtcatctggagaattaggaggatcgatgcacagcacagttcgtataaacgatccaatatgccgggtctggcaagaggcagattgaaaagccattcgattgatcatccttgttggtgtcaacattatgatcatttgttggcttgtagttatcaatttgtactgagttttccttttttcattgaaagcccgaaaagtcgtgtcgtggataatcaggcttgaaggagagtgaaagaaaagtcaagggagcaaaaaaagaacaatctatcacgtgagcaatatggggccttcgatttcttgcctatctatctttcaatcctcaattataaaccatcgttataataagttgaggcagaatggtacatttatctgttcgtgtctggtcttcttctgatgccctggatgaagttaccaaaagatcttacactgtcgatccttcggctacaattctcgatgtcaaaacactagtatggcgtttttccccaaatttgaacttggttccacggtgtcagacaatgaaataccgatttcaagttttgcaggatgatttggtgttggacacccttcaaaccagagacgtaagtctggaagtactagtcgatgcttctaagaaggctgttgaagaaccgccagttagttatctccctgttcgatacgtattcgactatcgattctcactagatcccatggatagcagagtaccatacagaggaataatcggatcaatgaaaacatatgtagctgaaatggttaggctaaaggaggaaaacattcttctgaaactggaagagaatggtgagcatctggatcctcagaaactgctcagtgactatctgggactagacctcccaccaaaggattacaccttagtgatcaaagttgaatcgttggtgcctttggaggagcaatcagagaacgatcattcgattaatgtgattacgatagcaaacaacattctagaggataatgtattcaaagttgatcttgagcatacaactatcggggacttgaagaaagaaatgacacatcgatacatcccacaagaaaaatacggattttcccctcttgacccaaatagaataaaggccattgctttgggtaggttgcttctggatgaggaaaaagtgggcgaaatatttgactttgactcactcactcaaccttcgttccatgtagttatctctgcattatctgcggaggagagagatgaggcaagaaaagcaagaggcaatggaaacatagagttaataagtaacactccactgacatcatcctccaacaacccggaatcaaatcttaaattcactgtctgctccactaacggtgagtatggcacagtggaattgtccactgaccattacagaatatcagatgagaatatttcgttttccagagatgcgattcgacagattgaagctacactgggacatgggttaatcctaccaagaattgaaactgaggttattagagaaaccacaagaactgaggctaggcctacgcatgatgcagaaaacccggaagagctgccccaacgtcaaccagagcattatccaggacctccccttgctcaacctgttggaagaatacggcaaatggatttttatctaaacatcaatggacagcaagttactgcggaagagttggcggcatttttcagctggatgaatcaatcatcaagagcactttatacaggtgcaagacgaatctatgagaggaatacgcataaacgtcttttcaagttactaatactagtttccaaacacgtcctcatcttcaatctatccgtctatatgtttggactaaatcacgagatatcctatagttacatggttatcttcctgctgctatttgttctttcaagaaaggacattctagaccaagtgcatactattatagtcgaagacttacctgaatccaccaatagaacattgaccacagtgactgttggatccagaacaataggacatgctgtacgatttgcaaaggaggctctatatcaaaggctcatttaccttggcattggaaataacagagaagggctgatcgatcccctggcatctcaaccatcagaagagcagctaggcagtctaaggaacaagattcaaattgcgttgcaggatgtatatctagcggttatttgcatgtttccaggtatttaccagactttcaatgatcaaatgaccagtaggaggagcataaatagcgtaagtaactgaatggttaatgaattgtggtttcacttggtcaattggaactgggaactttgcaacttggtggcgcgacgatgcagcaattggacatcaagctaactcatttgtaggccattccgtcttgctcatcattcccttgaggcaattggttttccacaccccttactttcattgaataattaattctcattaaattacctcgcaaccacctgggtcggtcgattaggtaatctgttaactagataagaaggatctagtacgtggtcgtacgcgaaactttaataagcaaagtcggcccagattttaactgtcccggctatataaggagtgagagttccccttggacgccacagttcttattaacatcagatctttcttttcgacttagtacaagaacagaatcacagaaactaatagcaatggctccaattattcagaaaccagctccattcttcaagaagactgccgtcgtcgacggtgtttttgaggaagtctccttggatcaatataaaggaaagtgggtccttttggctttcattcctttggctttcactttcgtctgcccaactgagatcattgcctactccgaggctgccaagcagtttgctgaggagggtgcccaagttctctttgcctccaccgactcagagtactctctgttggcttggactaacgtcgctagacaggatggtggtctaggcccagtcaacatcccattgttggctgacaccaaccacactttgtctaaggactacggtgttttaattgaggaggaaggtgttgctctgagaggtattttcctgattgaccctaagggagttttgagacagatcactatcaacgatctgccagtcggaagatctgttgaggagtccctgagacttcttaaggccttcaagttcactgacgagcacggtgaagtttgcccagctaactggcaaccaggtgctgataccatcaagccagaagttgatgcttccaaggaattcttttccaagtccaaatagatagaaataaactagaatagttagattaaatgtaatccacatttttacataaatgtactgttttactcttctagaacaaatgccctcaactcttgatatgctttctccaggtcgtcgttgacaataactttgtcatgagctcccgtctcagcatattctaactcagctttggcagcgtctaatcttttgcgaatactctcttctgtctcagtgcctctacttaccaaacgcttttgcaattcttcaatggaaggaggagctaggaacagaaaacgggcattcaagttggtgttctttacactcttgacaccttgcatatcaatatccaaaatgcaagtctttcccaatttgcgtgaaacatcatccacagccttaatcgtagttccatagtagttcccggaaaacttggcccattctatgaaggcgttttccttgatcagagactcaaactcgtcaacagaacaaaagttgtaatgaactccgttctcttcaccaggacgaggacttctcgtggtgtttgaaacagaaaatccatatttacttggaaattcagcaaacagccttttcaagagtgtagatttacccgtgccagaggggccagaaataactattggacgagccatttgccacagttcgcagataatgatggtttaaaccagctaatgtcaaatatttttccaacgacgtgtattgagtggtacaccgttaaatggcaatgtatgaggaagtcctttaggttggtcaaacgaaacgaatatccagcatcaatgtaaagagcagtatacaatcttttgttccacgtataatctcttagtttcaattcttacaggaacgttcattgccggtcaactcgctgttgatcatagatagggtctcttctgcaactagaaacagtctgcgataaagatgaagcgcgaaaggaattggcttattgatagaaagaatatttaggcctcactctcaatctctcctacaactgcaccttctatcttttgtctgtcttaccacggtagttcatccaatgtcagacagagttcatctaataggaatcagtgccctgtcattgtttactggcgcttgtttgggtgccctatgggtacttaactccccttcattaggcactaaatcatacacatccggaaatgcaagaagtagccccaagtctaaatgtcaaacgccagcatcttcagattacttgtcagactttgagcacacaagtggcgagtctagttttgatgaggttgacgacgaatcagtggaactagctgaggaagaagagtatcttgagattgattccaagccattgaatgacatccctggcgaatgtaaaatggtgtttgccataaggcaagatctcaaaatggaaaaggggaagattgccgctcagtgttgtcacgctgcagtttcattgtacagaatgatgtttcagggagaagtctccaagaatttggatcttctgaagagatgggagtccttggggcaggccaagataacattaaagtgtccaaatcaagacgagatggatcttttgtatgccaaggccatttctttgaatgttaatgcttatatagtgcacgatgctggaagaacacagatagctgctggaagcgcaactgtgctaggtttgggaccagcaccaaactcagttctggaccagataacaggaaacctcaagttatattgacagccaccccagtcattttcattattggaaggggatactaatgggatatttagtatataggataggtttttatgaaatgcatctatgaatgtgcactgctcttctgtccgttcatgtttagttgtagcgaaatgagacttttatgatcactctcaagacacattctctgggtaaatactatcaacacttgtccctctccaatagccactcgtatcattgataggagagcatttgaagctcttgcaccttcaaaatgtataatatatgccctcggctgtctatgcggtgtggctttcaccgttcgggtgtcaggtgttctagttcatttttggatccctttttcaattccaatgaaagggttaggaaagatgtaaaagaaggcgacaagatgcgagggataccgattaccataaagaaaggaggcgatgtaaatctggaagaggtttcaaaacacattcagcgtccgatatatgcaaacacgatgggttactatggggtgttcaaacttgccaaagttttcaaatctttcatacgaaaggaaaacaccctgaagagtttaattgttccaaccaacttgaagaaaattgagctaaataagcctgttgatatgggctccttggtggagtttaatgtaggtgaccaggttcgtctaggagttgtcataaaacctccattgggtcatttcaaagtcaatttggtctcgtttgaagtactgacggcagagggtaaaatactggaaacgacacagagtagaacaacgttgcatgtacctaatttcgtggatgcctcctttttgtacaggattaaaaaagacaagagctatacggaatatcaacaggttcaatatgcccttatttcattaatccattttacatctcacgggttggaaattacaatgcacaggataaacgcttttgcaattccttacagtcatctttccaatagagatgaatgcaacgctgtttctgtcctaaaagtggctcagcttttgccagaaacggtatttcctacaagtatcctccgcccatatgctttgatattagcatcgcatattcacatgacgaacgagcctctttattggcaagttcacacaaatcaggatatcctttcaaggacctcaacgtctaactgggatgttaatatcaattccagcagaaccgtttacattgccaattcaagggaaatggttcagactctgagacaggttcaaaaattgtccaactcggaactgaaacactttagaaacttcattaatggagcaatatcaagatcttctgagagaaaatcatacatgttcaaaaaatacagaactattctgaattttttgaaacattttattgtatatcctcatgaccagttgaagttaacagtgtcgcaaatattgaagcaaacgctattagagaaaacagacctgaaagatattgaccagaaatacatttatcactccctgcgatctttagacattccatatgaaggaattcttaaagataatttcattcccgacccatatctctcggcaactatgatgggacacttaaaggaaggactgcatgctaccacactaactgacattaaaggtgtaagcccccaatcaaccaaagaaacattaactagcaaaccatggattgacaagttacacgagattagagaatatcaacacaaagttacacaatccactactgcttccaagaatctgaaggtatatgcattaccttcgaggtatctcgccgatataggatactcagaatactcagaatttgccatctctttggagaagataaactccagaaagtggatattcaatgtccacatccctgacgtcgtaagcttcattgctcccgattcacagttctttgagaatatggtaaacaaggagcaaccgctgataggtatccatccaaagtcagaatatattaaacagagattgacctatgaaaacttccaactatgcaacggttcgaaccatttctttccaactgattggattccttcttttgccttacgtccagtttcttctcaaatatcattaaattgtttgaccttgagctttgtttactcgcctcacgaaatgaactgggattcagtccgcgttgaatataagactgacaagatcaacaatattagaaaggtcagtttagaagacttggttgatagtttgactcatggctctggtttttctttgtttcaacagcaagaaaaaacaagcctgtccagtgaagacaaagaagtgttatcggatttccagaactgtttaatatcaaagagactatcaagtcacaagaatggttctatagacacatttatggagaaagttcaacccgtggttagtgtccatcatcctgaaaataaaacaacaacagagatcagcatgctgaagagctcctcggagaacacttttctagatttgtttattaaagatgttgactacttgacctcagatctggttggaagttatggtagcaaacatggattacctatttttactaggactcaatcgaagaagaaggacgttgccaacgagtatattaggcaaacagaaggtcagcccatagaagacggtcgaactatcgaatcaaaaagatccgttctcccagattacacagctactagttatgaacaacttattatggagaggggattcaatggagatatatccatgacagcttatgtgtctgctcttcaatatctactgccatcacaattacaattaacacctggccagaacgttaagctagggatgaaaaatggaagagtaaggttcttaggctgctttcaaagcttggaagtgttgacgaatcattaccaattgcttaaaattcacataaacgagtttgaacaattcagggagctcatcgacgtaaaaggatactattccagaaacctctcacagatatctaaaaagctaactatccaagatattcaaaccaaggtggaaacatgcactacgtttctatcatggttggagacccgtaacagacgattttggatactccaatggttaaaagccaagacacacgaaccgactgagctgatattttacaagtgcatcatactggatacgtgtcgacaccctgacattgccagggcgtattgtattgagttagacattgaagtccagatggttctacaacctgggatggaggcaattgttggcgatcgtcttatcatgacatcgatagtgtatatcagccctattgagggaattttagtgatgagatgatggcaacctcaatactctagaaccctcatctgtaaatgacataacataactaattataataattgaagaatacttcattccggttcctcgtacgagtggaaaatgactacccgccttcccccaccccacacaccttccccttccagttccttggcccaactgactctagcggttttgctctctcccattttcctttcttttttttcgctaaacactgcacgaacaaggtggtatcaagatagaaaaaaaaagttggacacagtttgacaccgttcacaacactaagcattttcttgtcttatcatcattttatttgccatcagagcattctatcattcattcgtgttattaatccattgattacgcgtgtgtaacttagaagtattacttgatcctcccctgaaaccttaaaagaaaaggagaagattgaaagagaaagtttaattgttattttctgtgttaacgtagtataaacaatgggtcaaatactttcgactccaaacgtaacgagggaacagtcgtctgatcaagatgagaaactttattatggtctctcttgtatgcaagggtggcgtgtatctatggaagatgcccacacgacaatcttagatttgtggaaacaagagaaaaacaagaagttgggcaaaagcgattatgccgcacttttcggaatctacgatggacacggaggagatgaagtagccaagtacctgggagccaagttcgatgacattgttacaggtgcatacgacgataaccaagagaaagggtatgaaagttggttgacaagtgctttcttgcaggccgacaggcaaatgttgagtgaccctcaagctcagtactttaccagtggatctaccgctactgtagtggtaatcgaaaatgacaccctcgtttgtgctaacgccggtgattccagatctatcctatcggctaatggtgccgttaaggccctatcttttgaccacaaacccagcaacgaaggagagaaggctagaatagttgcagccggtggatttgttgatgtcggtagagtcaatggtaatctcgccctgtccagagccattggtgattttgagttcaaacgggcaaatgatcttccagctcatgatcaggctgtcacagcacttccagacattatagagcataagataacaccccaggatgagttcattgtcttggcttgcgatggtatctgggattctttgacatctcagcaagttgttgatattgttcgttattacgttaaggaaggtaagccgttggatgtcattggatctgagattgttgatatctgtttagctccagactcagctggttccggtattggttgcgataatatgtctatctgtatagtagctttgctacagggaaggacgattgaagaatggtatgaatacatgaaggaaaagattcctgataatttgatcaatcctggtgaacttcatctggatctgtatgcatctactcttgctgacaagaagatttggattgaagatttaggaggatactccaacaatagtgacgataagagttcccatatcagtgacgacaatgagacgacaggtgataccaaagatgaaaatgagcatgttagagatcttattgatgagctcctgaacgatgaatctgtaagaggagacaatggtcatatctacctggataaggtcaaccctggtttgcttgcccggctattaagaagaccttcaccaagtgacgagcgaacggctgagggaacttccgtgttaaaggaagaagacaccgatgaagatgaaagcaagtagagcaaccatgcactaaagttgtaatataacgtgaaaccaatgagtatctttcagataaaacgtaaaaaaaaaaatctcaaaaaaattatacgatattatctactattattatgtaataaagactgatctacttcaatctactttgaataacttgcagctgttctcgtaagtcgtctgaattatctcctcctctggtatctccagcaatttggccatcacttgagctataatcggcataaaacatggctcattcctggacttaactactggtggtagttcgcttgggtcctcgttctgaaactttgacaatttatcactatttaccattctaattggcagtagtggatgatacctcttcaatggtttcttcgaattgttgctaggtttctgttgtgtttctgtggaaggttccgaggcaatcaacgaaaagcacgctgaagatttctttatttcacaccagggagcatcagtttctaggtgtagttttgaaagagggatacgtttcaccacttccaagttttcctctgttttaagggagcaaccgttgacactgaagtcgagtcccaacttctctagtttttccaactcctcaacggatcctgtaaacgaatgaataacaccggtagtatttcttaatttcaaaccatccggacgtgtaccctctaggaaaggctttatgatagtaataaaatcgtcacaggcagctctcatgtgaaggaacaatggcaaatcaaattcacaagctagttttaactgtagctcaaaatacttgcattggtcgctctttgaagcatggtacaatctatcgtagtctagtcctatttctccaaacgctttcactactcctttatctaatccctttcgaatcagatctctcaattggtcgatgtgaccagctggatctttggaaaattcttttacactgcaaggatggactccaattgtacaataaggtttcagtgagtcttcatctttgacttctttgtactgactaagtctagctttgaattcctcgtagcagcttttatattcatctatgatatccaatactttgcccgactctttcaaagatgaacctgtgatcaaaattctgtcaacgttattgtagttcgcccgtaaaaggacgtctggaagatccttatcgtgataatgtttatccctgtattttccatggaacattgagtccgtcaggttaactccaatatcaaaaaaccttggtttgagagccatctttggtgttattttgagtagccggcttgatcttatagtcatcgtgttgactcatcgcgagatgttgaattttttgacaggaaactcaattgatattataaattatagtgatataatatatagaaagaatgttactttaatagtgaatttatcattactcgggacatttccgtgttggaactgataactggattaatggataccgagggaaaaaaataaatttaacacgtagaatactaatttttctgcttgtttaaaatccaccaatttatattaataaagagcgttacaaagctcaaagacttcagagagttcaaaggaggttgagccaggttgaaactttgaaaaatactctaaaggatgagcttacaagtttttcttagcaacttgcggatttagctcagttgggagagcgtcagactgaagaaaacttcggtctcaataatctgaaggtcctgtgttcgatccacagaattcgcatttttttttattttcaatctcataactaattgatttgcaatcattacaaaactatcaacaacctctaacctagctggttcataacccgcttcaaatggtggatcaaaaataaatggttatctgctggattatcaatttactcaacaattgaggtcaccctccgacgccacatatcttcttcatactcacgcgattcaaatcgggttcctccgcaattaattttgcatcagtagatcgtcttatctaacaaacatctgacatccatctgctttactagtctgtcctcttctataaaaaagcctcaaagtagttaatttagagcacacaactagtcaagtatagagctagtaccaccccgtagccagtgagtccaaaaactgtccggttttattgtcgtttccgtcagtgccttaaaagatacagaatccaatttaacttacctcccctccttcgtaggcgagagcgcgcgatgcgatgcccatcgctcatgatgacatcgagaagtttgtcagaaaaactaccagattgcacccaatagacgtttcaaatcaaagaactaacagcccgagaaaaaaacgtttttttgctagaaaaagatacagataagggacaataatatttaacacttgagctttaatgagtcaaggagaacaaaccgattctaatatcaagtttacccgggtattctctcgaactccgtcctcctgggaccctcaggatgatatcctacttcgccatttaaaagagcaacagaagctgggatggaaagagattgctgcacacttcaaccaccgaaccccaaacgcttgtcagtttcgatggcgtagattaagatcaggggccctgaagtcgtcacagccaccatccccaaatgtgaccccaacgccaatatcaggttcgagctctggtataggattaaacaaacctaaatcgaacctttcagagaaaattagtgctagcaagacgatagtggccaccgagtcgtcatcctcatcagcaagtccaccgccatcatccatcaaagacgaggagaacaaaactatcaatgtcagtgcaaccagctactgggtgcccaatagtgagacaaaacctatatcaatcacttcctacaataatgcttggtctacagagagaaatatgccatgggaagaagaagaggacgagcttttactcagcaggacaaaaagagagctgagttttgcagaattgtctatcttgcttccaagtcgttccgaaaatgatatttggtcacgaatagactatttggagaaaagtcagaacgtccccgagagatcatcctctagcttcaagcttagtcaatcgcccggtgccttggctgcttcaaatataggcagatccatgtcgatttcctcgcttacttccagttattctaacatttcctcacagcctccgtccagtgtccgaagagagagctccaccagcaatttagtgggggctcccttgagcactcccagttatcctgcaagtttcaggcacagaagtattacgggagcttcattccagatgtcttcctcgttgcctgaggagtccttgatgaatataggatcaccactactaaaaaattaccccagacgacaccacgactccttttccaccgaatcctcgtccatcccagaaaagaaagacccagaaacggggactaatctcccctcaattaataccatattcaacaacacgggatgttacaggaatacttgacattttgtttttttcttcgtttgtgtattgtatcaatagatcatacttcttaggtaatcaattccttactttcctcccccagccggcgagatgatggatcaaaatcgcgcgccagtcctttcaaaataataattatccatccaaatcgtgttccaccgctcgcttctttcagtcaaccaccatggttgaagcacgctccagacgaacagctgtgctaaataacctgaagattgaaaacaataaaatcttcacactcttgcatgacgagatcttcaaatctatggatgatgactcttccaatacaaagaaacaacgacatcttcgcgagagaaagtcaactccagactataatgtcatcaataacttcaggtcgactcaagcgcgtgacgattcttctgaaccagagaatgctaggctatcacgacccagatccccgagggctcaaagtttgaagtcaagtccgctcaaatctcttattgttactttgaaaatggaccccacgcggctggctcgagttttttcagccagtaaggaggagctaccttatcgtgggatactaacctacgaggagggcaacaccttcaatacgagaccaactgcggaaacctatgaaatgtttcaagcagctttgagagatagtaagcaaatgaaaaaagaatacggggacgacaccttggtcaaaccgctagacgaagaagaactgaggaaagaggctatatcgcaaagttatgcaccattagccaaacttcgatgcatacatttcggtgataaggaaattgacacatggtacaactcaccctatccggaggagtacacttccaagtatgtccttcatatttgtgagcattgcttaaagtacacagactctagcttcgttttagatagacatctattgaagtgtgcttataaatatatgcctcctggtaatgaaatttacagagatagatgtgtctctgtttttgaggttgatggaagaaagaacacgatttactgccagaatttgtgccttttggccaaactgtttttgaactccaagacactatattatgatgttgagccatttatgttttatgttttatacgaaataaaacctgcttcggaacactattcctttgtaggctatttttcgaaagaaaaactgaactctaccaattataacgtgagttgtatccttacccttcccactcaccaacggaaaggttatgggaactttttgatagagtttagttatttattgaccagacgcgagtacaaacttggaacgcctgaaaagcccttgagtgaactgggtttgctaagctacagaaattactggaagcatacagtttgccgatctatcaaatggattatagataatgtctctccagaaatgctcccatttttgacagtatcgatatctgacatctgtgatatttcagggatggttgcaaatgacgttgtcacagcccttgagcagttagagatgttagtcaagcagcacgatcagaagtatgggatactggtggatatggaagttatcgaggaagttctcagtaactgggattcaaaaaactacttaaagattcaaccagagaatcttatttggaaaagtgtagttcttggcccttcgggtggcattaataccaccagcacgatggtggttgcagctcctgattcgaacaatccaaatggaaataacagtgaatctaaatcggcgaacagtatatccatcatcaccaattttatgaccgatgatttggaggacgaaagagacgtggaagagcaggcgctttcggccatactggaaagagtacagagtaataaagagacctattcagggaacacttccgagttggaagatgtaagttgggaggttatgcatcctgcaaccacagaaaacaatcaatccattgtgtacaagccgattggtagaccttctaaagtagttgcccccatagatgaggaggagcttggcattattttcaacgactcagacaacaacagtaatgaggaagaaagtgaggacgacgactataatgaggacttaatagatgaagaggaagaagatgaagaagaggaagattctgagaacatagacgaagcgataataatagaagaagaagaaaaggaggaggaaggggttgagaaagcctctccattgcgaaaggcagaaaatgcggataatacaaggcatgatacatatcggaggacaattagcacagccaaaaaaagacacagcaaactgaagccagttaccagaccaccttttagaaggactcgaagctcccgacttaataattagagtattagtaattacaaattcgataatctatacaaacatgccatatatctggggcaaaagttttaattttatgaacaaatgaaagctctacttcattcgaagacgacagattcaaccttatgagttcaatttgctcctgaaaattttctatatgaatattttcatggacatgaatcatagttgttgtgttgaacaggttgatcagatccagtgctgtctgccacccttgttttgacgaaggcagaagacctagatttacatggctcaggttcaacttaaacgtggaatccattttcaccacctgcttcattctcgtacatgcaaactcattactttcatggaaaataactactttaatctcattcaaatcagcgggaatggactcccctttcctgactagacagtatggatgattgttcgccttacagctcttgatcaatccttggatactccatggattaatctcccaacaataaacacggttagcccctttggccaaatagctcaaagtgaaatatccaataccagcgtataaatctacaacatcagttccctgcacatccctgaactccagtatgcgtgacttttcctttatattgcctctggagaacattgtacgtcttggagcccaagtttgatagataccgttttgaattacatggcaccagaattctttcttgaaatcttcttcggtggggttgtcgaaaccctcttcgtgcagttctggtccaaagtctccatacaatggtaaaaatcccaagggtcttctcatgtcatcagttttgataatagggtttagaattgccaagtgagaacagttattgaacaaagatagtatccatttgaagaacgattcacctgcaatgccattccacgcatcgttatcaaatgtgttggaattaaaaagtaccattggcggataaatgatatatctattgggtatgaatggtaagaacatctttatatcttgattcttatctctcaggtactgaactagcaaatttttcaaagtaccttttgatgcagtattttctggttgatgtgaaaccaaatttattgaggatgcctcttccatatttagcatgcccttcaaatacacagtgaatgccaacaagtcctgatctccgagcccagtttttagtagtactggaacagatacactagtatttgtcagtatgattctgccattcaatatttcattatcttccagaaaaagtttcagttttttaattagtgatttgtttgcagcattgcatggggatagtattatcttataggcttcactttctttattcaccggaaggaaggggatgagttctgaagacatgaaaggccctcccaggaaaagtaccgagaattaatagcctttcaaaaaataacaattacaattaaaatcataatagtatttatatatttaatacatgcacatattaattcattttcatcatattcatggttcatcaatcattatctattaacatacacaagacggaaaaaaaacgtaacaacttctagtaacagaatgtctcaacttgaagttcgtagaacagattgctgtctccttcaatcacgtttcacggtcatcttcgatcttcttatagacccatgttgttgaactcagaattcaagtcgaatagcgagttgtgctgttgggcttgtgggttcaaagactgttgctgttgctgttgttgctgttgttgttgaacttgttgctgagacaggtatcctggttgtgcaaaggactgaaatggagagtatcgtaattcgttggctggggaagcaagtggctgtccactgccagtagcttgtcgctgttgaagtgatccaggtggtaaactgggcttaacaactcgagatgagcctctcaatacagcagcattaagagcgcccaaatttgaacttgaaagtgcggggtgaagcatacttgatccaccagtagattgggcttgctgaaatgctggggctgtccctccaaggggggctaatcccgaattacccattctcggagattgctgctgagaaggtggatattgctgaccagtgtacatacccgtagtagctgattgaggcggttgtctgtaacgaccatgagtgctggatatgttggtggatccggccgctgatgagagaataccataggattgtgatctaattaggttggagttagcagcactgatagatgcagcagtgctagacgctgatatcccagattgctgaagaggatgctgaaatgactgtcttctaataataatgaatcctccctcaaaagtatcagccaaacccaaaaactgactaagaagaggcaacacacgacgcagggaagagttagctgtggtaggaaaagccaactctgagtgtctttgatctttgtcctctcggaatagtagaagctgtgtgtataactcaagagtctcaggatcattcatgtccaatccagagggaataggggttaactgtgagggaattgtagcatatagtctatctggagcattctgttgagataaaacattcttagagacattgggaggggccgaagcgacagagtaaagggaagccaatgaggcagaagacatagatctatgttgctcttctaactgtcctcttttttcacgtttctctctttcaatcctttccctttcgggtagaggtagcatctttttatattcaactctcaactttctgccgccaatctcctttccattcaaattctctacaacaaggcaggcttcgtccgttgatgtgaagtttgcaaaagccaaaccacgaaaaacaccattgtcaaaatggtagttgaaggcataaggcaaaggcaagctaaactttgtcataacgtctaaaagttgctctttttttatggcaaaagggatgttctttatcacaatagcagtgggaatgacatcttcatcatcattcgtatcatcaataccatcgagttctgaatccaaaggtttctgttgttgggataaggcatcagattctttgagcaggtcgtccttggcgtcctcctctagatgaaatttgccatcgttaggaggtgagtattgggaaacgttgacttgttgctcaatccaaggatcaacgttgaccatcggattgccgttctgaggagacagccaggcattataccgtggttgaccggcgtttacgcgcagaggattgttgctggtgttgttgacagaagacgcatacccagacgctgcggatgacatcgacgaaattgaagggcgacgttgcatacccatttgttgctgatccaagaaacttggtgtttcagtcaattgtctcaggtccatattgatcaatgtgttcaactgtttcaatctggttccggagggtggctattacgacaagctgtggctactatctaagtgggagaagtaacggaacacattgatgagacacaggaattacagggcgtgcatccaccaataacaattagtcgagatttcaaccaattacgtaagcgctcaacccttttttcgaacacgtatcgagcaaagtccaggtgaaaccttcatccattatatccaaagtcgaccgaagctttaacaacatccataatggtaagtgtccagtttgatgagtgcagaatggttccaagttttagaccagttactaatatttaaagtctacagcaattccaggaggacagagaacgttagctaaaagaagagcagcaaacttggataagaaacaggatgaaccaacctccgccagatctgccggtgctggaggttcttcgtctaccatgctaaagttgtacacagacgaggcccaaggtttgaaagttgatcctttaattgttcttgttcttgctgttggtttcattttcagtgtcattggtttgcacgttgttgctaagctgacaggaaagttgatcaactaagacctacatttaaacaggtttcatcatatctgtactatatttacaagtccactgcgtttaggtatatactaaagacattcaagaagcacatccacaacttgtgcaagtcctgtcaaatgtactagatgcttttcagaacatcctgcggtttgaggagattcctgaatttcccagtcccaagtctttctcttgtagaggtctttgagttcttgtgaatgctgaattggggttcttacctcaatttctattagtgggaaatgctttcccacaattatttgcaatgggatcccggcaactttactttgcttcaacttatgtcccatactgaactttccgtcacggttgtcaacttgaacgtcgaatgagctcagtatttcggtgacagtgtctagattctttttacttgatgttttattcgaaagtagcgtgatttgatatggtgcgataatttgtggccaggtcaatccaacttcatctctacttgtttgagcaattgctgcaattagacgagatactccaataccgtaacagcccatgtaaacagttgtctgttcgttttgttcattgactacggtgcaatctaacggggaagaatatttcttatccaagtagaaagtatgtccaacttctattgcagtatgctccgatagagttcccttttcacattcatagcatctctcgcctgcaatagcttccacgataggaatatctgtgaaagtgaacatgctatttcgatgatataagactttaagatctggcatgtttgtgttggaggttaccctggggtcaataaccctaattatctccttcactaaaaatgatgaagattcttcggattcgtttttgaacagagttaatgccatttcttcgtcaatagaaaaatcaatatctggtatctcatcttttacatattgaggatttagttttcttccctttggatagtacattatgatcaatgtattcctgtctttattgataaagtattggcattctgcttcttgtacacctttgaattgtttgtctggaagtgactgacatttttccacattgctaacggtttggcacgaattacatctaaataaaatgtcttctccggattcgtgtattaagtgatactccaatgataaatccccacctatcgaaccagaatcggcattggccacagtcacaggtaactttaggtcttgaaaaatccttctataggcttcattgacattgtcataagacttaagaccatcttctttggtcaagtcaaaagaataggcatctttcatgagaaactctcgtcctctcaacaaacctcccctaggtctcaactcatctctatatttgcgggaaatttggtacacgagaaggggtaaatctttatatgacgaacataagtcaccaactaagtttgtgatttcctcttcacaagttggcactaaacagtagtctctatccttggagtctttgaacttgaacaattcattgttgtcccatctcttagttctctcccataaatgcttggaagacaggctacttaattccatttccagcccaccagcctgatccattcttttcctaattacattttgaagctttttataggtacggagtcctaatggaagccagtgaactattcctgctgcaggctggtaaataaaccttgattgaaggagcatatcatgagtagtaaggtcctttacagaaaatagtttacttccttgaagagaagtagaataaaacctcatgttgggtctccatgaaaggttcaaaggcattgatcctttaggtacttcaggatgtttaagtcatcaaactgtccatcaaaggtagtatagtatttaccatctagatagtgatgtatgggtgtaacacaacatttaaatgttgtaaattaacattaggactgagtccggagatgctattgtcacctaaatctattagaaagcacttcagttatatcatcgatagaggtttgaagataaacctattgttgataaataaccccattacccgtttacgtagcaaggttcaaaaatttgcttagatcggagctaaaaattcgactgacttctttcgaaaatgtggattatgcaagcaacgttgctatcggaatagtatataaggtcgatctgccccattacaaattgtaaagcaacaaacatcctacgcaaaatgatcagattaaccactagaaacctattgaacagtcgctctttggctgttagaactcaaggcccattgctgatcaggcacaagtccaagatagtggagacagctaaagagggattgcatcaaatcaatttaaagattggaaaggtagccgccggaacaatcgatgccactgagcacatcgctgaacaagtggctcctcacgagactgctgcagacctgaaggacaaagcttctaaggtggttgaggagaaggtgggagatgcaagtcagaaattgaacgatctttcagagaagattccatctcaggaagagctgaagagtaaagccaatgatttgaaggagggagccagtgagagtgccgaaaaatttacagaggacgtcaaggaaacgaaagaaaacatcaagaagggcgttgacgatcccgttaagcattatgacacaggaaagctgaagaagagaggtgccgaaatagaaagtgaacagcaacgtcctgaagaccttatgtaggttttaagcgagtagttagctatttagctattatgcaaatcatatttatttatagtacatggtagttatttatgtcttcatcttctgaaattctgtagagtcaattattggttgttgttgtcgttccgctagtactgcagcggcaggttcttcctgagcctcaggcacgggtcgttgatgtcgttcaatgatttcgacgtaattgtaaggtacaaatccaaccttaccatcccgacttctgcatttccaccaagtagactcctggttggaatttggttctgtttttgatagaatggcaatgagctcacctctagcaagtttcaactccatttcttcattctcaggattgaaatcgtaaagggcccttgcaaactccaacttcgtgggatctaggttgccttgtaaacttccaccactggtaataaagtttccattcatttgactggtctcagcaagatgagcaattaatttctttaaaagatacggaaatcccaccacagcagctaaaaacaaaaggagaggtttgagggataatttattggtattcttgttaggtccaccagtgttgttactgttagacagcttcttcatctgcttttcttggaattttctgaattcatctggggttaacttgtttttcacccccatcaacttggccatgattcgtttcaaccagttgatcactgtatatattccaagcatggatcccagtgccgttttcagatgagatagttgatctgccatggatatcattgtgaaaaatgaagaatgggtggccatgtaagtagcttccaatacctgtgcgaaccctccaacagcaccaatgatgctctctataagttggaaagtagcctccgagccttgggccaaagaaccggccatccccatgccattcattccagtgttcatgcccatgccgtatcctcccatcccatagccacccataccataactacccataccgtaacgagatccaccatacatagatgaaccataaccgcccattccataaccgccagaaccgtacatggaagagccatatccaccaccgtaggatgaaccatacgagtttccatacgttcccatacccattccagatcccataccggagcccatacctatcccagtgtttgttgtttgaagggaggaagattggccagcatttaggctggagggtttggaaggtaaatcaggagctgatgagtcactcatttgatttatagattcaagcgtaacctccttaatagcttaatacaaaaatattgaagaaccagcttcttattgagccttaaacaggagaagaatcaggaagagtgaaagttttgaagcaaagggtttatcacttgagggtaattctttaaggcgaacttttcgcggtcaaacgcggggtgaaagtgtaccaaccgtaatcttgcggttagttagccgatcaattcgtgagaggctgatagccgtgggtttgcatgtgataggtcaaaggcgtaaagttagttatctaaagcatcagatgttggatgtccgatcagcaaaagaaaagggtcttcatatatgtaaattaactatctcctactattgatgagggtactataggaacaaagtgataattcaagtgcctttggaggctggaacttgtaatatctggcgagtggatcgtcgttttaaaagtcatctgtttcaataattctctctccgcagataagttttggtgatagattcctttgatcaattccttagcctctgtttggcactcaacgtgttctctcagataacgtaattgttccctgaagagatccaacacgtccatctccttattgttagtgtgtttattataaatatcttgcaaaagttctttattgttgtccgtgagagagacaaatgctgcttcaggggattcattgagaagaatgctggaaataaaacttttcaggttatttgtgtcgttggtataagtttcttgaatacgatccaagttggagttgatctttgcaatctcatcaactttttccttcagttgcatatctatatcatccggtttgaaggcttcctctgcttgctgttttagttgtgattgcaacgtgttgattttggaggtatcttgcagtctctccgatgctatggtcatctccaaagatttgagggattcttctttactatccagcaaactggttttagaatccagcttattttgtaaatcccgtaccttctgtttcaaaaggtcaatttctttggtactttcgtcaagtttcagctgcaacgactcaactagctggctctcgtgaattgacgtttcattcaactcaaaatcaccgatgtccaatttcccatccgcatctgcatcaagactttcaggagtgatgggtccttcatcacggtgagtctcatatgaatagtgcccattagtgcggacaggtgaatgctgctggtgttgatgttgataatggaccgtgggcggaggattttgatagaaattggcgtgttgctgataaatttggggagcctgtcccattggatcagcctggagacccatattttgcttatttccgtgcatcggttgtacaaagtactggcttcctgttaaggaattgttgccgttataatatatccctccgttgggactgtgtcgcttcatttgtggataactgggtggatgaagactctcttgggaacccgaaccgagaggattgttcagtcccatcatactactcgttctatgagatttcaagggaccatactttcgctttccttgttttcttgacaagttggctaatgatgttgtcttaagtccagcagaactaagtgccgaccgcgagtcgtcataagcatcgatatttgtagcaaaagctgagtatccctcatcgtagtcttcgggaaggcgctgtgaggagtacaaggattgtgtgtccatgctgttcttcttgaaaagttagaagattctatcaggaaagaattttatttgagtttaaggttaaagtggaaacttacgaatatcttacatactaaatgacgcgtctttttttttttcagatgttgattaccaattacggaacttcaaaagcacccggccacatccgaaggatttaacccctaacatctcacaggcttttccctagcaacgactagttgccgtgctgcttacctgcgaggcacagacacattaaactaaactgtaatatagagacgtatttattgaggtcggttacgctaagagaaaaacgcaagcatttttatgcagtaaacaagtaattatacaatatctggtaatattctaccatccatatccgtatcttcttcggcgacgaactcttcctccaaccactgcattaccgatgagtcttgctccaatcagtcctgcacctacacccaccgcggtagatttccaactggaacctgagctctgttgttgctgaggttgttgttggaactggggttgttgctggatgtattgaggttgttgctggaattgctgaggttgttgctggaattgctgaggttgttgctgcaactgttgagggtgttgctgatatacttgctgagactgagcaggttgtgagtattgagcttcctgaggaggagggggggctgctggacgagatgcatgggccgccttttcttgggcaggcacttcccattgtgaagcaccagtagcagtattcacgtaaaagtatctctgatactcttcgtcccattcagctacccatccttctggaagtgctgggggtggagggactttggcttttgacattattgaacaatagagttatattggtggatgtatgcaaccacagagaggaaaagggcttctttttataccaatttattgtgtgtcgccaagaggtgacgcaagattgcaggcatgcgaaggtttccttaagacagtgcatataaggaacctttcaacacaactacaaatttctcgcagcgcctcatctcaaaccgtgtgactaactaagcccgctacgtcactaagcttggagagtgagagtgcatccaaacattattcttctttttgcgcgcgcctcaccctatcatttaccttctcgctcaccgatctacatacccgattttcatctcatctccagttaacaccgaggcacagtgtggttatgagtgttttggatgatgattcaccattggatcggctaaactcgcaacggagggataaggcttctgagtatgaggccaagaagcaatctctgttggtgaagcacaaccgagaagttgtggatcatttattgtctactaacttaacaaggcccataagaattaccaaagttcatgttgtgaatgcggagatgctaagagatacattcttagagacacaattggcaccgttattgaacaacgagcggctggatttgcatggtctcttgaaaaacttagatttgacaacttccaattttgccagaacaagtacaatctccaacataggggcaatactggaagtagatcctacaccttcatttgccactgttccccctagtacgttgagaataattcctgtaatccaattggatcctatcaagcgattcaatatgaaaatcggcaccaatgttggtaatggcgaaggtgatggatatctgtcattgcaatataggaatatctttggtggaggagaatcgatatcctttgacacgaatatggcatctaacaacctcaatagtacaagtagatcgacttatttactgaactttcaatctcccatcctcaataatgcaaattggttaggaagtattatgggctatcattcttccaagttagtagactggactacaagaaatgatcaaacaatcgaagggattaccttaaaatcaatctcacagtataaatcgccatggaattatgagttttctcttgaaaacacactccgttctattgatcttttgagcaccaattcacttaacgacactcttttgatgaatgctggagattcatttaaatccagtttcaattttacatgcaaatatgatacgagagatgactcgatactgccaactaaaggtttccactctggtgggtcgatagaactgtccaaccttctcccttccctcaactttcaagagtcaaagttcattaaattgacgtcacactttcaacatgcattctcttttaacaaaattattttcaatggtctgtttaaatttggatatatacaatcattgaaccattcaaatgttcatttcatggatagatttttcattggtggtcctaacgatataagaggatttactttaaatggattgggtccaaagctctatggatctcccattggtggtctggctttttacggattatctgccagtctctttacacctctcccttttgtcgattctgaatctttcaaaactcatacattcatcaacgcaggaaagttgatttcggattcaaacttacgagatccaagtgtttccataggcacaggcttagtattcaaacatcccatcgctcgatttgagctgaactttgtcctacctttaagtcagagtcactttgattctacgagaaagggatttcaatacggagtgggtatatctttcatgtaatagtggctctacgagaaacttcgtaccaatagacaataaagataattcgtaaaggtatatagtaaatacaggcaggtcataatgtgctagttttctcacaccatttttcatgcaatgacataatttctggtataatcagagactcaatttcggttccattggcgtgttgttcatccgtaaggcggatccaatgttcaccttcttcaggagtgacaaaaacaacttctttctttcttgtttgcagcaagttaccaataacaagttgatgattgtaacgctccaatgcaccgcgtgcttttgataataaaatatttgagtctgtttccaacttaaaggaaataatcatggctaggggagcccacgagtcaacaagacgagacaagaatttggggacggcttccaagctgacacgaagttttccgtcattatcgttttggctctgtattttgtgctcaggcattctgctgtgaggaagaaagaagtcagacaccgcagctgccaggtagaatagaccattgggtccaattactgatagctcctgagaaattaattttaaagtgaataaatactggtgaacagtggtaaacggaacaaccagcaataaacctttatctctagcattctgatatttcctgagcacaacacgcatctcattctgatactctgcattaataaccacttgtccattttcatcctcgttcatgtagtctagaaaacaattggtagtatgactataatgtcttgaatacggaagtaacgagaattctctgtgcaagaatatcactgcatacccattctctaagaaatattccgctgaggttgctcctctggtaccagcactgaaattatcaatgaatctcacagtattgttctccaaaggaacagtggtaccaccactggtaaccaagacaacctttctgttttgcttgttatgactagcaatgaaattggcaacatctttggatatttcactcagataaggaggaggcttgtgctttttgaagtaattattctcatctattggttgtgcggcaggaaactcggggaaagttcggtcaattgccgtagcaggttcaaaaacagaagtgcgcactctgcttatcgtaggtgatggaggggtcatgtcaatcaaacactattctttgtaaacccttctgttctgaaagagtgatgcagatggtggggagggttttttttttgtcatcttctttgtactatagataactaggtgtgacttggtagtgtaccaatcaacagagcgcctgtcgaccgtaatgtaagggtagatctaactccgatgtgatgagtcaaaaaggtctgaaagcttatttttctaggcagtgagcacagcctattattttctggctcgggctaattaagtaacaatgggtatcatggaatttgtttcaaaaatttaaaccaagaaagactgctgatagcgaggaaggccatactagatgtgacataattgccatacgttgtatggtgattattacagccttattttcaccaaattagtcgttgaaaagcttgatgcagtcttcactttgttttggcttgaaaatattagtaacagaagactcattcatttttaaacgcaacatctaactggaccactgtgtgacttcgaagctggaaaaaaatctctccgtactcaaaaggctctaggaatcacagttgaaaccactccaaaagggctttctccctcttatgttcatcctcatcttttttctaaccagctcttgcaatttttgagaatgtttcgttctaatatctattccctataggtacgccctttcaatgctttccccacactctgcctctcttcctaacttttaggagagaatcgcgattaaattagtttttggcaaaaatttctggtttctccctcattgaacattcaagctttcccggctcaatattcaattcaatccgatcaaaagtggaatcattattcaggaaagctctagactggaaagtcatcctcttgattttcacaactacaacaataataggaataacgactactcttcttacttcgggaactttcatggatagatttaatcctcttagaaatagaaggctgtacaacaacaatcccgagcagcagcgtagcctttctttagcacttgcaaatggtggctgtattggaggactattcaatgatggtaacacatgctttatgaactcggtcatacaatgtttagcatcttccaacgaattatgtgattttttggacctaatcacaaagtcggaagatagatctttctcaaaagagctcaaacgcctaatagacaatctcaacagtagacacgggaagaaagtcgtcacatacaagacgaatcgactgctcaaatcccttactaacggaccaaataagcgtctgttcttaggctacgaccaggaagacgctcaggagttttaccagctgataatgcaacaattggaaaaggatatcaaacccgaccaggaaaaaaagcagaaagaagtgaatcctagggacctttttgttcctagaacgaacgatatggtgtacggtttagaaacccttggagcccttggaaaatgttacgttcctgcgttgcaagtggatccctcagctgttgatgccgaggagaaagtatatccgctagagctactaaccccagtagatggactttcatgtgaaagaattggatgtctaacgtgtggtgaaatgggaggaatccgctattctacgatatctggtatcggtttgaatctaccgagtagtaaacaaccatcaatctctctaacatctttgctggacacttggattgctccagaagtcattgaagatgtggagtgtgttcggtgtggccttcgccaaattaaacaatttgttcagggttctcttgatgctgcaagcaatgaaaaactcagagccgtgtttcaatccagaatagatgagatagactccgaactttcaaaacccgtcataaacgaagaagtttacaaaaaattgcataccaaaaacatgatcaaaaaatccaaaaaagtgaagcagatattcttttctcgtcctccacctctattatgtgttcatataaacagatcggtttttgatcctaacacctatatgatacgaaagaacaatgccaaagttgttttttctgaaagactagacctctccaactatgtggccgtgccagatgatgttaacatggatgccagactgagtttcagaaaacaagatcaaggaaaagaaaaatcctggacacaagagttttcagaagaagagcacgggattcaagatcaagatgaagatgacgttactgatgttggcccattaacatattctttaaagtcaatcatctgtcattatggtactcataactatggtcattatattgctttcagaaagtatagaggcgtttggtggcgtatttctgatgaaacggtgacagtttccgatcttcaagaagtactgaatacgtcgggtactttcatgatgttttatgagctcagccaaaggaatgatgatagggacactataaagtctatagatttcaacaacgtcgagatcacagacccctctgaagaggtcaaaggacaggagactgatcacagaacaagatccaaccaattaacaacctctgatgtcgatattgatggccttccttctgatcttgaggcagatgaagcagaggagcattctgactccgagtcgccatcggagtctgagtcagatcaagaatccgaatatcaacaacaattggattctggtgaaagcataataggtaactacaacaacgatacagagaatacctcttctgaagaaaaggtggatcaagcattgttacaagctaatctataatatatacataatagtggataacttattctttcctcgcatttcaaacttcccgtatgtcaccttgtaactttttgagttcttctagttgctgttctctttccaatttattctctttagcaatcaattcgtcaatgtcatagtcgaacgaattagggtcggtgttggtggaattagtagatttggcacctcgctttcttagtgttgacgcatcagggacgttggccttgaatttcacaggcagagagtctgctgtgagccctttaagtttattcaatttgctttcggagttgttttttatttgagatcgttgttgctccaattcttcatctggtggaagatatccactatacgaacttgacgctcctttatcggattcatttaaatcttctttctttttctcaacaatagtgtatgttccaatattgttcatgagagggagcatgatcagtaaaaatactaatgcaaacgctattataatgattagcagaaacattttatggttagcaagtgatgagaagcggcatgcaacgaatttaaattagggacacatgcgaaatgtcctgcgcgaatcgtaaagaatcgtaaagagttgtgaatcttaattttacttccttatgattacaatataaaacactatgagtacaatattcagttttttcaatcagtcatctatgttctgaccaagccgctgagagctaaatatatcttggacagattgggagtaaagctcgtcattcatttctgttactggttcattcctcctgtaagcttcctccctctttagttcatccatcagcggcttgatacacagtttaccacattcagttttgaaatgtctacccagcgcatctgttcgggcaaatcttttttcacagccccatgtagttactccgtcagacaaaacacctttgcagcaatactttcgttcaccactatgcagatcctcatgacgctttctgtcgtgagaacgagcaaatgccttcccgcatattgaacactggaaaggcctttcatcagcgtgcgtgcgaaggtgagacttcaaattatatggtcttgtgaatctcttggagcagagcgagcaagcatagatggaagggttcttttgcggcgtcttggagcttggctgagaagctgccaactcaagagtcttttctctgctcataacttccatatgatgatctgttgcactgtctctagatctagacctggactttggcggttccctagatttagaacgttctttcgagtttctagagttggactcggatttcctcctctgtctaccttctctcattgcttgaaactgatctccaggtaccaaaaacgaagacgtgtctaaaactgaggatatttgtggaatatcatgttgtctgtcatttgaactcaacgagtttgacctggaatgtttgggtgtgttatatggagatgaatggttagattgagaaaaagagacggggtatttgctgctatatcatttggggcttgcaagactttgattatgggagtctgaagttgtataggaggactgagagtatgaggagtctgattttgttgctcttgttgttcgagttgaagctggtcttgatgaattaaatttgtctcagtgagtctttctaatctgtggtgtaactctgaaagctcttcgtaagctgcctccgtttttatctgattcacgtaaggctgtgacgtttgatctagctgtagtgtttccagattgagttcgtttctttcatcactgttcatagataagagagcaggagacaatgaggcttgatcatgaagtagcgttggaggggtaatatgggaatgagttgacagctccgataagttggagatggagttggtcctcgatacggcatcagcattcaagtattggttgaagtcttgggcgcttctggtttcctgatcattgacggttaaatgcttatcataaactggttgcgattcttgatagaaacaggctgctggtcattatcaaactccagttttattttcacctgtgctggtataatttcctggtatgaactggttgaaaaactgtctgtagcttcaaaagaagcgtttggaggaagtgaatctctaatctcacccttagccggaggaatccaactactcattaaaccgttgattgattcttcgattgaagctgactcgataggagaaatagataagtatctggagatatcaaactcatcctcaagccgttggtctgccatgtttacgctccgttcagggcaaatgaagtatatttggttgtctcctgtgtagattttgacccaggaggttcaaggctaatagttcatcgattgagtggtacactaatcgcatgaactgaaatatctttaatggagtagatataccggcaaaatcaattgaataactgaggatggaagagaactacgcattacaatttgtatactcctaaaatatacatgactgttgacttttgagccttgaatgagtcagctttttactcccaactttatcccctgtccctatttttgttttggtattaacgctatcagtgaacggattaatcgattgacgcacgacgtcatggctctccgcgaaaaaaagaaatgagtaatttattgcaaaggagctttgtaaacttgacgctaaatagataaataatatattggttagtacacgagatggttgattaagaatttcatgtcctaggtaagagacactccaatcactagctatataattccacaaccactgacaatggatggctattattaccaacccccaatggttcaacaatatggctatgtccctactcaaccagtgtactatatgggcccacagggctattattcacaatttcttccacccattccggggagtcaacaagaacaacagttctataatgcgggccaacccaaccaagcaactaatatcacgaacaagaaggacaaaaaaagacttcaaatccagaacaaattgataaaaatggaggaaaagtttcaagaagaaaaggatttcatttatagaagcaatcttcatgatttgcagtatgaaaggagtactctccacgccgacgtcaatgaggcatacttaacagagatccgtgatcttcaagaaatcagagatgaagagctggtaaggctacgtctttgggaagattatcaagtgagttgcgtcacgagacagtttaatgaaggctatgaaaaggccaacaaagagtatgacagattggtcactattttcaaaacaaaactgaaagagagaattgagcacaaaataaaacaacttaaagaagataaggtactaatggactttagtagccatttgccaaagacgaacactcgttctcataataacgtcaatggtggaatatttggccttacccccggtaacatttctgatagagaggtcaattctaacggctattactcttccacggatagaagatcacgccgtaggaagtttgatcataccacagataacggtgaagactcatacgattcaaatgataacacttctggatctgcctcgaacatttccagaagatccaagatgaagaaaactggtggtaatacatctgcaagatcttcatctgacactgacgacactttcttgaccgacgatcatgctttgaaattgttatttggttcagattacgagaagccgaaagataaaccctctactagacattcttcaaaaagctttaatggagtttcaagtcttaaaccagaggaattaaacgaagacctggagatcctaaggagtgctatccacactatatcgcatacaaagaagatggctagtaagtaatgaagttacacctgattctctgtatgtctccttttttttttttttctttttgtactctgtttccaatacctcgctgttagggtgtttgacgaaagatgaatgttccacaaatacaaaacctcaggcaataatgtcattccgattggggtatatacaggccattgtactaggcctagttctactctctgtttgttggacgattgtaattaggcctgacccatcgtctgctattgatttagcctcccctgtcacaatcgatttagaaaactcacttaccaatttgaaaagttttcctatttcctcccgtaggatatcatcaaatattgatcatgtgtttcaaactgggtgtaggaatgttttcaagaacaaaaagaaagccaacgctgccctcgttgttttggcaagaaattccgaactggaaggtgttcaaaagtcaatgttttctatggagagacatttcaatcaatggtttaattatccatggatatttttaaacgacgaagaattcacagagtcatttaaggatggtgtgatgaatatgacttccagtggtgtttccttcggcgtaatatctaagccagactggaatttttcagaagaaaaagacaggggtagtacagagtttttgaggttcaatgaattcatccagaatcaaggggatagaggcattatgtacggagcgttaccctcctatcacaagatgtgtaggttttattcaggatatttctttaaacatcccttagttgccaaattgagctggtattggagagttgaaccggatgttgagtttttttgtgatttgacctatgatccgtttttggagatggaggcgtcaggtaaaaaatacggctttgcagtgattataaaggagttgtctaatactgtaccaaatctgtttcgccatactcagagtttcattgagaaatatggtatctcagtggacgagaaagcatggtcgatttttactaaccggaggtctttcggagaaaaagaatctatgaagctaattgacaagatacgaattaatcatttgctttctaatttcagtggaggtattggcaccaggttattgtccagtctctctagaatgaaccttcctacttcgttctcttcgaaaaagccttttttctacggcgaagagtataatttgtgtcatttttggtcaaattttgagattgcgagtaccgatttgttttcatcaccagaatacgaatcgtactttcagtttctggaagaaaagaagggcttttatcaggaaagatggggggatgcccctgtccatagtttggctgtagcgatgtttctcaacatcagtgaaatccattacttcagagatattggttacaggcattccaacctagtacactgcccaaagaatgctcctgatgaattacaacttccttacgttccagcatcaccagagtatgcttccagcgccaaacctgacaaaccaccgagagtttcggttagggatgtttttaggagcggtcggcaaacggaaggagtcaacaacttgaatcgtggatctggatgtagatgcaactgcccgaaaaaatacaaagaattagaagatagtcccagctgctgtattggcagatggatggtattaactaacgataagtataaaggcgaaaaatacctagataaatactcaatggccgaagaggtcaagcagactctaagcaagggtgaaaaactaaacgttaaagagatattgaagaggcaccacaagtatccaacatgagaagagaacccagaaagagtcaaaatacaaactcgaaaacataccgattggcagaataccagccatacattacatttgatactaatatacataaaatacactaacctccgaaaccatacaaggtacgtccttgtcttttcaaagcgtagacgacatccagagaagtaacagtctttctcttggcatgctcagtgtaagtaacagcatctctaatgacgttctctaagaaagtcttcagcacagctctgacttcttcgtagatcaaagcggaaatacgcttaacaccacctcttctggccaatcttctgatagctggctttgtgataccttgaatgttgtctctaagaatctttctgtgacgcttagcaccggattttcctagaccttttccaccttttcctctaccagacatatttattgattatttgtttatgggtgagtctagaaaaggacgcactcgtcttgtatttatagatgaaaagagttaaggtggacaatgcagtgccaaaccgtaatgttgatacgacacggtacgcgatgaactgagccgtactcctagaggcagagcgtgcgtaaatttgaaactgtaagaacatgtcccatttctatgctaccagaactcataataaacttgcatcccatttcagtcgggagtgtcgcagtgcgaaatactgttggcactgatggcaaaaagtgccaaatcgttatctatgggagactcttataaatatccagatcctccccctcctgcttcttcttgtgtctatcgtagtaaaaatggctagaactaaacaaacagcaagaaaatccactggtggtaaagccccaagaaagcaattggcttccaaggctgccagaaaatccgctccatctgctgctggaggtgtcaagaagccccacagatataagccaggtaccgttgctctgagagaaatcagaagattccaaaagtctactgagttgcttatcagaaagctgcctttccaaagattggtcagagaaattgctcaggacttcaagactgacctgagattccaatcttctgccatcggtgctttgcaagaatccgtcgaagcttacttggtttccttgttcgaagatactaacttgtgtgctattcacgctaagagagttactatccaaaagaaggatatcctgttagctagaagactgagaggtgaaagatcctaagtgtaatgtagtgtatattaatcgaatacgatatttaagggagatacaaactggctgtaaggtgaaattcggtgttgccgatggctgtgtagtgcacgcttactcttgcgattgtcaagaatttcctgcttatgagggtgaggtagaaaagaggataagcaagtgaaaagtacacttagtatgatacttctaataaaaaaaaaaacaccatgtcctcgatccaacaacaagcttatgattacacggccaccccatatcctgcctggttgttttccacatcacttcttgtaacgtcatggcttcccaagtccgaaattccgcagcaggcagttagtcctggtcgtttctcattattcaagttcaagacaaagcctgtcagtgccctgccaaccaaagcatcatgtttgctctttggtgccaccgttggatttggtggttttatgatctatgataatgatttggtcaatggttctggatttgtgagtgcgtggtcaattctctattctttggttaatgctagaaagggtatttggagcttaaggctttggcctaaagttttggtaggccaggcattattcacgggtcttttttacggccaaagattcttctgggctgacaataagagaccagcacttaaactgaattgatgctaaatttgatgcgtagataggttatagtttaccattctatgggcagccatttattctcaatggccatcttttctacttccgtatcatcgaacatctctatgaactgttgatcaagggctctttccttgggagcagcaaactttctgtactcgtcgaatatcattgtcaacgaccatttttgcaatttccttatgcatccacttaaacatcctgttctatgtttgcctctgttgcaatgtattagaatggggtggttctctgggttcaaaactatcttgagagcctgttctatcaactggggctttatcttgacaaaaggctccttattacctgacaaccctacttggaaaaattgaatgtgttgttcctccaaaaactctctgttttcctcggggtagtcctccggtatgaggcatattacagattttagatttatccttttcaggaactcgaagttctcaatcgtaggaaagctggatcggtagatattaccacagaccggagagaaattctttggaggtgtcagagatatagaactcgtaggtgtgcctggtacaattctttctgtttgaatactggatgatggctccacttgaggatccaattcctcgtctagctcaaaaacatcagccattcgtttatgtttggtgggatggaaataatgaaagaaatgaaaaacgaaagatgatgataatacagtggatgtcgtaagttgatacaactggaggtggtttgtttctatggtaaataatgagtaaggcgactgaacggaaagcgtaagagtaaattttggaatagaaatgacgcttcgctaaatgttgggagggactatcagaattccctgacttccacaagaaaaacgcacactacacctaaaccatccatcagctatggtaagtaactctacgaactgaaaaacatgacaaagtgcctaacaattttcgactagtcagctctattcaatttctcatcgttgttgcaagttctcatattgatgatctgcacgtgcacttacatccatggctcatggcccgcagtgcttgacaaaaacaagactggaattttaggagtgtactggaagtttgcccgcataggggaaagaatgagtccatacgtatctatatcttgcatcattatagccataaaccaattaaggtgagaggaaactatttaaactcgaacacttcctgctctgcattcaccaacaggctggctctctttagaccgacaatcttttccagtttcaaggtatcaaatcggtcaaacataaccttaatagaacacaaattgaggtctaattcttcatcttttagtttgtttcggactatttgtctgactacttgagcgtagaaatctgggtccgtaggaaggttgtagaaaacaacgtttctgacaccgtttaagttgtaccttttgtaaaagtgcattcgctcagtgtacaacataatggggtatttccccttttcaaacaatgacctattcttagaagatgcgctgagggaggtgtattcatcgactgctaagaattcggatcgtgattcacttaaatgttttttcacttggatgtaatccaaataagaggatatgtacaccaaagtacctgaagtatatggagacttggtcaacacgtttggcagaatcaccttggtgaagaaattaagtcttttctttggtgattccatgggagatgaactagggaatctcataaacatgtgatttaacctgatatttttgttgatgattcttgattgaaacaattggtagttcagctgattcataacattgtttgtatcgtcaatgattggtttataaagagcatacccttgcaaattgggtgctttaacgatattgttcagctctggagtagtatatttgctgaatgatagcacttgatggacgtattttgcctggtcattaatacaccacatcctaattctactaaaatcacagttcaattcttcaaaatttttcggtgcctgaatcaggctcttagtgaaaatttgcttgacatggtcccagttttgcatcagtaatccatcagccttgtcaagaatggttacctcaattgacgataagtagtcattcttttccttatccaatagcattttcaatcccaaaggggaagcaaagatgatatcggactgcttcaacatggagtagatcttcatactttttcttgtgaatttaacaccaagagtgaagaaatccgaagagtttcccctaaaaaattcattgaaatctttgggtttattaccgttcaaagtctcaatcttgaaatcactatagaattgggtgttgaaacgcttcttgttctccactgtctttatatcagccagtttgattaacttgttcattaagttgaagcaaaagttcctcgtaggaagaagaatcaagattttgggccgagtgtaaccctgatctttaaactccaaattaggatcagcagagatcttgttattgtgatcgaaaattctatcccttgtctttagaaggtggttcaaagcatgcaacaggtacaaactttgataatctgtttctcttgtatagtattgataatttatgttcttgtagttgaatatgtctagggtcaactttttatctaattcgtctttgaagtcaagagatgagaactggtctctaagttttttttgattcgcagcttgtcaagtgttttgacttcattaaggcatctggacgtgcttggcagatattccaaaatgttgtatccgttatgattgactttcctatccattttgactttcaggccagatgattcgtactcattgatcatgcgatcaatgctttcctcttcgttaaaatggaaatgaaaaggatcatcatgcgactcatcatctgactcaaaatcttccaaatttatttcctcatcctcctcgtcttcgtcttcgtcttcctcttgaagctcctcttcctctctctcttgttcctcctctaactttttcagggccttttctttctcagcgtgaaattgttcatgatcagattcatcgtccaaaagtgttaaaagtgcatcataggccattgaactaggttgtggatcctcctgttcgtcgtcttcctcttcgccctcatcttcgctttcctcaactatagattcgttattatccattggagtaaactttgaataattgtttttgcctccagttcgtctcttgacactccttacagttctcagttcttctcgaccatagtgagatctagcatgctttgatctgtttctattactattggcttcagtcatttactaggtagaagggtttagagtgacaaaaatttattatttcgagaaacaaatttcagatattaaagatgagcggctttccaaggtgaagtgtttctcgttgaaggttcgcaaccacgtactaaactcttacctttccgaaatgaagtagctgccactaggaattactacgtaggctgaaatactactacctgaggaatttgcaacgaagtaagacattagtagtggaagatagtgcttcttgggcgaatgtctataaatattctccagcaaatcgaatcccgcagtttcaatggtacctcttcacgtggctaccagttacttcaatccttataggactaaataggtagcatccaaggatgttggtactaaccctgaactgcctgcacagtaagaaaaaagcttaccattaatcgcgatataactgcagctgagaaatccttgaccaaacgtttcttgaccctccttcttctccaaacaatgcccaagatacgctccgaaaatatcttagggctgcttcgtgttctgctagcaaccctttacttggtgctgattgtacttacaaccccattgtcgtttgaaatcggaggattagaatgtggactgagttatagcatatctatccttctattgtacttcgtactagctacgattagagtgttaaagtgcaacaggatactatcttcctttttgtattatttacagcacttgcttttaccatctttgttgtttacatttctctcttatttcaaagagaatcataggcttcttacaaatgatatcctacagaatatttggtggaattatatcatctcttcgtggaagttctttttagtcaattcgacccctttgtttatcatcctagaaggattttgctctcttttattgattcaggcagtgggccagatctcaacttggttggtcagaaataaatccgatacactttctatcctcaatctgatgttaagttccattattatatcatcgtcgctgtattttgtgctcagaatttacgtttcaactactattggttcactatcagcttctctgttggggtctattcttactttaaccactattttgtcaatttatgggatcatgaaaaacaaagcgtcgcctttggagtcgtcgcttttgatttcttatattgtcaagtgcatttatgatttgttccccgagctgagtcaacacaatataaacaacttgataaaatttatcatgaaagaatttacaagaattaacgaacactctatgatgatcaacaagaacttcattacttctctttccaacgcctatcacaactacaactacagctacgatttgaccaaactggaacaatactataagatcgtcaaatatttcagcaataagacttttgagtttttgactgaaagctttccacagtcatttgagtcaatttgggagttcctaaagttatcaagcagcaatttaaccttgccaatcatcctatcactggcgtaccgtatcggtgtgttttttgcagctacaaagataattccaatcttacaacccaacaacaggaatttcaagaattactatttgaagttgatttacctgtactctccatgcataatcattgcggtgtacactaacttgatgctccaatataatgatgaattagacaaagagaatgattcttggaattgggtgattatcaaactctcaaatttcggccaaaaatcagggcttttcaattatgaaccagtggtattgaaagatgatgtacattcatggcagttttggaactggatcaatattttcctcgtattgtccctgtacttcatagagttacagacaaacaatccggacgataatttgactagtaattgggagacatagaactttacaggttttcttctcccctatagtttacttccattccatttctacgagctacatttatgggaatggcgcaacacatgaatatgtcagatttataatattatgtatcatatatttactcttgaataaacctttcagaaaaatttgcaactctcgtctctgacatgtagaatgcctctgagcttgactctatgtttgctataatatctcatcattaaggtctagaaagaaaagcatctccagaatcccataaccctataggagttccatagatgcaaccagaaaggcaaaaaaggaaggtctggcatatttgactatgctaatctctctgaaaaagaacagacctgtgataaaataaaaaagttgatccatgccacaaagtaagctccattgggtgttagctggttaggctaaaactgtcataactatcgcttaggaacgaaattcccaatgccgaaagaatgaaattgaaccgattgataataacaatatgcaacaccactgaaagagaatactgcccaaaaccctgcggataaggataaatctgttcgatagcgtacgatcggcaacaagcaaacttttcaactcagctcaaaagaagcattgaaaagattccagatgcctttctgcacacgaataaacgtatcccaatatcccaattctaggtagaaagaacttcaatggctaatgttgacactattagtccaatcggtgtaatggcttatattagccaatggcgcttgcacctaatattttgaccggagactttccccaaggctgatatgattatatactaatcctttagcaaaccttgatgacaattctttggacatggataagaagggaaagggaaagagagaaaaattttcccaatttataggttgaagctttacttgtcgcgggtgacatttcaaaggatccagtgtagatggtagaccgatagggataagccaattgggcggaagtcctcaatgaaagcaattgaaaatctgccaggtgctatcgtggagtgctactgtgactatccagtaatattgaatgagtactagtaaaagatctgccttaattgcttctttgaaaaactatcctctaagtggtcactcatcctggcttagcctccagactatgtcaaacatcggccagctgtctctatagtcgggttttccattccttgaacttctttacttgtttatatagggataaatcagaagtgataaccattgaagtcgcatctatttttgttccccctctttcttctcgattcttacttaatcatccacctgcttcttgatcttctttctctccactaaacgaagacaatgtcggccagctattggtctagctcgcaacgattacattggcaattcaccagaaacgaactcaatgaacacagagaacagatacaagcattggaaaagaacttaaacgtgccaggctctgatctttccaggataaatattaagtatgacaccaatatgagaatctatctccataacctgatgcataaactgggaagaaaactggtattaagacaggttattctgagcacagctgaggtatttatgacccgattcttgctcaaagtttctatcaaagaagtgaacatttacttgctggtggcaacttgcatatatgttgcctgcaagatggaggagtgtccacaacatatacggaatctagtaagtgaagcaaggaattgttggcctgaatttattcctaatgatttgacgaaactggccgaattcgaattttacctaatagaagaactggactgtttcttgctggttcatcatccatacaactcattgatatcaatagtgaaagatgtcttgaaagatccacggtataatattgccatcaccactgacgaattgcaaacatgctggtcaattataaacgatagttatatcacggacatgcatctcttattccctcctcacattgtcgccataacatccctttatatgactttggtgacgttttcaaaggattccaaaaagctacagacttttgtgaaatttcttgcccattgcaaagtggacttggacgagatcatagaaagcacacaagaattattaacactatatgaatactggaatagttatgacgaactgagtctgagaaaggcagtccatcgtcttctcctaactttgaacaacagtaaccaataaaatagaaagtggtacccttccccttttttgtcatactcccaaagctgtactggatacatttttaagacatttgccttccctcaatccgttggtccaacttccaattcgaacaccatgtactttttttagtcctcttacgtaaccatctcatgggctacctcgactgtgaatgttccagggccttaaatttttcttttcacacaacacgcacatacacccaatattgccaagttaacaaacacaaatgggtgttgaaacatcttcctctggaactcaacatttcagtgatgacggttgtgtatcttcaaggaagccaaatgctactgtaagctttgagaagcctgagcgtgctaacgagctgaagaatcacaaaatctataaaaagtccaaggcttcatggttacagagaaatcaaattttactagcatcttcattgttgaacgcgttgttcatcttaaagcaaattccctcatttcaatcactcgttaataaattctttcatttacagtacaagaacttagatggtacttatgatattggtaaagacgactattttttcgttatttactggataatcaacttgactattattcgcagtgtcttgatggattgggtcctagaacccttggcaattaagatagttgggattaacaatagaaaagctcttaccagatttaaagaacagggttggtctttattctactacaccacgtcatggactgtgggcttctatttatactacaagtccgactattttttcaattgtgatcatattttcatcggctggcccaacaataagctggatttctacttcaaatcttactacttgattcaaatgtcatgttggctccagcagatcgttgttttgaacatagaggagagaagaaaagattatgttcaaatgttctcgcatcatataataacctgtttgctgattattggctcttactactattactttttacagattggacacgtcattttggttatgatggacattgttgacgtttttctcagtcttgccaaaatgttaaaatactgtggttacagcactctctgcgacgtgatgtttttcatattcttggtttcatggatagctataagacacgtgtgttacaactacgtgttctggcacacatgcaccaagtctagggatctaatgaacgcagattgttccaggtacgcaatctacggaggtcccttggacgttactccagtacgatgctatacagatagtaccattagatacttcattttccttcttggaggtctccaaattatcacactaatctggatgtacctcattctaaaagttttcataggggtaataacgggcaaaggtgctgaagacgttagaagtgatgatgaggagagttcttgaacttttcgtgggagaattgtttttatatataaagatgcatacatttgaagttattatttagagactgcagagtacagacatactaccattgcaacaattccgaatacgccaagggccaaagaacaatacttgtacactggcgagtgaaatacaggatgaccatagagcgttgcgttattattggatcttaacaacttgcttatatcttgatttttagagtttaacaatttgaaaccaaaaaatcctggtagagtatatgagattgaagtagatcccacagcgccaactatggacaagacaagttcgaacttcttgatcgtaatggccaaaaagtaacttaaaaatagtaagaatacggtcaagtaggtaaatctcttaccagatattgtaacttcctgagctgaacgtggcaacaatggatccacttccgattctgcttctaattcggcttctgtttcggacctagttgttctcctcaagaatgcttcataaatattattgaacgaaattcttgccgggaaaatcattagaggataagacaatataaccataagcactaacagtgattgacctaatctggttataatagtatcggggtatataagcatgatgtttcctgagatgtaattaccgaaagtcaaatagcctgctagtgctacagtaacaaaaatcaagtatgaaataatggtggaaacgaggttgattttcaatagatttctcaatgtcgggttggacaattcattggtaatttggtaaaaattctggtggcctgtgtatgctagaacaacaatggaaaaagtcgatgagatggctttgaaagattgcggtttccagacactaattggctgtctttcaggaaagccttcccaatttgtaagtaatccctgtaaatagtttccataaatgacagccacaaggtatacaatcgctaacaaagccactaccgacgtatatctcaatgagtccaacttctttaagaaacttgtaggaacaataaatattgtggacactagaatccaaaatattctttcatcaataggcaaattttcaattggtataatatgaggcatcaaatctcccgtcaacactaagtacgataatcccactccaaaacactgaatggctatcgcaatatcaaaaacaacagcaaggtcagggtaagtaatttggcaaacgttgaaaaaacttgcttcacctggtggtagatatttgctacttactccttgcaagaagaatccgtagccagcgccaatggcagaaagcaataaaatcaccattcccagtactaacccatcagttctcaaagcatacggtaaagctagcaacccagcaccaatgatggtattcaacaagtttatgatagacgagttggtagtagctccactcatgctagcagttgttcaaagttgtatgcgatctctcgttgagatctgcgctagtagtactaagcgacgtgctgagttgacgcgataattgtatggagcacacaattccaagctcaatcaacagcttaggcgcgaattgtactgataacaactgttgtagccgtatagccaaaaaggtccgttatcaggaactgaccagttgagcctcttgtctttgagcctgtaagttttgaaacagaaattgcagcagttagtaagcagagagatcaagtggccacttgaaagaaagagcagaaaatacctgtaatcatactaccctgaaagttcaggtttcacgtgtaaccactacagttgaaatctgagtgcatgtcaccgaaactcctttcaactactgatccctacagtattctctctcaaagtagttagcactgaatatgaatcaagacttgctattggaaatatttcgtttcctaacgccatcacagatacgtgaaattatcatcgaatttgggatcaaggagccatctttcattacctatctatttcatgtcaaatactctaattcccacaatacccttccatattcgttgacaacacattccaaaaatgggccaacatggctagaggatctaacattggttcattaccatgagaacgaaagcttccagtcttgttattgtgacgacacggagaatgttcatgtcctcaatactactcaaaatgttaaaattcctatgatgagtaaaatcaaatcacaggagcggaccaactgtcgaattttgggattaaatttagaaggcgaattgcagctgttcgtcaatgactccctctataactttttacatcaaactgaagagttgcaaaactggatcattcattgtagcaaagttcaaaaaccaacaatcatttacccgcagatcccattgattcctgaaaaagtggaaaacttctatccaattaatggggggaattatctgatgacctttcaattcagacaccccaagaaaggtatgaagtttatcaactttacaaacaaggagaactattttatggcaattgactccaacttgaatttgtggatcaatgcttatgagcatcctctatctcctatggtttgtgtcaattatgatgtagatacaaggatgtttaagtttccagaaagcatcaacaataacgacgactttaattatgatattaaggaaaaccccctattatgtcaattgcacatcaatgatcagtatgatcattgctatatcttgcccaaccagggattcgtattctttaaaaatggtctgagaatcaagtccagtattgattataagccggtactgagtcacgtatcaatgagaccctgtctagttccattcaaagaatttgaatatgaaccggtaaattttgctattggaaatcattttattgtggtcttggataaagggaataatttgagcatcgttaatattgttttggattactccgatcatttaaaaagcttgatatacaggtatcatccggatcgtattaccatgctgttgaacgaaccagtgaaggatatcagagtcaaaaatgatcgagttctagtttggtttaagaagaaaatatctgtatttgattcgagtttggggctggattttagttttgacctagattttgaatctccggtatggaatgtgaagcttgccagaaataacagaattttaatatttttggaaaatgggacattggtgagatatagcggtagtaacaagattcaatccctgacacataagattgagcatctctcatctcattctgaacataggggaacttgtttctcgtggaacgatcacgattttgcaggcaagaccatggtcagaaacattatcgatatggatgaaaatttgatcgtgctttcaggttcttcctgaagcagaaacctgaacattgatcttcagtataaatagtataagtggaagtatgtgtttattcttggctgacctccactgggtttcctacgtttgcgaggattttctgcaaaatgtttagtctaggtaagagctttgggaatataaccagcagtttgattttatcgttcttcctcgttacagccaccatgtagtatacaacttgatttccttgaaaagcctcattgatcacaatatcggagaggtattcattagaaatgaaatgcgaatctaatgttttggagctcctggcaataccatcgttgatccgtgtggaagttatttgtatacccgtatttggaataaccaacagtgattctttgatttcaaagcttaaatactgatacaagtgatttgccataatgagtaggccgattacagacccaatcgaataccttgcgtccaactgaaaccgagagacaatcaatatggaaactccgatcgacaaagcaaaatagctcaatttcatggtgtgcttcaagatctgcgagtaaatgactacatgctcggtgaatgaagagttcaaacctcctttggggaatacatgatagttgtaccggtctttattaacatacattaagataaatatcaaaaaaaaaagttcacgtcctcccccgcgaaggaatatatcccatttacccttgacttactgtctcatctaaactatgctgcttcataccatctatggtaccgacgaccgtctgattggcacgcaattcttgaatcatctgtgctctggtaactttcttcgttccagttctacggccaatttctctcaatctctgagactcaatgtcctctaatcttgacttctcttgtagctccttcatctccttcaattgtctttcgtgattcaccttcagttccttcagttcctggttgtactgttccaaagtcttgaaactattattggtatcctgacaatacttttctagattcgggggcagtttacgcatcagtgccatgccaatcaattcaggattcctcctctcttctaaattaaacttattcttgacctgttttcttgtacgatagggaaacaattgttgaagaatcgaaaagtcagttccccaggacgctaacgcttggtagaaccttaaagtttcttcagacgaccatcgctcactgtatgtaaactttccgtacgttccaaaattgactggattcttgaatttgttttcttcttcacgttctttgtcttcgttgccttcatttttgtggcggtttaacataagtgattcagagtccacaccaattgtaccgtcttgttgaatctgcaattgcactgtgttaacggaatttgtagatggagcctctggtgccaaaattttaacagtggaagtgacctcaagttcattaacatcactgttactttgtacaatcttcagcctttcttcttcgatcttcttcttaacttcttccagagtagtattttcttcccttgccttttctctgattaatcttctttctgcagatttcagtcttcgggattttagagcatcttcggctatttcaaaattatcggaaatttcaccgattggcagggctggcttgcacagctctgccaatgagatgacattctcatctatgcgcaactttgacaaatctccattcttcagaaaacgcttgtccttcaaaagcacattgatgttttgtaccattgctagttgtttattaccttcagttgtaaacattatagcaactttcttactgtgcgtttttctgcgtttactgttcggttcgttagttataggtttcttctttgacgcaccgggcgtaccatccgaatcagaagtgagttcctccgagtcttgaccatcatcctcctcacctcttgcatgcttggaggatccacttaccttcataacccttcttttatttttggttggaggttttgaagtgtgtatatcctcattttcgtcatcaacgtcgtcgccttcgtctttctcctcttgcacttcttcggcttcatcgacaaataattgagataacttgatgttttccgctgatgacttatctgtcttagttttcagtatatcggggatacgcacactcttgggagggaagctggttttattgttagatccagaggcatttttcagtagcataccagtacccaaaccggagctaatggaaggtaaccttttttgcctgaatgcgccagtgatgcttggaggaaaagagaattttgtcaaatctgaacccttcttggttcttgagttggggggttcaaagttattatctgtggctgtttttgccttttctggcagttctctggaaagatccatcgatcgttctatctgactatctgatacttttatatgtagttcttcctgatgaattactgtatgagggaaaacgtattcagtttccttatcctctccacccactttcgctttcttcttaatcactttaggactttcttgctgagcgactggtcttgcttgttcctgttgttctttctgtgatataacttctgctttcacattttctatttctggtagttctttcacttctgatattgcagacttctcgggttcttcaaacgttacttttttctcagtttcagttccatttttttgtttagtgtcaaccttgatttcccgcttagtgactttgggtgtgaacctgggtcccccctttcctattcttggttagaatctcatccgctcaaaagcttcgatgaagtaacagttttacttactgaggaaactactcatcttttttgatcaatgacgataaacaatgtaatcagtagataaaaaggaaaagtaaaactggaattggagcgcgcttctatctagttacagtgatgcgaactataaaaaaaaagatgtagctttttagtgcaggcccaatatcaatggagtcccaattaattcatactgtggagctgggagattgggctttgggcattgccagcttggataatcatggaattgttgtaagtctatcggatgggtctttgaacctggtagactccaacggaaatttttcaagaacagatgctcattctggatgcatatcgtcactgagaaacgtggataagaaaaatattgtggccaccgcagcagcggatggagtcaaagtttgggattttagatgcataaatcaaggaccagtgtcgaagtttttgaacgaaaagaatgtcccgtttttatcattggattttgaacatggactgctgggagcaggatctgagctagaggggacagattccgagatctatatatgggatctgagaaattcttcacccttgagaaaactgtcagaatctcaccatgatgatattacagaggtgaaatttcatggaaccaataaggacttactactgagtgggtctactgatggatatgtcaacgtatatgatttgacatttccggaagaggaagatgccctgcatcaagtcattaactttgcctctattcattccgcagactttttatctgcttcaaggatttatacactatctcacatggaaacttttgcaatccacgaactaaatgataaatccagtgatctaaaggaaccacaaccagttcaatttggagacgtgagagaaccttggaattgtgaatacgttgtaaacatctatccaggatatgtcgcatgtggttctaactcgcaggaatctctaactctctacccatttcaaaatgagaaagttgacacggaacggaagttaacatttaaacccgcacatggagaggaggtagtacgagatgtttttttgaaggattcccgtatttatactgctggtgaggatagtaaactgaaaatatggcaaagttcacattggcctgctcctgatggatccgttgactctgaagaattacagacatccaaagacgagaactctttgaacgaagattatagaaaatttaagaagcataagaaggatgggtcgaaagaacagaaaagtaaaaagacgaaaaaggataagcattccaatagatttaaaccatactagaataaatatataaatgttcctgaaacaatacaactagcgtgtagaaaggtctcacataaaacaaaaatcataaattaattatacgttattgcaaaagtcaatatattttcctccataatgaattaggtagaataaattattggttcgataattacgacactttgagcactgaaggtactttcccacccatacttccagtgggtcttggacatcatattgatgcgtccctaataactatatagctgtgacttataagaatattattatatttttcgtcgcggatacttatcattcaaacaattatcaatcagaaagcagtatatgggaagaagaccagccagagtccaggtggatcctgagtctatcgactctgacgagagaccaccacagacaggtaatattttcaatatatggtactctaaatggtcaggaggcgacagtagtgatcgaaatacacaaacgcattcaaagaccagatgtaatatagagagggactcaggttatacaaaagctgataaagagcaaagtccatttttctgcttatatttttccagaggggcatgctgtttaggtaaaaagtgtgaatatttgcatcgtttgcccaaggagactgatagctggattcctcatactttggactgttttggacgggagaagtttgcagagtatagggatgacatgggcggtgtgggaaactttaacaaaatcaaccgcaccttattcgttggcaggattaacgaaatagacgattctatagaactaaagatttcgaagaattttgcagaatggggagatatcgacaggatcagagtgataccgaataagaacattgcatttgttacatataaaaatgagttgaatgcccaatttgcaaaggaggcaatggcccaccaatctttggaccccgataatgaaaatgaaatccttagtgtcaaatgggccaacgaagatccaaacccagaagccaaggccaaaattgaacatgaacataaccagcaaaagctaaaaattgccaagcagttggtcgaaaaattagaaagattaaaacaatatgaatcggagaagagagcttcagttaccgttgaggagccagaggaaacagatgatttgcctccgaaaagacagaagatgattcaaccctcaccactcacgccaacctttttcaacggatcgttgtcagtgcttagtgagttaaagcataagaaagcgcacccacagaaaaatcaggcgttagttgactacagtagtgatgatagtgattaatattaataatgatagaccttccttttataattctatatttctcatgtttctcttctcgttcatatcgtgttgacgaagctcagctgggattttgcttccggattttaccagaagctttctaaattcagagaatatttcggaatcctctggtcccagataagttatgctataacctctattaccagcccttccagttcttccaattctatgtgtgtagctatccaacccatttgccatttgaaaattgactaccaaagatacgttgggaatatcaattccccgaccagctaaatctgtggcaatcagaacatctatcttccctgaccgaagattttggattgccaactcacgttgatcttgattcttagatccatgaatgactgtggatgaaagggcagtattcttagagagttgattctgcaaaaactcacaggtcttcttatagttaacaaatatgataatgggaggtctaaagctgggcaatatactaaacaaatgatttaatttagcattctcattagggaaataacgtacttcttgtgtcactgtgtcaacaactgtgccaagctccccgactgtaagcgttcctggttggttcaagtaatttttggtaattttctgaattgctgttgacattgtagctgtaaacataaatgtattgcgtggtctagacgtgaaacgattctgatcagtgggtaaaagtttcaatatttttagcacttgaacttcaaatcccatgtcaatcattctatctgcctcatctaatactacgtagtagcattccgccaatgagatcatttttctttcataacagtcaagtaatcttcccggagttgcgaccacaatttcacatccacggctaatgctgttgacattttcttctatagagtgaccaccaatcaaactgataatgttcaggtcgagtttaacagtgaattttttaaactccttttcaacttgaagtgctaactccctcgtgggcaccaatataaggacttgggggatttgatctccactttcaaggtggggaagttggagaagataattcaaagccggaataatataggccaaagttttacccgaaccagtcttggctataccaattaaatctctggaggccagagccagtggtatggaggctctctgaatgggagttggttcatcaaagcctagactgtggacaatatcaagaatctctttcttgatgttactttcaccccaaaacctcaacgggttaggaatatcaccaccttttgatgaaatattaaaatcctctttaagtattcgccaatctctcagtgtcatttcagatattgactttcttcgccaatgggtatccttttcaatatttctctgatcaacaccatcgttaacagtgatcaaaggttgatagtcaagtgatgtgtcttcttcttgattccattgaaactgaaattttgcatcacccttcttagctttaacagatccattacggttatgattaggtatagcgtttgaatctgctggaacagaaggcagggagtctgaatcttttgctactgtcttcttctttgcaatgggaagaatcttttcattttgtttttgttgatgctccttttctagctttagctgctgacgttttgctttagataggaattgaactttctccaccctctttcttttattcaagatatcattcaaagataatgtcattccaaaccaaacggtctagcaaaaacgataactttaaagaacttttcaattggttttgtacactaccaccggtttactacctctgccttcggttcttctcctcacatttttcgcaactgggatagcgtagcctaaagtgtcacatgctcgctgctcacattccctacacaacagagattgtcagcagaggaaattgagctccaccattcaacacttgtggatttatgatagtctgtgctatcagctctcttttttttgttgctgtagaatttaccgtgctagcaaccttttaaactttgtttagctctccttccctcttccattcatctgtttcggtccgatccgtctctggtcatctcctccgcatttttttttaccgttagcgataggggtcagatcaattcaatcagttttggcaagggtatttaaaggtggcgaaatccccctccgtttgttgaacacatccaactattctcaacccaaccatctaactaatcgtaatgtcgcttattggcggaggttcagactgtgccgcgggaagtaatcctctggcacagtttaccaaacacacacaacatgacacatccttgcaacaatccatgaggaatggggaatttcaacaaggaaaccaaagaatgatgagaaatgaaagtaccatgtccccaatggaaaggcagcaaatggatcagtttatgcagcagcaaaacaatcctgcgttcaatttccaaccaatgcaacacgagctgaacgtaatgcaacagaatatgaatgcaccacagcaagtagcaaacaatagctggaaccaagagtttcgaatgaaggatcccatggttgcaaacgctccatctgcccaggttcaaacacctgttcaatcaactaactgggcacaggatttccaacaggcaggtcctgaagttcagcatcatgcgcagcagcaccaacaccctattttgagcgttcccggtgtaagagctggaatatatgggggtggaagactcatgggcgggagcatgatgaaccgtgctgctcaaatgcaacaacagaacccggctcaggctcagacttcagaacaatcacagacacaatgggaagaccaattcaaggatatcgagtccatgttgaacagtaaaacccaagaacccaagacaaagcaacaagaacagaatacattcgagcaagtctgggatgacatacaggtgagttacgccgatgttgagctaaccaacgaccagtttcaggctcaatgggagaaagattttgcccaatacgccgaaggaaggctcaattacggagaatacaagtatgaggaaaagaatcaattccgtaacgatccagatgcctatgaaattggtatgagattaatggaaagtggagctaaactaagcgaagcaggtcttgctttcgaagctgctgtccaacaagacccaaagcacgttgatgcttggttaaaactgggtgaggtccagacccaaaatgaaaaggagtcagacggtattgcagctctagagaaatgcctggagttggaccccaccaatttagcagctctgatgactcttgcaatttcttacattaatgatggttatgacaatgctgcttatgctacattggaaaggtggatcgagacgaaataccctgatattgcttccagggcacgctcgagtaatccagatttggatggtggtgatcgtattgagcagaacaagcgtgtcacagagcttttcatgaaggcagcacaattatcaccagatgttgctagcatggatgctgacgttcaaactggcttaggtgtattgttttactcaatggaagagtttgacaagactatcgactgtttcaaggccgccattgaggttgagcccgataaggccttgaactggaatcgactgggtgctgccttagctaattacaacaaaccggaggaggcagtagaggcatattccagagcattgcaattgaatcctaactttgttagggctcgctataatcttggtgtttcattcataaacatgggcagatataaagaggctgttgaacacctgttgactggaattagtttgcatgaggttgaaggtgttgatgcatcagaaatgagtagtaatcagggccttcagaataatgcccttgtcgagaccctaaagagagcatttttgggtatgaataggagagacttggttgataaagtatatccaggtatgggattggcccaattcagaaaaatgtttgacttttagatagaattcgaaaccccacaataagtagaccacatatatccaacttgatactagctccttctttcctcccctgaattactgttagcgaagtccggcatccagatcacgtcgagcatctcacgaaacgtattttcaacattgatcaacatttctcatatctctatcgccatctattttggattatagtatccattgtaaatgtctaggcaaaggttccagcttcctttgagtaaagaggaggggttgtactctgatctggatccaagttttgaattcaagccctataacggtgagaattcctacaacaacaccatcagatggctatcaagtaaaatacacaaatacaagaagctgcttatactactagtattcttacttttagtatctacttttacttcggcccctttagttccccatttccattcaaacaaggatccgagagtcgtaatcatcttggctgctaatgaagggggtggtgtccaaaaatggaaaggtcctcaggaatggtcagttgaaagaagttccatcgccaacaaaaaaaaatatgcttctaaacatggttatggcctagcaattaaagacctgaccttaaaaagacggtatagtcacgagtggagagaaggttggcaaaaggtagatattctcaaacaaaccatgagacagtacccaaatacggaatggttttggtggttggatttacatactctgataatggatatggacgttgatttagaggaatatttgcttaactctgtgggaagcaaaagttatcgaaccgtcacaagcttcaaccccattggtatcgaaaatcatgttccatacacagacaccagtcaaccggttgatttgatagttgcccaagattgtggaggtttcaatcttggatcattttttgttcgtcaatctgagtggacagaggctttactggatgcttggtgggaccccgctctttatgaacaaatgcatatggcttgggaacacaaagagcaggatgctctagaaactctttatgatcatcaaggctggattcggtctagaacaggttttattcccttaagatccatcaatgcttttccaccaggagcttgttcagaccaagcagacaatccaaaatttttttactgtgaaagcgacagggactttgtggtgaatatggctggctgtgagtatggaagagattgctggaacgagatggagtattacaaaaagttagccaaacggcatgaggagagatggtggaagttttggtaatcattttccactttgtttattaaatagatagaccattttatcatactgtactatttcagccttttttcgcatcctgcgcatggcacacaggggaattctaggaccagccaccttccagcactccctactctagtttctatttacgcatcgcgcgcgcttctggatggtggaaagtcttatttatttcgcttcaccgtgataaatatggctgaccagcactgggtaaatgaacaagagacttttaaccctagtaacggtaataatcaagatcaatatatcatgtcatatctgaatatgaatgagaattttaccggggaggaaagtgtgaatccaatgtccattcttgaccagtccaagcaacggccccagcaatacacaggttctaatgagtccaataaccagaacgaactaggtttgacggcggatccttctgtatttttcaatcagccttctaatatgcaaagttctaactctcccatggtatcgcaagtccagaatcagtcaccgtcatttcaacagtattctcaagcaccaactcctggtcaactgcaacagcagtttcaggatatgtctaatggggattccaaacaggttgttggagatcccaaacatcaatctcagatgcaaaaccagttaagaagacaatcgccgtctctttaccaagcaaattctaattcgtcccagcagcaacaactgtatcaaaaattccaacaagaacagggattgaactatagaagaatgcaacaacaacaacaacaacaacagcaacagcaagcacaacttcaacaacaacagcagcagctacagcaacagcaaatgcaacaggctcaggcgcgtgctcaagcacaggcacaagcacaggcgcaggctcaagcccaagctcaagcccaagcccaagcacgactacagacacagcagaaacagcaaaattctcctccacagtttcagcaaaactacccggctaattctcctcaaggtgtacaggctaaccaagctcaaaaccagaaacaacaagctgccagggcgttccagttgcagagggcgctgcagaatcaaattaatgctctgcaaatagacagctttatgcgcactctacaagactttctagcaaggaagggtataaacttgattcagcctgtaatcgaaggaaaaaaggtgcccatattttttttgtatatcctagtgggatcaaaaatgggcggtttccacaatgtttctaagcataaccaatgggctttagctgcttctaagttcaatctttctccgaacgctgccaatgagcttacagctatatatgctcagtaccttttgccatttgaggaattttctctgactccagaagggaagacagaaatggctcaaagaaaagttgcattacagaaacagattcaacagcttcaaattcaatttgaacgacagaaacaaaggtttcaacagcaacaacaacaacagcagccacagcaacatcaacatcaaaatcaacaaccaaaccaacaacaacaacagcacctgcagcaacagtctaagcaacagcttcagcaacagcagcagcaacaacaacaacagcaacagcatttactacgacagcaacagcagatgcaacaacaacagcaacgacaatttcaaattcaacagcaacaacaacaacaaccgcaggtaatacctcaacggagtcaattacaacaaccgatgtctcctcagcagaacacttctgccccatcatccatcgcatctcacaattcggcgaagccaactccacctactcatgggatgcatgggagtaatacacctggtcagcccgtaccctttgattccagacagcaaaccaattattcaagtcccaatataccagccacaacgacttctcaagagcatcaaggagaaaaaatctataaacctgaagtggcgcacaactacgttccgcatcaaagactgttagataccgttgctggctatcaaatggacaaattacttcaattgggggaacaattggaacaagcaaaaccgttatttttatttgccccagaactaggctctgtggatttgcatgctttgaccatgtccttatccagtgggattttatcagaaataaacactgctctagatgttttgctggtcgtttccgcggatcacagcctattgctcaatttgagtgaatgccctgacctgcttgacgcattaagtgatgttggtcttgatgtgttgaatgaggtcattaatgggaaaaaaacctccaaatcgcaacccatttactacgacaacacaactctgtatgactcaaatgatgttatcgaagagatattttcaaagtactcgggagagaaaagcactgatgtccagatagtagttgactcttttacctccgaacccatagaagagaaaagtcccaattctccttctgactcactttttgttgattctgaagagcaggtttctactgctgattctgaacaatcgacgctacgatcaattcccgatgcattttcttttcctgactatgcagacttattagcaagctgtagaaaagaagcagatcttatattttccgatatttatacccgctcttacaacaatgacgacatactccatatcgaacagctggccacaatcacaatgcttttgagaaacgtatcttttgttactaccaacatggaaactataggtcagaatccaaagtttgtccgttttctctttaaacttttggaatctgtagccgaacatcccaagaagtttagatttcagagaaagattttggccttactcaaagattcgttgatgatactttctagcatctctcaatttttacagttgagaaatcataaagatgcgctattgctcttaatgctatgtttttcaatgggtatcaagataaaagggattcttgataaggataagaaagatcgttcaatgactgaaagaaatatgccaggcttccaaagataccactctttctgtgttgacattttggccaaggtattggttagaaacccaaacaacaaaaagttattggccgacgttttatgtgaaaattatgtcagtgaacttgatccgtctgctcccaattattcagatgagatgcatacttttaggttattgaagttatatgttggtgatgaagtgaatgggcacctcttatctaaggcgttttcatttgccttattatcgttaccattagattcactcattaacgctcctgcctttgttgaagagctagctccaactatctttgaaggactcctagtatgcaaaatttttatggacatgatcactcccgataactttagcatcaaccttccattgttatggttaacgacaaaagataatattggtgcaaatttgctaactctgggattgtacttgacgaatattgccatcaagaccaataaccccacatacgtaatgatggcaggcagatgtctaagtcttacaaacgatcttatttcgaaggcactattttttagtgagctaggtgacgatgatctcataaggctttctcaacttccaggactatttcctgcttttgagaaaactgtattaactattgcaaactctgttaacccggttattacaatagagtctatcaaactggagaaaacatttcaccagttgacctcgaagcttcaggagagaggcctaggtgtcgattagatgactggcgtggtagtgaactggagtgaataaagcattacgattggtaaatccactgtataattatgtatagataaacctatttcaatagagttaaacatttaatccatttgaatttgtagacgtggagttgaacttccaattaacaaagttataggctacagatccagcctcttttccgattatatcctgcatctcctgtaacgacagattgacaaacttcttgaggtttttcactttagttataatcaaatgataattgaccttggtcacacctggtatttgagtaagtacatctatggctgcgtcattgaattccggggcgccagaactattcatcatgtttgcatcgaccccagcttgtatggccttttccaaatctggttccctttcagttgctttcaaggaaattaaaatctgtgccgattgagttggagaggacgaccagaaaatctttaattttggataagcaattaacaaagtgattagtttcgcttgaatatcctgctgaaaaaactttaccgtgctgggggtcatttgttgagaggtttggtttggtctagttctcaactctgcaaacggctctaaagaaaaagatttcccttcttgaaactctatcaataaagctggaagctggtaatgacgaaacatttgttcacactgttgatagagccgtcctgagttgaaacttccgattaaatcaggaatggatttcctttcaacgcagatacgcggagatatgatgtaatcgcctatagttagcattgctggaacaactttcaacccaattcggtagcagagatttggcagagatgatctaaactctctaacgtcaacaataatacttgactcatctgtcggtgttctaaatgcacttccaccggctatacgggtgttgaatacttgactttttgtgactctaaattgattatcctcatcagtagagtaatgcgacgctaaggtggccttttccctaatgagtttcgtaaacgcttctttctcccttttgatagagttcaagtaagtttcctcttcgacagagtctttgtaatacatgaaaaatgtctgtgctgcacgctgtttacggatagcttcataaacctctattcttctgatgaacgataaatttggctcatagagaataatatgagaggggttcaactcgtcaagtaatgattcgttagttctagcgtcaaatttctcaataacaatttgatctgctggttcaattgaatgagaaagaatcaggttccttgagccggtaacctcaaaatccgcacctggatctgaatcttcctctaaatttgaaatgttcaattgatcactgtcctgttcaatgaaagcatccctattgtagagccgatcaacggcttgaatggccttgttacctcttgtacgccttcttttggaactagttgcgtgggctctattcctagtgaaggtcttagaaactgtaagagcttctaaatcagtactttccacaaccttttcttgtttgagtccttctttcagttgttttaaggctttctggacctgattgtagtgattaagacccatcatcataaacttacggccaggtgtagccctgtttgtattttgtgataaatactttctgagttgaacgcatgttgacctttcattacacatgatgaggatgggcccttcattcatattcccgcgtgaccggtcatcagcaatatcttggaaaatttccgttagctgctgccatttaggtagttcttccaataggaagctttgaggctcgctggaggtttgcaaaaagactcgttctcttgacaacgaaagaattgaaatggcctcatctaacattaaccatggagatgaattctttgtagatttgttgacatcaaatatggtttttatcgtttcataaaactttatagcgtcataattcaaaagataacccagcagttccttcaaagtggaaatatcgtggataacttgtttcgttgtccaagaacatcgatgccacaccgggtccaatgtggctcttatgacttggacaaactccttattcagtgcattggaaatgtcccaatattctgtagacatttcagggttgtgtcgcttgagctcattgatacatgcttcaatgcaggaaagtatagctaattggattgttttcattctctttgtaagtgaaacactaatttcaacaaccaagttgttcttggaattcattttcaacgagttggccacctcgatatggaatcttggccaaatcaaagtatttgaaagctttagatctttcaactttgttttcaaaggctgaaaaccatgtatgaatttttcaacatcatctgatattgctttcacaaaaccccatttgtttgtttgcctgtagaaatcgattataaaagactcattagaagtatccgtaactttttctgcatgtaaaacaattattcctgttattaaattcagattgagaaggttgctcagtaaatcaactatgaatattctagatgtgacggagatgataccaccagaagcatatatctttgaccgctttcctactacgtagttggcatcaattctgacaaatttgcgtccgctctttttcattcctttattcaatttctctacccagcttaattctaccaacagttctctaattttttcattttcaaactcggtagcattcagaagtatgattaagcctcttttattttctcttagaggactagataatgcatgcaggaggttagaaacaatcacctccagtcctaagccttttccaagaagtaaaagaccgtcttgtctcaacaaatctgcaagaatcaaatgttgatacttgagaggtagtgaacagagaacatctatgggatctgacacaataggttcctggtgagccgcttctttcaggggaattgatatttcgggagctctatcatcaatcgattcttctggcctgtaaacttctagattgtcatcttctggaacgaataaagacatagtacatgtttcttctcttcaaagatgcgatgaagagaagcgcgagcaagtttatcatcagttgaaggaaccactaatggaaaagaacatgcacatgactaagattgatttctattgatctgtactagcagcattgccaatggagtcagatcagtgcaaacatttttgaagactcaccacggtcaaacggctgtaaaaatggaacgttataactcggctctaactgaattctgtgggggttagtaccttgtatcagtattccaattttcactacagtttcagcgtttcggcgacctttttgaaatttcgggtacctttttggaagtggtctatagggatatacttggaccataagctgcaatttcaagggttgcatttaataagcgctttagaccgaatcatcctatagacaaagccatgagaaactcaagttgatgtggcgaccaaggcctcagctaatcaatagtcagataaggaatttggtatcacttgaagacgccatccaagggtattcaaagatagttactgagcatctatctaacacgaaatagaataataacgccttgtcaagaaacctaggcagtttatcgcacagagacttgagtctagacaacgtagaaatgtctacccgaaaatgggtcgtcttagtgtttgaggcaaatggaatggttcggctttcatgggtggtgaataaatcaacggaatgtcttcttagagtaaccccctccttgcaattctatgtggctgatttcacttgcaaataaaagatcgttgtgtaaattcccattttcagagggtttggttcaccttgcgagcaattccaacgccgttctctcgcatcatttcctatttggcagagtaaaaagtttccagcgacttaacgttcttctcaaattgattgtagcctctttgagtcccttcgttgtttcctcagcttcctatagagatgactaaaattatcgacaagataaaggagctcaaaggagaacctttctattcgtttgaattttttcccccgaagaccgacaatggtctaagaaaccttttggctcgtctgggaagaatgtccatgttgaaccctctgtttgtgaccgttacctggggagcaggcggtacaacttcaagcaaaacattagaccttgcaatcacttgtcaaaaagatttggatctcactacgtgtattcacttgacttgcacaaacaccagcaagaaactgatcgataatgcattgaaagccgcttacgacaatggaatcaagaatatattagcacttagaggtgatccacctcgagaggctcaggaagttgcagttgaccaagacttcaaatacgctatagatcttgtccgttatattagagggcaatacggggattacttttgtatcggtgttgctgcgtatcctgaaggtcatgtagagggaaacgatgactcggaacaatctattgatcatgatatgccatatctgctggaaaaaatcaatgcaggcgctgattttgtcgtgacgcaactgttttatgatgctgacaagttttgtaccttttacaacactttaaagcaacgcctgggtagggacgtcgtggtcatccccggattaatgcccattaatacataccaactatttcaaagagcaactaatctcagtcatgcttctattcctccagccgttggtcaactgtttcctcctgatgtgagacatgatgatgataaagtcaaagatattggtgttaagttgatgattgatattgttgatcaaatttacaatgaaacgcatggtgaggtcaatgggtatcatttttataccctgaatctggagaagtcagtcgctcaaattgttgacaaatcaagtcttctctctccgaggctgacagtaagctcaagatttgagaatgcaattgaatcttcgtccgaagatgaaaaagagcaaaatcagcagacgaaaaccatcattgccatctcatcaggtgaaggtacaatgggtaaggaagctacatgggatgatttccctaatggtcgttatggtgactctagatctccggcttatggtgaaatcgatggttatggaccttcattgaaagttagctcttcaagagcctacaaactatggggctatccagttgatctggatgatattactaagatttttattgcttatctttcaaacagaataacggctcttccatggtcagagttgggattgaaccccgaaacgggtttgatccaagaggagcttatccaacttaacgaaaagcatatgtttacaatctcatcccaaccttctgcaaatggagtcaaatctactgacaagctttttggatggggtccgtctgagggttacgtgtaccaaaaggcttttgttgaggtgttcatcaacaaaaagcaatggaatgaagaaattctgcccaacttgcaaggacataaatcggtaacctggtatctgggcgattgtaacaatgcctttgacactaatatcaagattcccttgtcttccaactcagttacttggggttgcttcccagataaggagattgtgcaaacgacgattattggagaggaatccttccaagcatggaacgaggaggcgttcaacatatggagagaatggcaaaaactttaccctaagaatactgccagttacaacctacttggttcgatcatcaataacttttatttggttacattaattaatcacgattatgcaaatgataataataacttgtgggagatcctattgcagtagaacggttgtccttaatgacatgcattgaaccctatttatcaactggtaaccccaaccgttgattcagatagtctaatttgagctgatctctattatagttccactcatcaatgtgagagttcggtaatacaatcatggtgtccttagaaagcaaaagacaaccatgcctaataggggtatttttcagtatcaatttagtccccaacttcatatccttaatactatttgatatcggctctaagttaattccataaatcaatttttttgaggaatcttgaaacgttaatttgaatactttgttttcgtaaatagagcttttgaactcatttgaatcttgatccggggaatctgtggggctatcagtttcaatgctcttgataacctgtcttctgttacgatgctgatctgcaaatccctgattctcatccatggaattaatgaggatgtttctctgggattggtttgatactgtgacgtcgtggatatctattatttgcaccatcgtaggattagacaccactgacgcgtctgagttgatagacgagttcaatgcattctcgatattaggggacacattgggaggcttgacctttgtgatgtcaaacttcaacatagacggtgaccattaacagattagaggttctttgagaaatgtagtaaagtgagttataagtctccctctcatgaacaatagatcagttgaaataaagctaggagatcacttttcgcgataggaaatatcaacttagtaaatatattgttctggtcaaataatagctacaagctggaaggctattttcagcctgagaaaatactggcagcatttccagaagatttaggggatgtcgttgggtatgctgttaggttttgtgagaacgtttgcttaaatctctcctatcctcttaggttaagtagttcgctaaccaatatccaaacagctcaaaaatctgaaccattatcaattgacgctcatatactaccagaccgtagccggaaaactgtcgattaagaaatgaaagtgctctccttatacttgctgaacaaatcgggtgggctaatttatcaacgcgacttcaatccagagtccaatggaatcaacaagctaagctctaacgattacttaatcactgcgggcactttacactcaattcacgctatagttgcaggcctaacacctccagttctctaccctatacaagaaaatcagacgggaaatcagaaccaaacggggctgtttcaagtggaaactgaaaaattcaacctgttcatttaccagacattgactggtttaaagatcatctccattgtccagaagggggtgagccaagagacggccacgagattcatggccaatgtgcattctatttattcagattacgttatgaaaaacccgttttacactttagacatgcctattaaatgccagttattcagcaacaaagtgttattgttgagtgaggctagttgattgggtagagctcaaaactattcaaaccccgtggtcgtgttgggttcatacattacccctcggtttttttttctcagggatggtcaccctttgtttccctcttgtgagggaaggaaaagaaacgacaacaactgtttattctccccctcgaaagtcatgtcatgctgggtctaaattgggtggaacgatttagttcttttttttttgcgaggcacgatacgactcttaccccctggatcatccgtctattaagcatctatatgccagtagatccttgaaccattcttagttagagcaggtcaccatgtcaatcctaacgaatgtcattgtgaacaacaagtaccagcttgtgaagaaagttggttccggatcctacgggattgtttacagtgcaagacacttaagctccaacaccaacaaactctacgctattaaattaattctcaaggatcacccatccatgaagaaatcaaagcataaagctacgaagcagaaggacacaaagtatttgattgaaagattcgaacaagatttgcatgatatagctcttaacaacaacggtttaatatccgcaaatttgttggatctggatttaatcaaagagaagggacacaactgtaaaatcttgaaagagatttctattcaattaaaagttcataagcatcccaacattttaagcatatatagggtctacgacaatcagatttccctgattgttgtgatggattactatcccgaaggagatttatttgctgctattgtcacaaaacaattgtacaagaatgatccaaagttaatcaaagatgtgtttttacaactgatcgatgctcttagttactgtcacgcacagcgagtctatcattgtgatctaaaaccagagaatgtattggtcgcaaataatggtaccaagatgattttggctgactttggcctctccttgacgagcagcttcattgacagtaatatttgtttgggttcctcgttttatatggcccctgaaaggatacaaaacttcaataatggatttgatgatttgcataatctcaccgataagcatggtgggatcgttaaattcccaacaagtgccggagatgtctggtcacttatagttattctcatcaattttatctctatcagaaatccctgggcaaaggcatctttggacgatataacgttcaaaagctatctcaaagactacaaagttttgatgaaaattttacccatatcaaaggactgttgcaagatgttaagtcggtatcttgttttagatccttggaagaggggttcgttactccaactgcggtatgacttcttgaaactgaaccatttatctaaagaaggtcctttgtcgataagttgtggtgttgatgtctcagaatcaatgatgtgccaaattccagtcgatcacaccatgtctttaagtgatgaggatatacagataagccagaggacttcgagtagttcaactctcgagattgaaactgaagagcaggatccgtttcttttgaaaagtgaagtttccagtatctgtagatggaacttgaaatacccgtatgctctttataattaactccccgggaggaggcttcccaaacaagggaagttgtccgactctaattcagggaaatcgaaaagataacctatacatacatcaaacctatacaatgaatccgccagttttctttttcagcttgcggattcggttgtacaatataaaacccactagcaaaaagcttatgataataaatgtccattttaatagaagccatactgtttgaagaaagtatgtcaaccttgactcatagccatatttgtttaggttattttcacgatgctgccttcgcagcctttcctctgccttccttagtcgttgagctgttttccttctttcagaagcctctggttctggacgtttatcttttgtcagccttctatggcgttgcttggcaattctttccttgacttcattttcgctttcgttttgaacatactcatcgatatactcgtcatttagtatattcgaaaggtcgctgatagatgacagcacgtcaccatgttcgtccgttaaagcgttccattcaattcccaggatgtctgagttgtgatgtaatgcgccacattcagaactcaatgctaagtaaactttttcaggcaaaaccacaccctctttagtgaaacagttaaaccattcggagccaggcatgccatttttcttggctccaaagtccaaagaaaggtaccctgaatctttcaaataggttattctcatttttgaaggagaattcaagtatttcagattcaagttacaataaccgagttcatagtttgactttccatcttgacccttatcatatatgtaaccaccaccttgagaatattgaatagacacacgagggaatttgcccagtttagaggcacttggagaattttgataagtatcaatcaacacagcaacacccttgaaagttgtatcatcaacacctaaggcggcgcctgagtgtagttcattttcactcaaccaaacacctacaccgtctccgtaaagtttcttactgagacgtttcttcgcatcgtcatcaaagttgatattgaagtcaatctccagcgaggtagactcatatttcgaaacctccaactgtttggtggattgaatcagcccaacttgttgaggagaatccctgaccagtctaatcttatcccttgcaatcatggtagaagctcctctgatgtgaaatttttcagtaatttgatcaaaggtccatggctttgaaatgctaaagtcctgtaggagtttcttgttgactttgagaaggttgggcatctcgttgttgagcaatccgttgatctgtgcattatcaaaaattgtatccaattgaacctgtttaacaactttggagtcacttggagatgaaaagaaggaaatagtgtaggacacagcactccacaaaagaatgcagacgattagagctattaggatcctagctcctttgaacatcgttgatgattacgtgtgaaatatgctaagcgaaatatgctaagcgaataagggggaaaaactataaattaactcggtgatgagatggagaaaggaaaacagaaaccataacagtatttttgttcatcttaaatactatgaaattcttaccttgtcggtaagaatgcaaagcttttaaagacctctaccaattgaccaaagtcccgtttgtgcagataagcgggcaatggtgcaattcataaatttttaagctcagtcaaaaggaaacaattgtgaacactaatgtagtgcaaacagaacctttctcttaggattcatccgactgtaactgacagaaaaaatcgccggcagactattacactagactcctatgacgcattgaggtgtttttaacatcaggagtcgaagagatcagaacaacagtaatacagagcctaccacaactgagaaggcacgaatatctttgtgatcttaagaatttgactcgaaagtaagcacgattccttacaaggatgctgatgcttgctatcaaacctttagtctttcaacctcaagcactgctaaatactccacaatattagctgtccacattactgacgaatgctacagaatattgcccattttcgtagttagctgaaagttaatcaaataacgtcgaaaactcgaccgacaactacacgacttggtaaagcgctggagcggatagcccggtgaaaaatgatcaagcggagtagtgaatgtagtgtaacggtaacaccacaccatcttattgtcacgatgcagaataaatgtgagtcgcgcctcacaccacacagagatggtttgggatgtggcgatatattgccatttttgttgtcttagtaagatgacaaatataaatgcgtaaccaccatgcgcaattagcaaagtcaggggctgacaattatataaacgtacaagattgcctcaagtcaattctaacctaacaccaaatgaccacagtagcaataattggagcacacagtgtgcttttcgaacccattgtcaaagcgctcaagcaagcctcaaacgtgaagttccccataagagctgtcaccaggaagatcggtccatctgaagtgtctgatgataaagtcaagtactacgaagcaactgcagatgacgacaagacatacgacccagtcctgacaggcactgacgtaatcatcaaccttactcccccatctgtggaggagtccaagtacaacagcattctcaagtcaattgagcgagtcggtgtaaagaatttcaagttctacattccatcgcagtttggagttgaattgtcagagtttcccttccgccctctcgtgtacatcaagcagcaacactccgaaaaggcccgtaagctgggtttgaagactgtggatgtgttcaattcatattttgtcaacaaaggcgggttcctggataccattttggctcatcttggttaccaaggtgacaacaaggtcatcataagaggagatccagatcagcttttcaatgtcagtcatgttgacgatattggactcagtattgcctcgttgatcgacaacgtcgacaaagcttccattcctgacactctccgcatctatagcgaccgtgtcagccagaaggagttctatgacgcctatgaaaagagacacaatgtcaagttggagcgctcgtatgagtccaaggaggaggctctgcgcaaggcaactgagaaattgaatagtggtttcaagcccgctgactttttgtattatctcaatgtcggtgtttcacagtccccagaagggggctttgccttcaagggagacggaagagacatcgtcaaccctggggagaagtatttcaaatggcgcaagttcgctaatttttacgattaagcagtgctgtatggggtagttaataaatcgggaatatccttctgacgtgactgtaacaaatctctttttacgtggtgcgcatactggacagaggcagagtctcaatttcttcttttgagacaggctactacagcctgtgattcctcttggtacttggatttgcttttatctggctccgttgggaactgtgcctgggttttgaagtatcttgtggatgtgtttctaacactttttcaatcttcttggagtgagaatgcaggactttgaacatcgtctagctcgttggtaggtgaaccgttttaccttgcatgtggttaggagttttctggagtaaccaagaccgtcttatcatcgccgtaaaatcgctcttactgtcgctaataatcccgctggaagagaagttcgaacagaagtagcacgcaaagctcttgtcaaatgagaattgttaatcgtttgacaggtcacactcgtgggctatgtacgatcaacttgccggctgttgctggagagatgacaccagttgtggcatggccaattggtattcagccgtaccactgtatggaaaatgagattatcttgttcttgatctagtttcttgccattttagagttgccacattcgtaggtttcagtaccaataatggtaacttccaaacttccaacgcagataccagagatctgccgatccttccccaacaataggagcttactacgccatacatatagcctatctattttcactttcgcgtgggtgcttctatataaacggttccccatcttccgtttcatactacttgaattttaagcactaaaatggcaagaactccagctccaagagtcatcttcgttcgtcatggccaaactgagtggtccaaatcaggacaatatacgtcacatacggacttgccattgaccccatttggtgtcaaacagatggacgctactggaaaatctttggtaggcaactcaaatactaatcttattcaaccgagaaatcttaagctggttattacatctcccagaaagagagctatccaaactaaggatctgcttctgggtgctctctcccctgaaaccaaagctcgtatccctcaccaaataagtgaggatatcagagaatgggaatatggtgactatgaaggcttaaaaactaaagaaatatatgcgctgagaaaatctagaggattggatcaagatggacacatttggcaaatctggcccgatggatgtgagaatggtgaaacttttgagcaagtaactgagagaattgacaatcttattaaagagattagaaaaattcacaagaaagcattggacaataatgagcactgtgatatattagttgttgcacatggccatattcttagatgctttgctgcaagatggtgtggacatccaatcaataagaacccccaatttgttctcgatgctggtggagttggagttttgtcttatcaacatcacaacgttgaagagcctgccttacaactagctggagcttttgtggttcctgttgaggaagctgaagctgatagagcgtaaataagtacctatgttgtagaaaaagaagaaaataaacctgttacttacatttctcttctcatcactggattggactgtcgaagtccctagttttcttgcttgacttgggagaccttggagattttggagaattcaattccatcaacagctctctctgagtattacttatttttggtgttgacgagattaacagatcgtcatagtcaaaagaatcttctattgatacagagtttctcttaaaatggtcattgagaaaagaagttgaacctttcggtgatccaaaagaaacgtattctgactcctcatcggactgctgttttccaagtaaaggagtttgcactgttaccagggaggaatgttgatgttggtcgtttaaggaggactgaattgctactccgtagatcaaaattgaagtacccacaactaatgagatagcgacgaaaaagttgatatggtcaaataactgataaaagattatttcattgaagatattagtcacattgtaaatgcaaaaaaccaacggatagaggattgctgttgagactatcttgaggccttgattcaatgaaactagctgtgcaaaacataataagaaaaacactatgatgtatccaaagacagatctgaataatgaaaaagatagttcactaatgaagatttggataatagttttagccagcaacacagaaaatgctgataagattccactgacgactcctaatgaaagtcctgggtaaaatcttttggaaaataagcccaggcaaataagaacaacgcacatatcgaatatataccattgcctaaatgccctcgtggcaattaattgttgaaattctttcaatcctatgaatcttggctctggtatgatattcccaaccacccccagaatcaacgctcccacaatgatactcgcaatgctgatggcactttttctgttgaactcctcattcattattagccagttgaatacacagttgaagacaagaccactgctttgcaatgaactcagtataatcaacggtaaagtggtcagctgaatggaggagcccagaatattacttgtgacaaaaagtaagaaccctattctccacagatttctctggttatcgaggtgagatttccgttgtagtattaatccaacactttggcatgcagaagatataataccgactatcactccaaatagcacatagctccgctgtatcagcatgtctggggagtgtgtgaaatgttgagagaggagagttggggtcgtatgcagaaaacagaaagcgagggtttagtatctaggtttgtatgcaccgtaaagttggcttgatggtaaagggatctactgttcgaataccgaaggacgaatagaaaggggctagataggacacacggacgtgagaaatgaaacctcgcaggactactgttagatgtgaacgcattcttgaacgtatcacttcaaatgtgtcaaattgattatgtaagaagagtaccaaatcggtacgtattaatagagtgtcgacaggcttaatcttctccggattaacacattgaaaaatgcagatggtgagctggccttcgcttggttgaataacgtctcctgctcaatttcactgaatcatcgtttcagcgtcggatgaaatgcttcgttttaggtggcacacctacctcacctcctacctgccccaccaaaatgctttggaacgcgctttaacagattccatactgatgatatacaatgctgataagttatactccagcaatagccaacaagtcatagaagagcttggttctattaaaacttacttgtttgaaaaatgcaatgaactccacaactcccaaagaaagtggcgagttcccaagatcgacgatcccatttttggagaattcattctattgcaagagaaacccagcacgaacttgacgggcatcctccttgcgggtcctctgatacggaatagtcagtcttctactgtattggctctatgtctggaagttttgcatggggtattgctcctgcaccctccctccagggactactttacccaagtacacaacatggaaatgatgatttcattcttaaaatccgagtctggagatgttgtcaatgccgcagttcaatgtcaggtagctatcctggttcgaaatgtgttgaactttagactttctgaagctctggatggtcccaagatcatctgcgaactgctaaatagtccagcaactttacgaactacgaagatgaagatcctagaattcttgttcttttacttgattccagaggaagggacattagacggcgtatcctctgagaaccacaagaacactaaagagaaagcagagattctgaaaaagtatttgaggaatgtagatggattggttgaggagttgatgagaagcaaaccttttggggaaatggacatacagtggtagtatataatggttatagttaaattaggagcgtgagttaggaagagacactttgaatattctgaggaaaggatggtctggtgaaatgacttttagtaggacgttacgtaaacatcttttttctaggtaagcgaaatgtcagagatacctttcgaatcattcgtttctagccctccctctataagcataaaaatgatctctgcccttcttatattcaattctaagggagaagtactgatcaactccattttgaaaaataacgttaaaagaagcttatcggatgtattcagagttcaggtcataaacaacttcgacatcagatcaccaattctaacgctgggctcgacatctttcatacacacaaagtatgaagatctttggtttgtaagtgttaccagatccaacgttgatagctcaatattaatcgagtttatgtacaagtttattgatattctgagacaatatgttggatacaaagaggacacttacccaaactgcatagttttaaacgaagactgtatcagggataatttcataattattaatgaactgatagatcatatgctgcagtttggctatccggttgaaacagacatttcagtgttgaggaatcttacctctcaaaaacctaaccatgacataattgatttcgtggagaataaaagccctctaaaaaggaataagacagtgagtaaaataaacttaggacttcagagttggagaccttcgggtataaaatacaaaaagaacgaagtgtatgttgacattatcgaaaaagtcaatttgatggtatcttctactggtaccatactaggctcggatattgatggagttatccaactaaacgcaagtctttcgggtatccctgaatgccatctacgattggacgatgcggcagagattcaagattgtaaattccatcaatgcgtgaatctaacaacttatgatcaaacgggtgatgtcaagttcgttccaccagatggagagtttcaactgatgtcctacaaaatatctgagcccagaatcccattcctagtcctggcatcaattacagattatcccaatgacaattcacgaaaatacaacgttactattaaatccaagttcccatctcacctcattgcaaatgaagtggaagtgactatacctacgccaaattctatcaaagttgagtcattcacaagcacaagtggaaagttaaagcctaaacttgaagaaggggttgcattatggacaactgacaaatttcctggaggagaaactgaacaatcggcctcaataacagtcaaagtagggaacttgaaatcagtagacctaccccctctcagtctccagtttagcatacccaattactcaacctttgagtcgatgataaaatttttcaaagtacatgaacagtctggttataaaaccacgaaatacgtccgctatttcaccaaggctggttcatatgatattagatattaattatagacacttccaacatcttgtactcattaatcgcgaattagaggtacttttcttgtaagacagaaatacatcaaagctaccacttaatagcttcgaaatgagggatcttatagtgctgagtggctcctcaaatccacaactgacggccaggatctgtaaacagctaggtgttcccaaaggtgaagttatatctacgaaatttgcgaacggtgagacctctgtcactgtagttgattcagtgagagaaaaagatgtatatatcgtccaatctggctgtggtcacacaaacgacaacttctttgagttactgatcatgatatcggcttgcaagactgcctctgcgaaacgggtgacagcagtgcttcctctttttccttactcccgtcagccagatcttccgtacaacaagaatggttactcagtaaacggaaagagagaatttgatagctctccaggaactccaattccaaatagcactgccagtgaatccactgattatctgacctctagtgtcgttaaggatacctctaatgacatgcgcaagtcaacgctcattaaccaaccagttcctactccaactgcctcatcatcgtcttcccttttgaacaataataatacagacgatagtccaacatataaggaatggattgctcagtctggaactttggttgccaacttattaaccactgcaggtgctgatcatattattaccatggatctgcatgaccctcaatttcaaggtttctttgatatcccagtcgataatttgtactcaaagccgctgttgcagcattatattgctaacaacattccggatttccagaacgctgttgttgtttctcccgattctggtggtgctaagagagctattgccgttgctgaccaattgggtatgtcctttgctttaattcacaaggagcgtagatacaggaaactgatcaacccgactacgcttgaccaatctcttttgataagctccaccatcactccatctaatagtaataaagtcattgccaccaccatgttggtaggtgacgtggctggaaaagtatgtgttcttattgatgatttagtcgacacatcctatacaattaccagggcggcatccttattgaaggatcagggagccacatatgtatatgcattagtcacacatggtgtgttttcaggagatgcaatcaatagaatcaacgactcagctattgataagatcatcaccactacatcgactccacaggatggtcatgcgaagcaacttggtactaagctagaagtccttgatgtttcaaggattcttgcagaagcaattagaaggattaacaatggagaatcggtatctatgttgtttgaacatggatggtgataattgttgaactctatataaagtaataatggaactatttatcgtcactcctctcgtcatcgtcagtcaccaaatggtgttgatgatcgtctgtttttataagcttgtagttattggaagattgagagtcatctgcaatctcataatggcagtaatcaatacttctaaaccagacatcatccaatatctcctccacagatattcttcttgcagggtccaactcaagcatcctcgaaataagtctacggctggagtgaggtaacaatctgaataatctgtaaggaccttggattttggcctctttggctttatcttcttcattgagatagtttccatcaaggtctgtgttgggtgtggcacagaagtttctgaatgaagactctgaactcctaggaatcttccaaggaaatctctttagagccatacaacaataaataatggctatggaccagatatccacaggtcttgggtcatatgcttttgtttgaaatacttcaggggctaggtatgggtcagatccaacaattcctttagctttgatgatagtattgtcataatcgtacctgaaaacagtggcagatccaaaatcaataatttttaaaattccactctcgttgacaacgcagttgtccaacttgagatccctatgggttaatccttttgaatgtatgtagctgacaccattgactatttgtcgaaaatagcatgcaatctcgtgtttagtcattaatcccgacatcaccaaattgaaaaaatcgtaaggtatatactccatgacgaccaagaaggattttccatcttcaattagatcataagtttcaatgatattctgatgggtcaagcttgaagctatcaaaaattcgccttgcactttctttcgataatcataggtggtttctctatctgatttagctttaaactgcttgacagcaaacattttgtggtcggaaggtctttcagtaattgagacggaacctccagctcctgtccctaataatcttccggggataccatacttctggatcagctcgtccatgtcgtccgcgccaaagaatccgccgtccgaaacgtgttgattgaaatcgggtgtagaagccccagatgctacaactttctcatgcttagccttggaatgcttaactttggtgggaggtttgagaacattcttgaagaatcgttttaacttagtggacgagctgttgggagagttgtcactactgatgctgctctcgcctttgcttgatctactcattcttggtgataataaggagctacgattatttttctccaatttctcgctactattgttcttcaattcttttaacttgtggtgtaatttctttcttcctgaaaataggttggaaaagctctcagagctcttagaagtcttaagatccgacgcaactgcagggtggtcctcaaccgtcaagtggttcatctggttagcaagattctccttcgagttcggcatattcttgtgaattgaatcaaaaaatctaaagagttcaaagaatgcaaaagctttgcaagagtgtatcgaaacgaaagtgaagaaagatcaagtgactttggaaacgctgggttcagttttcagaatgggcaaagggaaggctgactaattgggagatgccaacctatgtaatgcaatataactttaagctgaaatgcgaagcagttgagagatctaactaatttcagaatccggctttgaaatgatgactcgttgataatggtatttctcggctcagatggcaacatgattgatatatatgctgatgtttggaggtgatggccctttcttttttttgaagggatgcagctgagaattgtggttcgaatggaaaagatcagtggggaagtgatgcccctcgttcctcgggaagtgctgtcccaccttcctcgggcaataccggaactgaaatcgggatgcctcgtgctgagatgctttcgtttataataatacattaagaagatataaatgcctacttccatttgaaaagggtagaacttctacggctttgacgaaggagattagaatcttcctccaagctggaatgtgaatgggaattgatttcgtagacttcttcctcatcgctagcagcactttcaataatagtcttagaaacacctttacagttcacaatactttctattattcctccggtcctaactgaatggacatccccgtctcctgtgtaggccgatgagttgttattagtgatctgattgtagtcctcctgtgtgatgttttctttgggaactggtgttctggaaactgaattatagaaagacgttttcatatcactgagatctgtggaggctacctctgttcgataatcttcgccgtcatcggcatagtgtttattcgtaatcgatgagaaactgtgaccatttcctttgccattaccagcctcagaagaccggcgagtgctcttaggtgagtttgaatgtaatcgctgtaaattctcgtgtaagcctgacaccagagcatcagcttcggtattttgtatggagccatatggaaatgtgtccattccttcctcaggacctttgggttgcttgatgtgaataaaccctttcgccgtcttcaaagggttggacgctaagttagagggcttcaaatgaggtatgcttatatcatctttgcgaactaaaagtttcgttaggtacgattgactagagtcaatcgaacttctgactgacgaattctttctattggcataaagattatgcaaataagaactcagatttctctttgaaagtggccctggtacagatcttctgatactacgattcaaatcgacaaagacgtcactttcatccacaatttcttcaccaataagctcctcgataacgtcttccaaagtcaaaacacccgtggcaccagaagcagttccaggactgtcactgacgaccaccatatgcgattttccctcttgaaaataattcaggatgtttaaacaggacgtatcagcagaagtctctggtaaagtggccagtgggaacgacgatactggtagcgcatcttcagggtcgtaactaatcaatactcgtaccagcagcataccaacaaaattggtgggctctcctggtagataaatagggatccgagaaaagcctctgttgaacaattcttcaactttggcctcatccaaaattgtatcagcactcatagtatacaccttattcattggcgtcataattgtatgcactggcttttctttcaaatctaaaactgcgctaataatggttacttcatcctggttaagtctctcaactcccatcgttcgatgcagagtgactaaagtttttaatccggatttcttgtagaccacaccatggtcttctccaagaatatgatcaagtaacactgcaattggataagccacgggatacattaagtacattaaggcaagcacaaatggagagaaataagctccgatttccaaaccataacgaacacatactgactgaggaatgacctccccaaaaataacgattgaaacagttgcagaaaacacagcaacaagtccacccccgagacatctatccagcaccacaggaagcgtttcattcgtgataacattacaaagcaataaagtgacaagaacccaatgcttaccccttccaactaattttaacacttctttcgcattagcctgctcctttggagatcccgagttggctacaactttcaggtagatttcgtcttggcccattaaacctaatgttaatcctgcaaaaacaccacccaataatactagaaaggcagaaacgatcaagtagatataaaactgggactctggtaggtcatcatgtgtctctgtttccttaatgttaagaggcaaccctgtcgccagtttcggtaacagagttaaacccataaacaagcggttaaccacattgcgcgcaacaactcgtcgtttgggcatatactgtgaattcatatatggaatggaagaaagaactcaattggtaaaaacagggatgggggcaggacttcaaatttaaattttccctcggaattggcttaatcaattaactagaggatggcatcatattatgtaatcaaaaataacaggagaattttaaacctactactagcctaaatattacttacgtggtggctcaactttgcttgcactctggaggctgggatttgggctgggattcatcgtcatcatcgttttcagaatcgtcatcttcatcttcttcatctccctcctcttcttcgaactcttcgtcgtccaattcatcgtcgtctgcatactcgtactgtaaggcatcaccggtaaaccaatcgatggctcttgggatcaacttgtctttgattaactcacccaattggtagtccaaggccagtctttgctctaattcctcatctacatcttcgaatccatcatcgtttccactatcttcaacatcagctgctccttcatctttagttacctcactcacagtttcttcagattttggaggccttggagggtcaaaaaagttgaaaaatgaatctataggtgtaagcttctcaatggttctgacttgctttgtgtgtttatttctttgttttcttctttccacggttatggtcacgttatggtcgttgtccttccatttgatggtggaaccctcggcatggtcataaataaagtcaccagaatatcctagctccttttggtagtaatatgtcttggtcaaaacttggttttcaaagaagtcattggattcgaattcgaacaaaagtttgaaacctggaacatcaaggtactccaatttaatgttactcaacttggaaagaacttccacatcacgatcagtgatactatcggctatgggtggaatattctctagagcggtaagccagaaacttggaataccacggatgttgatatcgatctcctcttctgcggcctcatcttcatctacttctgagatttcctcaatcttatcagtggaagattccagtaattgtttaccctcttcaatttcatcggaggttggctgcacttctccactaatgattttctgtctcttctcatacagaggagcatacttaccatagaactttttctctaactccaagatctcactttgaaattcggcttcgatcttgaattgcttttgttgaatagccttcagtccggcaacgcgttgctttacagattttggaagcttgtcaacgtagcctgagcttttacctacaagggtatcaagctttccttgaatcatcgacaaaagagctgggtttcccagcaactttctttgaagctcctcattttcctcactgattgtggatggaatagttggaggctgattcttcatataggaacctgttaccgaggcaggagtattctgaggagttggggcattagccaactgacttaatgacttcctgatatctttctcggacgacataagaaaggattatagttgcgattaaagatagtttgtttggtggtaaaattttctgactcctgagacgtcgctcaatataaacgcgctttggtggcggattcgatttcatttcatttcctgaccctcgcccagtagccattccttggccacgggggagggttgctcggaacagttaaggaggaaatgctgggaggttgaactttcagtctccttcttggggatctaatttgaaagattttttcagcaaatcttccaatatatccagcaattccttttcgatcatggttagaactttattgtcttcccagcggccataatttaaaccttgggttaccttcttgatcttcaactgacgagctctctctctttcaacggagagagttccaaatgcttcgaaaacttgtaatattaaatccataagatcaatcagtttgatgaaattttgatcaatatgctgttctagtttgagagatttcttcttgctattaatgattagatagaggactcgtctaaacgttcccaaagtccaattgcaggatactccagattgagcaacgttgagatagcatagcaatagctccaccagtaatttattggagagtggaatcttgttatcttctaccactttcatttgatagtcgaacatgttgtaaatgtcattaattgcggtaattgcggcctgatagttcatctcttctatccaggatcgatatagcttaaaaaactgtaaggcagtgtcttcagtggggttcaaataaaacaaaaagggagaatcgtttacagtggaaccactaactttcagctcttttgttatgtagtccaatagtttggcttttttccggtattgccgtcttgaaatgtctgtgttcaaatgggttacctcaccaccaagaagtctcagtcggttgctacattcaacgagaaagttgaacaatgcttctgcttcttttatcatgttcattctgatgtaggcacctattagttgattcactagattgatgtctatcactattccatcatttaacatttgggataacaagaattcaactcgatttttatcattcgtgacactgtaatacttgaatagtaaggcataagtaattctatctgggtttagcccttttcctgccattgcttccagtaattgttcgactaggtcataatttcgatatttgatggaatatcggatcatgatgttataagaatcaacttggagataattgccatataaacgagacaaagtttcataatctttcaatgtgaactcttcatcaaaatatctcgtagtgatgaacatgttgatctctttaccactcaatggaacatgacacgcttgtacatctcgtagaatcttgctcatgacggataaccctttaccctttattcttcctctttggttcatgaagaattcagataagaacttctccaaatccacattttgaatatacgtcaatctagggctaggcaactgcatatatttggagtacaaagcataatggtcaacattgttcccattggctggatacaactccttcaaaaactcacagtaaacatgaaccggagcatcatgcttcgctatcttagcccttttggtcactatgtcttggtatgaacccctacccatctttttatttatgtactgttcatagtacttttcaaaaaaactgttagtatcattgcccttcttctcaaaaatccaaaacggagtggtgttgctttttcgtattgacttgaacttttgatgatattctttaagcatactctgaagagcagaatctatggttagatatttgatcttggaaacttggtcagtcaagttgcccagggtattgctatatcgtctgattggtatgaatcctcttagtatccattttttgttcatagagttaggaaccagatagttctactggtttagagttctactaaaaatctcgattggtgaaatgaaaatggctagacagacgatagtcaacaataacattaccattgaccatccagtatttgcaaacaacggttacatagacaaaaattcacaactcatattgtgaccttcttgtggtatttagttgatgctactggttacaatcatcgctttacttagtttatgtctcctgttccctctgcttttggtccaacatccaacatcctattacatctatcctcctattcgcgattaaaggatcaaatattttccaaacccatcgttcaaccaacctccgttctaagtgtatcaccgtattccgactttgattcaggatgaagatacagcagaatgcgatcaacatccttgaaaggacttccaacttcctgaaaagtggagtcatcaaacaacagcccgcttggtacaaagttgtgggtagcattcctccccaagtggatttaactagaaaagctgcggtcaatcaacagaacactaccaactttgtttcacagccctccaccttcaaaactcgtgttaatccacgtactattaaaaataaactataccgctcacagaagttggaatttgttgaagacgaattacgagctctattctacgatcagcacccatgggaacgggccaatccaaaactcgtagtagagaatgcaaatgatatcgaactttttaaacttgactggagcaatatacgccaactaacgaagccatttgatggtgaaaatgtggtgcaaaggactctgtatctcgtccagaatgaaaacctctccattttagaagcctacgacaaggctagatttgaatattatcaggttaaaatgcaactagaagctgaagatagtatctccaaagaagaagctacaatgtacggtgcccaattcaaagagtctgctttggaatacgggttccagaaagaacaggaggtcatagatcagtggaaggaagaggctgaacagcaaactgaattgcttcaaaacaaagcagcaggagttaacaacttggaaaaagattcaacatgaattgtcgatctagaataaataaataaagaataaagaccctgtatatatgtcactggtttgaattacgactgttctaaactatgcaatcatgaaatggtaatgaattatctcttttctttcgcattccttcctttcccttgcgtcttcatcctatcatcagtccccttttcattaatgatgttcctcatggtgtccgtggtggtcattagtcaggaagaccttctcatatacacaataaactccgaaagcgcctaaaccccagaaaaatcctggaagtgctcccctgaatctgttagctctggtaaaagcaccttgagatctccaagcatctcttcgtttccatggattgccggccatatttctgtttgttaccaaccaatgagctttctaacaaacggaagaacgattggtctaccattccagaaaaggcgcgagaaagtcggtttagttggtgcacgatgcaatgagtcatgtgatttatgtaataaaatttagaccttagaatactcatctcttaacttatactaatacttgatctgaaaaaacgatgataacagcggatcggagtctactcctagcaagtagcaatacccctcctgatttgatagagaatgattcttccagtaattacagctcgggagacgaggctagtgatgaacaattggcagaaactatcattaatgagataaaagatggactatatcaatgtcttgtttgcacttcagagattgattcaagctctaaaatatggagctgccatcattgttatagagtttatgatcaagattgcataaaaaaatgggccctaaaaggatcttctacagaaacagacaggtcttggagatgtccgtggtgtaatggagctcattacagtttgaaattcccgtacacttgttggtgcaaaaaaaagattaacccggagcaaaatgaactaaatccttttagctgtggtcaaacttgtagtcatgacctcaaatcttgtgttcacggctgttccctaacttgccacccaggaccccatattagcaaatgtttagctttgggccccaagcttacatgtcattgcagtaaagaaactagacagcttccctgtgttttgactccttatcaaactggcttttcatgtggagcaaaatgtgatgacttgatgccctgtggtgtccataagcaccaagctccttgccatgaaggagtttgcggtgagtgtcgggagatggtggatgcacaatgctattgtgggaagcacagaaagaatataaaatgcagtgatcaagttcctaaaaagtctaccgactgggttggaatgttcgcttgtgatgacccttgtgatgtgttactagattgtggaatccataaacatgaagcctcatgtcatcctatcactccaacaagccatgtctgccccaaaagtccagcggtggtgaaaacatgtccatgcggaaaaaagcagcttggcgaatctcgttctacctgcctggacccgattccatcctgtgatgaaacttgtgataagttacttccctgtggtgaccgctgcccttggaaatgccatgatggcccttgttctccgtgttatagagttaaagaagcatcatgtgtttgtaagaagcaaagtttcagtgtaccttgcaagttcttaacggatggaaacgtaccaaagtgcaagaggaagtgtgaatcgcttatgagttgccgtaggcacatctgtgaacgaatttgctgcccggactatcaagaggctttcaagagagatcgagagaggaagaaagctatgagaaaaggtgttctggtagccaggaatgaagaaatgtacattgaaccttcccatgtgtgtattagaccttgtgataggttactctcatgtgggaaacatagatgtccccaagttgatcaccctggcaattgcccgccatgtttagaatcctcaagtgacgatttggtgtgtgaatgtggtaaaacagtgattcctgcccctgttagatgcggcacaaaggtaaactgtacatatcaatgttataggccaaaagaatgtggtcatgagccagaaccacatacatgccatgacccagagattaagtgtcccagatgtactacactcttaaagaagccttgcaggtgcgaaagaaagattgaagtcaatgttctatgttctcaacctcaagtttcctgtggaagaccatgtcaaaaactgttaaattgtaaaagacattactgtgatgatatttgcccttcgaccaagatatgttctggtaatttatctaaatgcaaaaaacttgtcaaagtatcttgcccctgcaatcgaatagttaagcacttcgaatgctgtaacgttgctgaggatcagaaacttgaatgtgacgaaacatgtgaaaagattctcagaaacaaaaaattgtttgaagcattccaagtatcaccaactgtcggagaccttgatcaggtaattccgtactcacggtacgtcatgaacacagcccttaaacagagcaattgggtaaattcagtggtgagattgtttgataatttgattcaatcttcaaagaagactcaccattttaatcccatgagcacttctcaaagacaatttattcacgaactggcagaatcctataactatagttcctacacacttgatcatgaaccctatcgaagtgtagtcattgaaatcaaagaaggctcaaagttgccacatttgagtattgcagagtccattaaaattttcaaagctaagaaagaaagggattcactagcaagcaggcaggagcaggattcaccagttccagaaaccaattctagtgaattttttaatgcaattgccattcaaaaagtgttctttggagccactttagatgagattaccatcactgtccaagagttatattctcccgtcttccctgaaggtctagtgaaatgtattaatgacagtaccttttattttctgccttcacaacccataaattcctcacaagatatagaattgaaactcatagaacttcttgacccatttactcagattttgtcaaagaaaagtttagcttttgagtgcaaacttattaaagtcgatgacaattgccatcttattgcaactgctcctcaagaatatctttcttcaagtaccgaaaaggaatctgaaacggaaccagtagagagagaggaaggcaaagaatcgactgaaaagcaacctgagattggtctacaggatgaagtagagaatagctgtcttgaagtgaaagatgtatctcatgaaattgtgtccccgatgaaaactcaggaagaaccaggacaagcgatggaaggtagtactatatcataatgccctcctacctctcttgacttttttaacacattgactacttataaacctattcatattacatagagaaagcattaattagaacctcaggttacccccgaaagactttggcctatcttacattctgtcacgtgagtaatttcgcccatcatctgtccacctcactatgattcatactgaccaaactatttcactctccttccacccgcaagttacccattgaaaaatgctgtcagctgtcagaaacaacgtccgtagctattccactgctgttaaaaccttgaaaattggtttgatcccaggagatggaattggaagagaggttatacctgctggaaaacaaattttggaggctctcccagctgaacatggtctgaaatttgaattccaaaatttggatgccggtttcgaattgttcaagaagaccggtgtagctcttccagatgctaccgtggaagccttgaagcaaaactgcgacggtgctcttttcggtgccgtttcctctccaactactaaggtagaagggtactcttctcctattgttgccttgagaaagaagatgggactctacgccaacgtccgtcctgtgaaatctgttgaaggtattggtagaccagttgatatggttattgttcgtgagaacactgaagatttgtatattaaggaggagagagtgtacgagaaggacggtcagaaaatagcagaagctatcaagcgtatctctgaaaatgccaccaacaaaattggtaaaatggctctggagatcgccttgcaaagacaagctgtccgtgaattaggaggaacttctttacattctaaaccttctcttactgttactcataaatctaacgttttggctctatctgatggtttgttccgtgagactatcaagaaactctacgacagtaactccaagtacgcttctatcgagtataaggagcaaattgttgactcaatggtctacagaatgttccgtgaacctgaaatctttgacgtagtcgttgcacctaacttgtatggtgacattcttctgatggtgctgcggccttagttgggtccttaggggttgttccttctgctaacgttggtgatgattttgccatcggtgagccatgtcacggatctgccccagatatcgaaggtaaaggtatttccaatccggtcgctaccattagatccactgctctcatgctggagttcatgggttaccctaaggctgctgctcaaatctatgctgctgttgattctaatcttgctgaggacaagattaagactcctgatttgaatggaaagtccactactcaagaagttgtggacgatatcattagacgtttttaattgaaactagataccaatatcacgtttgaatgctaccacgaagaaaccgatgcctccatcttccttaggctttgatcgaatgcaaccttccgctaattccttagggttttcaaaggtagagaactcttcttcaaatcctcgtcgattccaatcaggaataacttcatctctagtgcacaacttccaacccttcgcttggacttgtgaatccttaagtaaatcgacaaccactctttcattctcttgagggtgaacagaacatgttgaataggttagttttttagcgttaggaaacatcatggcatgtctcactatagtaaattggaaacttgccagtttggaaagtctggtatcgtcgtaggtttcatcttgttcgttttcttcaaaagcccttccaaaaatgccacttccagagcatgagggatctattacaaacccatcaatatcggtataatcctcagggtttgtagctgtaaagtccccaacttgaatatcaatgcacgacaatccaccagcctttgcacacaaagtcttgagaacttctgcccttttaggatctttttcaaaggcaattatggagtcgggcctgttaccgagataactagccagatgcgtggttttatttcctggagctgaacatgtatctatgattttgtcacccggactgggatggagaatatgtgcggggaaacaagaagccctatcttgaataataagtctccccttcaggtatgcatctgttgaagtaattttttccctcggatgaactccaaacaggtttggtatgtattggtcatgatatattttgccaacttccagctcttgaaaagattcaacttgaatgagatgtttgaattcattcaagaacttctctctagaagtcttcagcaaattggccctgacccatctaacaggagtgtcatcatcttctatcaactcttccaaatctttaactttatatttaatcttcaacttggtcagctctgcttgcaatctcgttttatgtgctaagaaagcatctttcagtgggtgcttaccgctttgaatccttccattcttggagaatagtagatcatgagccatcaaaatcagcaagggctccttagctcttatttttttgtcctctagaagtttggaattcctgataatctgcttcaagaactttttataccttgatgcggagtacaccaaagcatatacatgttttgggttgttttttattttcttatttctagaggcatcaaatattcgattttgcaaggagccacttttagggttatgctcaatgaattgctctgcttctctgtataagttcatgggtagacgtttgcacacagtcgttacgatttcatattatttcctactaaaaatttcacgacattgttcaatgttgtactgaccgatgtagcaagtctagacctatttagtgattttgttccgaagtaggttgcaagtgaattgatccactgcatcagtttttttggtacatgaggcttgctggttattcatcctatctttttctttcattccaacccctctcctattgctatctatttcattcatcacttaccatctatctcatgaggtaacatccgaacaatacatgacataaccccatacttcgcgataccatctttccactatattgtaagattatccggcttcttataacccttctttccatatcggagttacccctgtattcgtttcaagcttcctctaaatagcgctaaactggatggttatagttttcacagacactgcttaaaaaatgctttctgaaatgccggatcttatctccgctcctattttatatccgtcaactgaacagtttaataatcctattctctacttgagtgagcctgagaatgttgctctgggaaaaaaatttggtattttgaagatagtccccccaaagaactggaagccgcccttgagtatcaacatgaaaacttttaaatttattacgaggcttcaacggttgagcgagttgaacatcaagaatagatacaagatcgaatggcttaaaggctacaataattatatgaaaatgaatcataagagagttaacaaggagggatttgtctacatctctggcaaacctgtacatttgtatgacttgtatctggataggtgtaacctagaaaactacgatcagctcaaccgtcaagatttgagcaatctgaaagaatatatcggctttttggaatcgaagggttacaaaaattctgaggccgcccaagatgaaaaggggtcttgtggtgtttgccatttggatgatgatccgacgaggcttcttctctgtgatgagtgtgataccgagatacatatgagatgtctcgatccccccttgttggatattcctgaaggactttggttttgtgatcaatgtttgaacggaggttcggcatcttatggatttgaagaagaccatgactctgttttcacactggctgagttttttcagcactgtaaggggtttgaaagggactactttttgaagtattatgaaggttttcaaccttcaaagaaagaactggaggcagagttttggaggcttgttgaggacagtgatgctaatgtagaggtaaggtacggtgcagatattcacaaaaatcaacctggagaaatttctggatttccagtacatgaccctagaaatgaaacaaagctggagccttcggctgaatcgtactgcgagcacccatttaatttgactaaccttccttttgcaaaaggatcactattgagatacattcaagatgaaaaaatttctggaatgactgttccctggatatacgtcggatctttgttttctaccttctgctggcataaagaggatcattacactttttcctgcaattattgtcatattggatcatccaagaagtggtacggcattccagagagcgatgcgaagttgtttgaagatgtgttcaataagtatgtgccagactattttgagaagcaaccagatttgttgcaccaattagtatctctgctatcacctaaacagctaaaagagctgtccatgaaatactttggcaaggaactgcagattgtttatgctgatcagaatccaaatgaattcataataacatttcctgaagtttaccacagtgggttcaactgtggatttaacttcaatgaggcggtcaacttcactacaccttattgggttccttttggagctaaatctatctcagactatcaacttgtgcaaaaggagaatgtttttaattataccaatctaatgaagaagattttgaatgatttcgaacacatttctacagttgaggacctaaatgccaaggaacttcagtacagtttttcgtgcaaagacattgcccatgggcaatacatgaacatggtgagaagagcattagagtactattcgaaagattggttggctaagaaggataagtacaatgcaatatccagaaagtacaagttcatcggaactattccacaagacatttttgtgaaagataagacaagaaaaagaaacaacgatcttttgtgcgacaaatgcaaaacttctattaattttatttgggtagagttgggggtaaatccagcacgagcggccttactgaccccagagtctactccgaatgcaagttatgacagagagtctgaattcagaaagattgttgaagaggccaagtcaacaccgttgggactaggcataaagcgtgaagctgatcaacaggaacatgatagtagtgaagaaaaatcgaaaagaagaagatccagaaggctagccaaagaaaaaggacgagacttcgaagaccaccaccagattccggggaagcaaacagaagaacaaaaattagtgagaatgctgttatcaactgaaagaaacaacaagaggaggaatggaagaatagttctttgtctggaagactttacgaagttcatattagaatcggtgaatgactcccatgccatcatacagcgttgtctagttgtgcgggacacccaagatgacgaagagatcaataaatggatcggaaatatttccacgaagatcaccattttggaaacaaacagttgaaaaacaccatataggagtaatagtctctagtaataattataccctcaacctttggccctcatacttcgagttttcatttaaattaactgagacaagaaaagacaaaaacgtgccatcatctctctcttttgaattagtttagcgctgtttcaatcaagttagatgttctcaactaccaatagtctataacaatttcaaaaagagaaccctacttttcattgctcttacatcataaagaaaaaaaaataaacatactgaaccttttaacactccgatggcaagttcatcaactaaaatgctattattcaatcgctaagctactatatatatatattttgacgctccatcgatgtggtgattgttgtcccatctcttgtaagcactggatcaggtaccttaacagtaggttccccatgaaaaacgatatgtacgacatcacaatagttgtggggtcgtgcttttaccgtagatcgggtgtcagtttcgtgttaaccaataaaaagagtccatcctcgacaaaaaaggtggcctcggtgttatgtgcccggacactatttttcactcgatgctccttactcccttgccaattagcgctcgctcttatttgacaacacctttccttctctctttttcttcttcttacaccagaataagtgatttaattattcggatcattactagctatggttgtaccaagattgtattattccaccagccgtgctgctttgcagaccgctagagctaatcagcgtcttgccagaggtttggctaccgctgctgcctccaccggtaaggttaggtaagttttttccatttttcccttttttgtttcgttttcgatatggatggtgattatgagtatcaatagagggtcattgtgtcaagaagatattgatcgtgtcttttggttgtcaacataccaagatttgtcgtcgaattggcccagcgccgcactttctcttaattgaagaggtcggtgctttctcagagatttgttgggattagtatgtttagtttatctcaattggctcaagtgaactgacaattgtacatggaagccagttggattcactcctaccaagaaactgattgtaccgttgtcgtcacccctgtttcttccccgtcaaatcagagaccttgaaaatttcgctagctcgagaaatttcaagggaggctcataaccaccagtccaccagttttgaaacgaatcgacgtgaagttgatcgaccatgttactaacatactaattatagagccgtcattggtgccgttgtcgatgttcaatttgaacaaggtcaattgccagatattcttaacgcccttgagctgcagaacggtgaccagaaattggtcttagaggttgcccaacatttgggtgagaacaccgtcagaaccattgctatggacggtactgaaggtttggttagaggaactagcgtcactgacactggttctcctatctccgttcctgtcggtagaggtactttaggtcgtatcattaacgtcattggtgagccaattgacgagagaggaccaattgagtgcaagcaaagaaaccctattcatgccgaccctccatccttcgtcaaccaatccactgctgccgaagttttggaaactggtatcaaagtcgtcgacttattggccccttacgccagaggtggtaagattggtctgttcggtggtgccggtgtcggtaagactgtgtttatccaagagctgattaacaacattgctaaggctcacggtggtttctccgttttcaccggtgttggtgaacgtaccagagaaggtaacgatttgtaccgtgaaatgaaggagactggtgttattaacttggagggtgactccaaggtcgccctggtcttcggtcaaatgaacgagcctcctggagctagagctcgtgttgctttgactggtttaaccattgctgaatacttcagagacgaggagggtcaagatgtgttgttgttcgttgacaacattttcagattcacccaagctggttctgaggtgtccgctttgttgggacgtattccatctgccgttggttaccaacctactttggccactgatatgggtctgttgcaagagcgtattaccactactcaaaagggttccgtcacctctgtccaagccgtttatgtgccagccgatgatttgactgatcctgctccagccactaccttcgcccacttggacgccaccaccgtgttgtctcgtggtatctctgaattgggtatttacccagctgtcgaccctctggactccaagtctagattgctagacgttgccgttgtcggtcaggaacactacgaagttgctacccaagtccaacagaccttgcaagcttacaagtctttgcaagatattattgccattttgggtatggatgaattatccgagcaagacaagcttaccgttgagcgtgctcgtaagattcagagattcttgtctcaaccattcgccgtcgccgaggtcttcactggtatcccaggtagattggtcagactgaaggacaccgtcagatccttcaaggaggtcttggatggtaagtacgaccatttgccagaaaacgctttctacatggttggtggtatcgaagacgttgtcgccaaggctgaaaagttggctgccgaggctaactaaggagttaaagcaccttgaaaatgtcattatgttttaaataacattatatactgcacgattgatgttttagattgaatatattcgggttgttactcgttaaaagtgttttacctagcgtcctttatatggcacccctcgcatgtaaacgtcctgagatctgagaattggagtgcgcgcttgctcgacgtgaagacacgcaagaatgattgaatagcaccctcatctctccataaaccttcgaccacaatgagcttcttctcccaactgacaggagcattggacaagccaggttttaattggaaacttctgattgctggattttccagtgccgagtttgcgtttgaagcttacttgtcgtatcgtcaaatcaaaaagcttcaagagaagggacaccaagttcctcagagtctgaagggcaaaattgaggaagatgttgctttgaagtcccaggattattcattcaccaagctcaagtttggtatctttagtgacgctgtcaacttattatacaacttgacatggataaagtttgatattcttcccaagctatggaacttgagtggcaacctattggctaatagtctggcgtttttaccgtggaaaggaactttggttcaatctcttgtattcgtcaaccttctgagtattgcaggactggttgtgtcccttccgttaagttattactcaacgtttgtgattgaggaaaagtttggtttcaacaaacagacgctcaagctgtggatcacagatgccatcaagggtcttttattgagctttgtgtttggtaccgccatttatgccggattcctaaaaattgtcgattatttcagcgatacattcatgttttacatgtctgtcttcatgtttgtgattcagatattcttcattatcttttatcctaagtttatacaaccattgtttaacaagctgactcctttggaagatggtgaattaaagcaatccattgagaagcttgcagctgatcaaaaattcccgttggacaaactttatgtcatcgatggctctaagagatcttcgcattccaatgcttactttttaggtcttccttggggaactaaacaaattgttatttttgatactctgattgaaaagtcctccgtcgacgaggtgacagctgtattgggtcatgagattgggcattgggctctttctcacacaaccaagttactgttgatcaatcaggtgcagttgttttcaatcttttcactttttgcccttttcttcaagaataagtcattataccaatcttttggattttctgggcagccggtaatcattggtttcactttgttttctgatgtactcaaaccattcaatgctgtcctttcgtttgctacaaacctactttccagaaactacgaataccaggctgacgagtacgctgttgatttgggatattcttctgacttaagcagtgctctaatcagccttcataaggagaatctttcttctttgcatgttgattggttgtactctgcttatagtcactctcaccctcatcttactgagagattacaagccatagaattcaatgctaaaaaagagaaatagtatatatatcgatatataagttttatttgatctattcttcacttgcaatttcgtatgatttatagtctttatacggtgtaaagcattctcaagagtgttggtagttagaaatggctagacaagcgttaagagtcactctttgaagttcaattgcagattttgtaatttgaatatagatccaaagtttcaaccacagcattcagaacaacggtggacgtttgagagatgtcatattcagttttagggaataacttacttttttattacatatcgtcccttaaactcgtatttctatcccgttatatttcactccgattatccagaaaatctcgaaatcgatttgggtaacaacactgcaagtatgctagacataggagaagctttgctgaaagatgatgatcaagaccagtacttgatagacaatagtaagctgccgctatcgcagctgattccaaagatagtagccgaaagagggcgatttgaggatcttaaggaagatgaactgatagatgaaatactggagaaccaccagcaacctgccaacgagacaacagttcaggaagaagaccaagaagattccgaaagcttcattaaacaaaagatggaagtcatcacagcagttcagacggcattgaatgaaagctcgctgttactggatctcgtctcactgttaatatcctgcactagaccagcggctggctcaacctcaatgtcccctcatttgaaacaacacgccaaattaggctcattgaattgtgacgatataagttcaaatggggaagtatccaggcttgccgaggaaaacaaagagaaacattctattgttggcctggggtggaaatcggatgccttggatgttgcatccaagcggttactttcagcttcagaacgtctaaatgatgaggtattgaaggagaaaatgtattgggataatatattggaaaccctagaggcaaatgaagtgatcctgaaacttaacagtaaaggtggattatccaactcgaaggaaattggtgtgaagtatggttttggagactcagggtcgacatattttgaccgaggaattgcacttttgaaaaagggacgaagttttggggagatccattttaatagaataaacaatcttcaggttgatagagacgaaaaagtggtaaaagtttccatactaagtaaagtagacgatgagtacactctaactggggagagtaactccagaaaatacttagacagtttgaaaaacttccagatcaaccatacgagtatagtgggtgaaattgaaagagcaagattttttatctttgaagaagagtttttccatcaacttttgaaagaggcaacagaattgatatcttatcaggtacaagttgatggtaacaaaatcgtcgtcgatttgggcgaagagatcattgagattgaaagtgtgttagcagagacacagctggatgacaaccaagtgccccataaagagttaagtcacaatcaacgcgctgattacattactatatttctaaggctcatgttatgcgcacactttagatccaacctagagaataaacgccacaatccaactgctcttaccgttcacccaccgggaactcccaaacagaaggtccaattgaaccttttgagaccattgataggaaattacaggcacaataaacatctgcaactattgaagaacataattgagatgctgatacggaatatttatctggacgacgagaaggtctccgagatcatgggccaacatttcaagctcaccaaacatctggctgagcctaaatctcagcaaaaccaagacccgttcattcggtgtaaaacccctccagtatccgaatttctgttggaattgccttctcgctctggcgagttcacactgaaagttataattactgtttctgctacatccagtttctgtgggttacaagttcgtttgaaaatgttcaagattcttgaaaaagactcggagatggtcctggatgtcactttctctgatgtccgcgatgtgcaagattgtctctcatggtcctggaataggtatctttgattgggttatgcacggggaagaattattttcggacggggtgtgcccttctagcttatactgaaaaaccattcttgacactttatattttttgtcaataagtacaccaatagacgatgacaatgagcaaaccgaaagtactagtcgtcggcgctggtgggattggtatgatcggtgcctacactttacattacaacaagcgctgtgaagtatccgtaatcgttcgatccgattatgagttggctcggaaaagggggatcaatatcgatagcgtagcttatggcaaggtcgataattggaaaccagccaacttggctgctaacacaaccgaggctatggaagcgtttggaccctttgattatatttatttggctacgaagaatatcccagatggttcaaataaatgtgaggatgtcatcagacccgcagtcaccccaggtcttaccacaatattaatggttcaaaacggaatagatattgaaaatgccatgttcgaagcatttccagcaaatatagttctcagcggagtaactctctcgggagctcagaatctccatttggaggtcaaacatgttggtcccgaagtgtgtactattggattcttcaaacaccccactatcgatgaaaaaatactagaagcaaaggctaaagaattcattgagttatacagcaatgacttgaacacaatcacgtatgagccggatgtcagaagttcccgttggaggaaacttgtgtacaatgcttctattaatcctattacagcactggctggcctcgactactcaagagtagagctatgcgatggtagggctaccgttttgcgacctgctatggatgaagtcgttaaggtagcgctggcagatggctacattataccagattctcatgtgcaggccatgttagaggtaagctctggattattttataccccatccatgttaatggatgttagaaacaacaacttaactgagctggaaataatcctgggaaactgtgtaaaaattgcaaggcggcacgaagtcgcaactccagtattggatacgctatacgctttaatgaagatgaaacaatttgacataaaggaaaaaaatggaatcattaaagttgacacaacaataaacaaagactattctacctacgggaagggtttttgaatccaaacagaagagtgaaaaaaattatatacaactgtatacagtctattaatcatttatcttagtttttcttgccaggataagtcttcttagggaaaggatacgatggtccaacttgttggatcgattcggctgccaaccattgtccgatgtcaatgttttcaaacagatctttaccttgaacaagaccagcaacgaaaccagcggcgaaagcatcaccggcaccattggtgtcaacgactttgtccgcagccaaaggatgaacgacaatttcagagatttgagcttcaccttgagcatcaacgcgaaccaccaaggtggggtctaaaccttgagtgaaaatgacagttcttggcttctttgagttgacttttggtagtttagcgatgtaagttgcaacctctaccaatgacttgtctttcaaatcatgggattcggcataggcagcagcctcagattcgttacaaatgatataatcagcgtatggaacaacttgatcgagagggtctttaaaaaactgagcaatgaatggagctgagaagttgataacaaagtctttgttgttctcagcagcatgttttcctagcaagatgatagcctctggagacacagttaagtggaatccaccaatgtagaaaaaggaagccttctcgacaagctcccaattttccggcttttgtaaatgagaaggcttgaaatggtttgcagcacccaaatcggtggccaaacttctatttgggccattgatcagagcagcacacttaccagttccaatgtcaggttgaacttggtacctagtggccagaccgacagatttgttggcttcgtgcaacttctcagcgtatttgtcgttaccaacagaaccaaagtagactacagagatttctggaagtaggtattgagctcctctagcagtattctgtgcggcaccaccggcaactaatttaacagaaggatctttaaggccatcatcgaaaattggcatatgtttctcttctaccaaaatggcatcattctctttcaatccgtacttgtcaaggtactctttggtgacatcgaactggatatccagtaggggatttcctaaacagactaatttataaaccattgttgttgaagaagggataataacggttggtgaaattgtctctaatgaatatagtcgacttcgattcacatggtaaatgttgggatgtaaaaatccaatatcacgtggtatggaatttattctggcactaaacctgcaggagatgaggtcaaggaaggagggaacgataaccgacgagcgagatcgcgaaatacgaagttatgtagggaatctgcattctcaaaatgcattacgatcggagctaatccagcgttgtccaggcgtatcgtactaaccagtctgtcagtaccttcataaaaaaccctcaattgtgcttctttgaatattgttgttggcaaataatgattcatcccatatatgatgacccattgctgtggttacgaccgtttcctgctgaaccccggaatctactggagaaacattggcatgaaatagcaatctcttttatcttctatcaagtgctatactacttgagtgcaccgatttgtgcctatatttttgggtctcattatacacatgaaatctcaaagaagcaaaggattaattttgatatccatgtcgttgcccttgtgcagtcgtttatttccatcttgttgaccctgccgctgtttaaggaccccatgtggaaagaagatccaatctttggacacacgcctttttccaatcttgtttctgctctgactgcaggttattttatttgggattcaattgtatgtatccagcatttcaaaatgtttgggttagggttcttattacatgcctttgccgcattgtatgtgtttatgatggctttcaagccattttgccagccatggatcccagcataccttatcttcgaattatctactccatttgtgaatatcaactggtttattgcaagattacctgacggttatgtctctactaagttcactgttatcaacggtttgctcctaatggttacatttttcagtgtcagaattgtgtggggactctatgcagttgttcaaacatttgcagattattggccaataagagaccaagttcctggttggctggcattgccgatttttgcattaaacttgttgctggacgtcttgaacatgtactggttttacaagatggtcctaattgccaaaaagaaattcaaaaagtccaagagtaacgacgaaaagcttaagaaaagtaaataaggcgtctcatggctgtaaaatttcgttacatccttttcttttatgactaaatgattaatctaagtttatttattcaagaaaagaaccaccgtgagacagattaccattacggtgattccaaaagcgaccagcgccaatgctgcgtacttgtaggtcctttggcgccatgtagcttcagcagaagtgcctaacagcttgtagccaaatattcctggtaaaatataagaaatggaagtcgatcccgtagcaccaacaacggacagcactaagcctagagacgtgacggataatgcaattgaataagctaaggcaataattattgtagttaatatgataagcctttgggtggagagatgaactgcgactggtttcgaaggagtttcttctattggagaaaggttcggatcgttcaaatcagtttggtcttgtacgatttggggaggccctgaaccttcaggagatttgttggtaaaatcttcttgatcttcagttaaagggcgacgctcttcaccctcatcatcaaattcatcaaattcgtcgttaagatcagttttaccacttgtttggtaaaaatgcactatgtaatttaaggagtttcgacaggggtggcattgcaaggggaatgataaagtaaccaagaacacaattgcaattcttccgactgtagaggaaacattttgaggatacatggcaatgatgttactgatgatattgtcaccaaatgtcaggtagccacatattccggtgaccatgtagagcaccattgctgtactaattgctatactgatgaacttgttcatattcgcagcgcttttatcacgcagctcattaatcaatgaaaatgcgttatgctgtgaagtgtaagaaacaacaaaaataggaaagctgcccagaaactctgttattgaagtaggtcccacagcttttataggtccacggacaatagcttcatcggggaagatcaaatgcaccacgacgagaactactaggtatccaacagatgagagggccactagtgacgcgtatttgagggatgtcaaatttctgaggtagcacaacggaattattattaacatgaacagactgatccataaatttctggcctctaatgctggatgttcagcaagtgttgaatccttgactaaggcatgtacaatcttaggcatcaaatcaccaataaccaccagataggagcaaccgacaccaaaacacttgatcataatagcaatatcaaagaagatactggcttttgggtaagtaatttgggccaccgtaaagaacgaggcgtgccctggtgtcacgaactgggatactttagtttgcagaaacagcccaaatagagacgcaagcccactaagtataatcaggaacacaccaaaaagaataccactagatctaatggcatagggcatggctaagatcccagcaccttgactatggttagtttagttcacaaaaagagggaatgctgatcacttaccaatcagtgtatgcaatagtcctaaactagccgtaaatgcggagctctttccagtcattttgcaggcagaagaaatgtaactagtgttactttctatttggatacaaagactatatacagaaacagttcttgaactaggtttaagggtaagggctcataatactttaccaaacgaaggttggcgatgactgattatataatcaatgttcctaaacatacatctatgtacatgttaaaatgctcttcgaactagtaacccttacgtttggcctcatttacaatttgtaacaatctcttgaaacctttaccgaaccggcgcttattgcgctccatgcgtagctctgccttggccttgcttggtcttaagtagaatcgttgttttctgcgttcttgagcgacattgttactacgaaccaggttattgagttgtttcaaagcttgacctatgttgccgtcaatgacatccaccgttcttcctgcggcaactccggttaatggagcgttatggctttctgttggaggagagaagcagtcattcttgtttattaagccacgtgatgaagtaatgttcttcaaacttggagcggggaaagctgacttcgattgaaacctaagcccgtaaacaagatttattggtcttatcctttgaatgtaactggaaaacattgggagcagctattggtcgggtagactagattttctgacaagctctagctgaaattccttttccatctgatgtctagattgttgattggtgcacgacttgtgaatagtggctctttcaactttaaaatgacatctcggctataatcgatcttccttgatcatgactagttctgtagataaagtgagtcagaaggtcgctgacgtaaaactgggctcctccaagtcaacaaagaataacaagagcaaaggtaaaggaaaatccaacaagaatcaagtggttgaggatgatgatgaggatgattttgaaaaggccttggagcttgcaatgcaattagatgcacaaaaactagctcagaaaaaagctgatgatgtgcctcttgttgaagaagaagagaaaaaagttgaggaaaagattgaacagcaatatgaccccatttccactttttaccctgatggaaactatccccaaggagaagttgtggattacaaagatgacaacttgtaccgtactactgatgaagaaaagcgagctttggatcgagagaagaataacaagtggaatgaatttcgtaaaggtgctgaaattcataggagagttcgaaaactggcaaaggatgagatcaaaccgggaatgtcaatgatcgagatcgccgaactaatcgaaaacgcagttcgtggatatagtggtgaagacggactcaagggtggtatgggatttccttgtggtctttctttgaaccattgtgctgcgcactattctcctaatgctaacgacaaacttgtcttaaattatgaagacgtcatgaaagtagattttggtgtccatgtgaacggtcacattatcgatagtgcattcacgttaacattcgatgacaaatatgatgatctgttgaaagctgtcaaggatgctaccaatactggtattcgtgaagcaggtattgatgtgagattgaccgacattggtgaagccatccaagaagtaatggagtcctacgaagttactttagacggagaaacataccaagttaaacctatcaagaatctttgtggccataacatcggccagtatagaattcatggtggtaagtctgttcccatagtgaagaattttgacaacaccaagatggaggaaggtgaaacctttgcaattgaaacctttggcagtacaggaaggggtcatgtgataggacaaggtgaatgctctcactacgccaagaatccagatgcccccgccaatgctatctccagcattcgtgtgaaccgtgctaaacaattgctaaagactatcgatgagaactttggtactcttccattctgtcgtcgctacatagatcgtcttggagaagaaaagtacttattggcattgaaccagttggttaaatctggagttgttagcgattatccacccttggtagatgtcaaggggtcatacactgcccaatacgagcacaccatccttttgagacctaatgttaaggaagttgtatcccgcggtgaagactactagcagtcatttgttacgtaatatacttttgatttatcattttttttttcacaagtctccgatacttcttgtagtgcgacacctaatactgtgtccagtacttttgtaaacggcaaagtgtacacactacaaaggatagtttagagtgagagaagcataaatggagattgacaagagcgtaatagtattcaaaggtaagcaaatcgatttattaacctgacgatttttacaatgactaacctggcaggaccttttacccagaaatctggtgagactgttaagcttacaaacaccacctcaacgcctttggcatacaaagtgaggactacttccccgaagttatacgcagttcgtcctacttcgactctgctacaaccaggcgagtccatagaagtctctattgttctgcaagggcttccagaagagccatcgcccgacttcaagtgcaaggacaagtttttgttcgtctctgttcctcatcctgactacaacgaaaatgatgttattgcagacatcttcccagaattagagagccgttacaagagtgaggtggaaagacaaaaagttaaagttaagttcgccattggtgaaccatccactcaagacgatatagaatctaagaacgagcaaccagacaatgcaaccgaggcttctaagcctgcctccactgaaattaacccatcgttcggcaaagagatctcagagaagaatgccaaagttgcagctttggaggaatcgttggatggaaaacacaagacatctattgaaactaccgcatctcgacaggagcctgtttcaactacacaatcctctcgtcttccattaataatcttgataatccttcttgctatagttgctaagtactttttcttctagggagaaaggacaatgtgtttttataggccctttattctttttataatagtattggagtatgtataagtattcgtgcgaaacgatggctattggttgatcttgccaaagtcgttgtagaaggtgatcgttttctttgtgccgattttaaaatcggattgcctgtaaatttttgctgaggggatgagaactataagagtcccttccatgccttttccacccacttgcagtctctaactggaaccccattaacattatcgacaggagaactaatgcaaacaaagttctgcttatcaggaaaaacacattttatttgggattgtggaaatgggcagggacagtccacaggcttagcaacacatgcaaaggtctcaggacaaagatatttttggcagtctgagttgagttgttgctgttcgtagtcttgaggttgattgttttgttgcgtcctttgttgttgacggttctgaccaccgaaaaattgctcaaagtcaaaggccataacacagttggcagcaccaactataatcgtagccacaacgaatcctctcattctaaactatgcggtctaatggtttatcgatgaggtgtattcttttagctgttactattgaattcgaggatcattaaattacataatcacgctctatttcggcttggtagccatctcctgtatataaattcgtcaatgtggtacagttccaggagatttctcaaagaatggggagttggagactctgaaaacatagtcaaagcctgctgaaatgcatcctttgtaggctgggtaacatatgtcaatagcaacgtcttgttaacaccgccaactactctgctgatagctgatatatcgatccattcgttagatggagaatcgcttggtttataatcaggttgaaccagcacagcaaattcagcatgttgaaatggagggcctcttcggtacagtagaaaatctgatccaaatttggttcctgattttacacaccagccgtggctcttgtaatgatgataaaccatgtataacaaaatgaaagagttatccacttccaaagagcgattcatacatagttggaacaactgaaacaaatcaaaatcatttactttggagccaaagcaaaatgataaaaagagggcctccactggcatcaactggagatattcaagatctttgatatgagtctcatcgataaataaagcagaatcagcccttgtctgctctttcttgtctccagccaccgagtaattttccattataagttcacgtaacggtttgcgttgaagttgcttattgtcctcgatcaaaattcttttcaatttggtcaccttttgcaaagaagtcatatctccagtagttttgaaataattttcttgcgcctctagttcttcccgcttaagcttaaacttttttctttcctctcgacgaatctgaacggtttcttcgtttgtaagcaacaatcgaccactctcatcaaacagcgggtccagccccaaccttcttcgagttctgtgcaaccaagtgggttcggaacgggataatataccctttccaataaagccactattccaaacttcgttcatgtagtgagaacccgaaactttgaatataccatcgcagtattgtatatcgactacactctgcttcaactggaaccattgtttaacataagaacctagacaccagatccaagaaattggattgtgagtgaccacaggtagattgatgatattgataggcaaaggacgatcatactgcttgctctgtttcttcgacatatctacattctgttagttgactattgatcaaacaatgttttatccttatcgttcaattcagataccgttatagtcttaaatttgtgctcacatgataaattcaagcaacgtttcgatctcatcaccagaaaacgaatggatgtattggaggttatcacttacgacttggccatcatttgttggattatgaataaactttgaacaggagaattttttgctggaaggaaaaaaaaacctgagtagtaaaagctcgcgaatcaaagttataaccgttagggctactaaggcattttttggatagaaacttatcggagacgaagcaggtgctaagacatatcagttttgctgacctccggtgtatttcacttccagtggagaatcagggaaattccttctcatcttgttctctaccatcttcaaatgcacctttctgcgtttctgcattaaactgttagcctgcgatgctgacacgtttgtaatttacccaaagaggaaatatttatttatcgcgtccctaggttcctactcttttggctttttttcttgatagtcggttcactttaatcctctactaacttttggactttcttcgccgaaatgcaaagcactcttatagaagacaagaaggctcagaagcatgaggacaaaatagctgaaaatatcttgcgaagggcggaattaacccgaattacccaacaactaaagtcaaagctatccaaggtgggtagattggcagcaatggactctgaacaagggttacgcgggaagaaagcctttaaaccaaatggacttcccattgcaattgcgtctggtggagtcaatgagggatcacttaatcctgagcagccagaacgcctgaagaatcacaattcatcgcccgtcaaaagagatcttaacgccaataatttaccctcgtcgccagtttactcatacagaacatctgatctttcaagcaaacttggtaactcgtttgataatgatgatacttctttaacaaatcccccatcgacaccacctagaaagcatgaaacgttgacattatccagcaagaatgaggcacaggttgcccttcaaaacgccattttggcgactcccaaatctaaggtgattggcaggagtgcaaatctcaagactccatctggtaataatggtccaaaagagcttgatgatggggcagatttattgatgttcttagcaacgtcaccatcaccttcacgtccaggaaatcacatacagagtcatagcaacgcacagctgcaaggaatcgtatcaccccgtaattatcaaacacaattgcagaatgtcaattcaactcctcctaggcagaaggatagatcttttggtacaccgttgggtttaccatcttcatatatcaaccgtttcaacatgacccccggtacgccgcgtaattctggtcaattgaaaggactccaacgaactccgggattcagtatgagtgattatgttaatttttttaccccatccccaagacagcataaaactccagacgttagctattctaatattgtcacatccaacatctcagtgcagggcaccctattgaattttgaccgctccccagcaaatcagaaattaatgggttcggagataaaaacaaaggagacccggaaacctaaagacgccagagatgatgaatctccgctaaagaagcgaaaggagaactaagatgcaagggagctatcaggaatgaaagagggggtagtatgttttatatatcggtacataataaaaattggatttggtaacaagggttcgatatatcttctgcgcgaaaactcctctgggttcagctcgttcgtatagcattttcgcgcgaactttatttatataaatgtcccattttcattttcccccccaagacaattcttgtaaatatcccgatctgatgaacactgttcctgagaatcaggatcacaataggcgtcggttacgacgtgctactttggcggaaaagatcaaggttctggattggcacaacaattcggaacgaaaatgccagcaagccaccctacaatactttcacgacttaggtgagtttgctataacaaaatccaccatgaacaggtgggtgctaaacgagaaggagctgcgacaagatttcaagaatcttacattgaacaataataaagtttacaagacaaagccaaagtttaaagatcctgaagtgaaccgctgtttggaattgttgtatgatcagattactaatgagaactgcacaatcacggagcgggagttgattcaaagatggagcaacttttatctgatgttttacaatatccccaaaacggacttcaactcaagtaatattcccacaaaatctaacggatggttgcatcatttcaaaagaagaactgccttcaagcgggatttggtcaaacgttttcacacagactcagaattgtacagcgtacgtaccttggaagacgaaaaactacggttaaagaacacactagctcgataccagctgtcacaaatttaccaattggatgaggtttcgttcaaaatcaacccaacctgctttatccccaaccatcaatccaattcattgactattccagatcctgcagaaagagtcacagtggcattatgtgtaaatgccactggttcttcagtattcgctccactgatagtttctgatttggaaccatctaacaagatcatgaaatctttgaaaaatctattttattccaaatcaggaatgctgaccacggagatatttttcaagtacctcaagagtgttaatgataccatcgcacagaatgcacctcaagaaaagatcgtcattttgctagatgatctgtatacccacatcgtacctcaagatgagttcaccaatattgagctagtatattttgctccctcgttgaataagttggattattacccgttagactttggagtgatcagaatctttaaaacggaagtcaagtactctattatgcagatatttttcaaaaaattaaccattggaatggatcaaagtttttcgaagacattcacactaagcaaggaggacctgatatcagtcatcatggatacttggaacacaatgaagtataataccatgttgacaagtactagttttcacaattcacagttgattccaagttttgctgtgctaaaccaacaccgttcaatgccgtttgatgctgatgtatcattttctctgagagacacaaataaagaaactcagatcgtcaacatgttgagagttattcaagagagaaatctgttcagaaatcataaagggttgccctcacgcaaacattctgacctatatattgaccattttctattcccggcagaagagaaagtagaaaatgtccacttacaagactccgacatcattgaacttgttagaagagagcacacaggaattgatccagatctggaatctgggcaggctgcctcatcttcaattcagcacaacatttcttctcaaatcggacaaccggaatcgacagcacaaactgccttgcattcaaccggagctcatgagcctaggggataccttcacaatggatactctcaggaccaacctgcacatccaactcagagacaacataacactaatatcgtgccttctcccctaacaactaacctcatcatgggagaattggacaatctgaagtcacagagggcatcaccccattctgcaatgttagccaattccaatgaaggcagcatgaacaaatattcagcgaatggagagacggtcgaggcgacagaaataggcaagttgatgttgggccgcctaaaagacttcttctcgctacctgagaacatcaatcattattccaactcggcaatccagttccatcgtttcttgaacacttacctgcaagaatctaatgacctctacatgaaatcgtatgctaaccagaaaattcataagcagtcaagaggctacaatggctcgcaaaacttggaacagccgtccaaaaggcgccaactggaagggacaacaaattcgtttgaccagtttatgggctgagaccaccaatatttctcgccatcgatcccacatatcgagatcttcttgacagaatgcccgaagtatacattttgtttccgaagttttatttctttttttctttttttttttttttaggcttttccaaatcgagccttatcttagattcgataattttcagtagccctctatttagtagtagtgagtgacgttttctattacatgtaccatacagcccacaaatatttcgtcattctgggcgttatatctgtccttccaaccactgattagcaaagaacacttgacctggtgatttgaagatgctgcatctcgaagacaactcgatgcagccaaagtgtaatgcaccttgccgtaccagcactctacatggaaacgaaaaagcccagattgcgaacccttgacaactagaaaaacagcagagaaggaacaactatccgaatgtttcttgtgcattacttgcaaacgccagggcgttcggcgtactttcactactatcgtccttccatccactacaatttccgattgttccacgctccaatctctgcaccccccacttctcctactctctccccccctttcaaccctattaatcttacgttcagggatacgccacccttgatagcttaactatctgcataaatccagagtactcttcctgccttgaggcaccttaccgttatttattcctgtaaacatagcttctcttgaataaacaaataatttgtggcttattatgcccaaatgtgtacgaactaaactttttaacatgcaaagttgcggatttttttggaccttttctattcatagatttttctcctctgttttttttttcttccacctccatttatcattaagtgttactatacggcgtataccggttgtggactgaccttcatatctgttgagcataattgaatttttttttgctttgaaaccaagtcgcatattgcagtggtctcttttcctttccacatattagcaaatatcgtccgagaaagtcggttgaaccttttcaccacacaattgtgatctgggacaatcactctcttcgtttcatttcattttcttctttcacatacaaacatatttgagcagtcatcgatgcaggggggaaatccagactcccactctgccacggaaaaccctccagagttactatcgcctcctcaaatagggcagcaccatgtcatcaacgatccaggaagcgttgttcattctggtattccgtctgctcaacattctagatatccttctcaaaaattggccactgatgctcaaaatatgacgttggcacctgctcatgtcgtaacttcgaacaatccaggtcatattcaaccatctccaatttacagcattccaaggcataataattctaccagatacccagcccctcaaatgtccatacagcaacatcaacagtcaatcccaaaccaggctcatcacccacctccacatcatctgcatcagcattccctttccttttctcagcccataacgttttctccgcaacagtatgtctttcctaccccaaatctccctccaccatcacaagttcagctgacctttccgcaggcgcaacaggtcccttctcaaatcccagatcagaaaagttcttatggtccccctatgatgatggagatgccgcaaggaagacattcggcgcagacatcttcaggaagtatttcagcttatgtttttccgcctcaacctggtgttaagcaggcgcagaaacaccttaaaaaatctcataccactgtcgctgaatctgatgccaagttgaaggaacaagcttattcagcattgtctattcctttcgatgaatatgccaactcagtcaaactttccgaatcggacagagataccactccctccagacagacaactaataaagagcgacaagaagaagcatcttccagagaaaggcagagacaagtttttggcatggttgttcttttgaaaacctgtgagttgagtgcagattcagttgttgccagaaataagatctacaactattatgcttccatctgtttgagcaatggcatatctcctctcagcgcagcatcatttggcaaattggttcgaatagtctttccattggttaccactagacgtttgggaactagagggcaaagtaagtaccattactgcggcattagacttatagccgattccgaaagttgtccaaaagattctgcatttcctctacaattttcgacatcccagacaacgtcacagaataactcatcatttggctctccttatcaatcaagtgtgaacatgtctacaagccagttttctcaagcgaaccctcctacctttacgaattcccctgcttctggttctgtttcggtcatatctaataggttgacttcgattaatactgcggacactgcactttccgcacttgataacttcgcccatgtttctctcaaatttgacatggatctttgcttgaaaatgcattacccgaataaggatgacgaagagatggaagattcaatcactcttccagaattattagatcatttagaagcttatgatactcagatacccgaattcagtgagaagaatattgactcacttcaggctttatacaaagaccattgtgtttccatctttaaatctttaaggtatatgcacctcaacaagttgtttcagcaagtgctttcttttccatcgcaactgagtaaagaccagtacgctatttttgtgtctccgtatgttagctcatggattgtgcaatgtgatttagtaacttacaaggccatattgaaaatgttgtccaaaatagcacttcaaaaagttcctgattatgttgtgcaacaactgaaagttgtctgtaccactttacctgaaaatatttcgaatttgaatttaccggcagttgtactgcaagtgaagcaacccctggtagattatttctgcaagttagtatctaggttgatacgtgtcaccatgtcaacagggtgtgcatccaaagtgctaagcaaccctcaatcgaagaagtcaatcatcaaaagctggcaaaataatgtctctttcgattcattagcccttagggttctaccatgtcccaaagaaaatagggaaaaagttcttgaaattctcacgaagcaggttcctttgttcctggaatccatatctagttcaaaagataccaaagaaatcaaaactgaggaagggtctacatctgttcttcccactgacagagtagtcgaagcttttagttcgttcctgttaacgcaaacaaaaagctttccaactgtacctgcctcattttttttattatgtctgaacagtatcttaactactgccttgagagacatctctcttgcggggtcggaagctttttcttcctggtggctagtaaaatgctggattgatgaatggatgggatggtgtgcggaatacagtggattcttgctagcttcgacggctagttttctgttagacaatcctgtgcagagtagtagtgaagaaaatgcgtatgtgaacagcagcgtttcaaactctcagaatgtcccatcgaatgtccaacattcccacgagaatgaaaaagctcatgaaagcaaccaagaagaaggaattcatatgggacaaagtgttatcggaaggcagaatagcgtccattccggcaagagcaacccaaacaagactgacaagaatgaaggaacagatcatgaaattgacattcctgtaatggctgatacgttcgacgatcaccttgacgatgagttcatacatgtggacgaagacggtattattccctccaaacgccaaaaattggaagctgacttcgtcacaagaatggatgatgagtctggctctcaaatcgatagcgatatctctcttttgcataaacgacttgatattccagaggagtttacatcttagggtagtgttactattcctttaatgcccattgttctgtttacagttaatttagtccttattagaaatttcctgagaagaaaacaataaatgcatatactactatgtttgatttagcaaggcgatctatcaccaagcctatcgattttgtgcgagcattgtagatcaaaattgctttgccatttgtgaactttaaaccaggaactgttttccaacaaaaaaatgattcttgaacggaccaattcagcactctttgatccaattccgcttgaccaagtgcacaccaatggaagaagcaagtttgagcgtattgattgtggtcgagttttcaggatcccttctgggttaagtgtggttgatccagatgaaggtcccgaaaaaaggggaattcaaataaattatcaagctccagcaggtaacataactccaaggaatgtatttacactttaaagttgatgtgctaacactatagattctgtcatttacaattttgtacctcagttagagattctagagatgaacaaatcagacctatcgcctgactatagggccacctgctgttttcgttgttttaaaccagggactttacctgccagaaattcgaatgtcaacgacattaagagtgatcagggttgtcatcttaaaggagtgatgggcaaaaaccttagtatcaatggcgttgacatcaagaaattgttacgatgctcaggctgtcgagtggttaattattgctccctgtcttgtcaattacaagattggaacgagtttcatagtaaggagtgtacttacctcaaggattatttaaaaaagtactctatggtgccttcaacaactgaagttttggtcaatcgtatattactgaaatataaaagtaacagtcttttcaaattacaaattgacatgctgacttcacatctcgaggttcttgaagatgaggtttacagaggtcatgtggaacacttgcaagttctagagcagggtcaacatatacttgaaaggtttagcaatgtctcttcaaaatatgcggaggatctcacccttctcaagagattggttctaacagtatttgtaaatagtacagtaatgtacaacgaatttcttgaaccaaacgggttaatgtttgattcgttctttgctctgataaatcactcttgtgaaccaaatatcttggttatttttcagaatggcaaactgagtctgaaaagtattcttgatatcaaaccagggacggagttgactacaaactacgagttcaccaatcttccaacagcacttcgcaaattgaacctacggagtagatttttcttcgactgccaatgtcctttatgtttgagtccaatagacagaatgctggctgttcaatgtgcaagctgtggaactattgcagggtcttttgaccttgctgagaaaattggatccagaaatcaattgaaaatggtcgacggattccaaaggaaaggacgggcctgtttgaagtgttcaagcgagtttcctgaaacattcgataatatctctactatgtttcagaactgtctgtcgacttttattgaagacgctcagacatatcaagtggcaaatcgaagagggtatattgacaacgaggagcatttagtaaaacttcttggctccaacttcaaaattctgagcttagcaagcgcagccaagtacatcaaactgatccaaatgttgcaacaatgcgcaatgattcccaataacttttacctcgagtccctcctgttgaacctagtcactgactattttagtgaatcaacagatcaaatcacattcactagattaggcctactcgaaagcttcaatgaattacagaataaaaaagagaatgaagtgatcagagtttttcaaaaaagtcacatcttgaagtcaatagcgcttaacctgttgaacctaactgaaaagctatcaaaaagttccaatcaaaccaaagtccaggaatcttacgaagaatggtttcaccttgaaagtcaagcaattattgcgctatcctctttttatttttcattgcaggggtttgcacaggtctctaatcagcaattcggagtcgtcaaacaacactttgaggatatggctgtggctggatttaccaattcagtcctactgttagaacttcttggaagtacaaattggttcctggaaagttggtccaacttgaaatttcaactcattcttcaaaaactttctttattgcttaaagttcctcaattaagcttagatttttccactcagtattacaacgatatttccaacatcaatcttgttggaagcaacttttcaaaacgaataagtcaatatctgcgtcaaagaaacatatcgattacaccgcagattgtaaggacaccaactgagatatcgcagtttgaaatagttgagtcagatcatccaaaatggttgagacaaggggtagctgattgcctctcgatacctgtcagttcatcctacacactgttaccccaatatttgagattaccttgacgtgcaccactcaaaatatttgtgtccccaggtgtgagaccgggccgaacaacgtagaaccttctagaagcaatcattcgtaggaacgcagagctaggctaacccgaaaaaagtcgttccaggaatcaatctaagagcgcaattcgtatttaaagtaagtggggtgccaccgcgagattttatagaacagtaatcaaaatatggtgaaagaacaaggactatacaatttattgggtatatcaccatcggcctctgatgctgagatcaagaaagcctatcgtaagatggcattgaagtatcatccagacaagccgacaggtgatactgaaaaattcaaggagatttctgaggcatttgatatactgtcagactccgacaaaagggaagtctatgaccagtacggcctggaagcggccagaggaaacgcacctgctggtggtaatccatttgctggtgctggtggcccaggaggcgctggtggccaaacattcagttttggcggttctggtggtgggcataccttctcccaggctgatgctttcaatatatttgagcaattcggtggtttcggtggcctaggaggcatgggtggtggaatgggcggaatgggaggtggaagaggtggttctccatttggaggaggtggggcctcttacatgaagatgccaggcgggtttggcggagagtccccaagttcgtatggttcccaggttgagcccgaagtagtgactttgaaattaaattgtactcttgaggagttattcaatggtgccacaaagaaaatgaaactgaaccgaaagggtgctaacggtgttaaggaagaaaagatcttatgcattgatttaaaacctggttggaaatcgggcaccaagatcaacttcactaacgaaggtgactatcagcctgaagcacgtactagacagacgatccagttcatcatagcagagaaacctaacgatacattcagaagagacggtgatgatttgcattacactattccattgaccttcaaagagtctcttctaggatttgataaagaaatcaaaaccatcgacggtaagagaattcatgttagcaaatcccaaccaattcagcccacacagaccatcaactacccaggtctgggaatgccgatcagtaagaaaccgggccagcgtggagatttgatcgtgcactacaaagtggactatcctataagtttaacaagagatcaaagagatgccatttccaaagcgttttaaaggagcttgcataggttgatgatggagtaatgtatattagataaatagtaattgatggaaatcattcaattatgtaagccgcgacgaaaccttaacatctgaagtggataatcttgagtttctgtcttgacgacttatttcaaccccatagtaactaatcatgtcagttatcctagcttcagcaggatacgaccacactattaggttttgggaagcgcttactggtgtttgttccagaacgatccagtattcagactctcaagtgaatcggttggagataacatctgataaacggttcctagcagcagcaggccacctccatgtaaaattgtacgatgtcaagactgcaaaccccaacccagtcacttcatttgaaggccatacgaataatgtgacctctatggcgtttcaagctgataataaatggatggtgtcgtcaagtgaagacgggacagtgaaagtatgggatgttagagcgcccacagtacaacgaaactacaagcataattgtccggtcaacgaggtagtaatacatcccaatcaaggagaattgatttcatgtgatcaggagggaaatgtgagaatttgggatctcggcgaaaatcaatgtacgcaccaattgatcccagaaaacgatgtacctgtccactcagtcagtgtcgcaactgatggaagcatgcttgttgctggtaataataagggaaactgctatgtctggaagatgcataaccaaaaagacgtgacttcacttcaaccaataacaaagttcaaatctcattcaaagtatattaccagggtattgttgtcctcagatgtgaaacatcttgcgacatgttcagcggatcatacgactagagtgtggtcaattgatgataattttggcattgaaactactctacgtggtcatcagcggtgggtctgggattgtgctttcagtgcagattctgcctatcttgttaccgcctgttctgatcattatgttagattgtgggaccttgcaaccagcgagactgtgcgacagtacaacggacatactaaggcagctgtttgtgtcgcattgaacgatgtttaaaaggattcgttatttcatgtacattactgaaccaaatgataatttctgtatctaaactgaataaaagtacaaatatatactacctacttcttagacttcttcttctttccgtcttcctcgtcctcatcagcctttcttttcttttccttcttttctttcttttcctttttctccttcttgtccttcttttcctttttgtctttcttttccttcttgtccttcttttccttcttttcttcgacttccgtttcggtatcatctatcttctcagttttatcttcagtcttgtctacagacttcttaggagtcatgagagcaggagtttccagtttggaagctggcactggaggaggtgcttcgttctcgtggctgatgtaatcagatttccaagaatctggggtgttctcattaaccctaccaaatttgtccaactttccgtcagctttgagctgctttttcttaagagcaattggaccaagtccccatcttcttgggtatgtatcacgctccataatgcatctcttgaccttggcaactacaccgtggtcacaacttgaaaggtcaacagttgtcatctgtgcgataccaatagcaatggcttcacccttggtggtaataagaacaacttcatcgtatagctcgattccttcctcataacgcaacaaacctggaagcatcagtttggcaccgtaacaaacagcattcactgcagagtccttgactacgactcttttgtatcctatcaacaacgtttccaatgggtgaataatctttctcaaataagtttcatctctggagttgtcataaacccattgggcatccataacatcgtgcaacgtaaccaaattgtcattttcagacaaagcaccagatctgacacgacgaagttcttgcatatgaccaccaacacccaacatcattcccagatgaacacacaaagttctcatataagttccagcttcacatgaagcccaaaatactccaaggcctctcttgttatcgaattccaacaatttagagtcgtatatggttcttactctcagctgtctcttcacggcagaaatcaaaggtggtctttggaaaagggcacctgtcaaattctcaagcgatttccctagctctttttcattctccaaggcatcatggagacgtacaacacatacatactctttaccagcaccttgttgggacttaactaatctggtagctctgtcgatacagaccaataaacaaccagtgacctttggatccaaggtaccagagtgaccagtcttttcacaacgaagaattcgtttcacccaagcaacaacttcgtgggaagaagggttggatggcttatccaaattgatcacacctgaagagatatagtccttcaagtctcttttcaagggagagcacccgtgagggataggagtataatgcccacttctaaccaacaacttgtcgtagttcttcaagagcaaaggccagtccgaagtatcattggaaggagtcacggcctctggcttaattgtgtaatcagtttcacccatgataagttaacgtaaagaaaattttcagtagaaaagaaaaaaaaacctaacctttaagtgtcgtgtactcaacaaacgatgttggatgaaccttttcacatagtcactggagttaggaagtgcgatgcggtattacattacagatggatgaaggcctcccgcaatgctttagtttgaacatctacgtgggatttaaggtgcaaccaacaaccggagtctgttaatctaaattgggaacaacggacattgacaaaaaagaagcggctatttgtttatgtttaccatgaggatttcagctcaatccgtcttatataatctgtcacctacttgagttttgtggccttttcaacaacggaattgagatacagtttgggatttttttcatgctaagtcgtatttctctttcaccctttgctgaactaatccaaagtttattttgatctttcaacgtctacacattttgagctacttctgatcttctcttcgagttttgggcttcggtacccgtaacaatagtgcaaactgctagtgtgtaaatattcgcgcatcgtgaataatcctcaaacctacatgttgatgcaactagtttaccctttttagtattattccccgatctggacaaacaaaaataacgtctcacaacaaatcaagcctcgattttttgctctggaaaatatcaaccgacgtactatattaggcctcctaaggccatttttttttccattttctcttcacatccttgcgcttatttttttttgctctaattaaaagtccaaagatgcagtttggaaaggttctatttgctatttctgccctggctgtcacagctctgggagaaacaacttcttcattgagtaagtattgatcatttgaaattttttcgggagttttttttgatgttctgcaaaggaatccaagaaacatttatgaggttaccaggtaggtttttgttcagaagtaactaggttgactcaagctttcaactgttcaatctaatagcctgaactgtttgagtttacctggtagtcctgagtctttcaattacgagagaatccctgtgatccgatccctgtcgccaaattcaaatcgcccaagacggtcagccaatttgttttctgatggcttgggcgctttatgcgtcagggacgaggaactacagttttgccatacatgatacgggactatccaatgcagctcaccctttgtggtgtgaatcttgcccgtttcctaaaacgaatcaaacgggcggagctcaatggcagttccacatctgtatggagctatttttagatttttggttcctttcgcgatttgttgatcatgacactcccctaacatttcattttcttctgagataacgtactaacaatatgccaaggtgccacattgacttcaaccacacgaatttcaattgcatctggatgtagtcttgaagacttcactgctactgctcagtctaatcttgatgagttgtccgattgtgaagctgtcagaggtgatatccacattgccggaagtctgggatcagctgctatcgctaatgtcaaggccatttacggttctttaattgtcaagaatgccacctctttggtttcattgaccgctgattctttgaccaccattaccgaacaattggctctttctgagttgaccattttggacacactctcttttgctcaattgacttccgttggttctatttacttcgtcaccttgccagctttggaagagaccggtttccacactggtgtctctgacactgagtctgtttacatttctgacactgctttaaccaacttggacggtatcgttgctaccgatgtcgatgttttcaatgtcaacaacaacttcaatttggacactgttgactcgcacttggaaactgtttcctctgctttggaggtttccttcaactcagacgatgttgaagtatcctttgacaatttgttgtgggctaacaacattaccttccgtaacgttgcttccgtctctttgaacaacctgaccactgttaacgcttctttgggtttcattgagtctggtttccaaaagttgagtttcccaggaatcaccagggttggtggatctttctccattgttgacaacgacgatttagaagaaatagacttttctaacgttcagtcgattggtggtggtttaatcatcgctaacaactctaagttgactgacttcagtgaatgggaggacttgcaaactgttggtggtgctcttgttttggagggttctttcgacaacggttccttcccatctttgagagctgttagaggtgccttctctttggagtctgatggagatatctcttgtgatgacttctctgatatcaggggtgacactgccggtgagtatcagtgctctgctgcttcgttctccacttctgctagtgctcagtcttcttctagttcaaccagtactggcggatcctctacccacaccggtagttccactgctaccagctcttctagtgaggatgctggtgtagctttggctcctgcttctctcttcactttgttagcctcaattgttctcggattcttgtagacatagagaaataaaaagaagaagcagaaaagttgaatggaatatttgtattgtttagttttattttaaaatttagttcgtaatgaatgttttataagtatttctatacgtacttacaaccccttaccgtagtttccagactcaaaaaaggaaaagataatcttgacaatgttttctaaagaggccaaccattccaagagttgagcggtgaccttttcttggtcatctcccaattttttgaaaaagtccgctctatatggacaggctttcatagctaacttgaaaattggcttgatcacgaacgaatgatgcttacttaaggttttaccataggcattagtgaaagccttcgtgagttcatagtctggattgtctacagtctctctcatagctgctgcagtaaattgaaggcctctagatagccataataaaccttgggtagcggatttgcccttgatcgatgcgtctttctcatccaaaaccaagtcttgaagcgtagcagcatcgacaggtgactcaagaagctttttacgaattttgtcaacatttccttgcatgtcattttggactacagcaaatgctgaagaacccaagaggtctatcaaacggttagtacgacgtgattaagagagtattctgggtggggctagaaagttcacgtaccaaatagtttaatcaaggactccgacgcttgcaggaactcgtccgttgctatttttccatccaccaaagggacatccttgaaggatttcttcattccatcgaaaaaagttgacatagtgtgcttgtagtgagttgtaaggtaaaacaattatgaaaactaagaccccaagactacgtcaactttaagcaaaaatcgcgtttatttttcttcatccaacatttaagtttgttgtatattctagtgaggtacattttcgctactgcagcacaaagaattcaacttaaaaatatgtgaaaagttcagagtaaatagaaaaagaagatgtatttaatgttcttgattaacgtcaacataccgaatatggatttcttttattgtcctgaaacaaatactaatagttattacagattatcttttattaaggtaaaaaatgaagaagaaataaaactccatttgtgtaatataaacacagttatgaatccatattattttgtattaagaaatggaaaagaggtagtcttaaaaacaaagaatatggctttctgtagagaatacgcgttaggggaatatgaatctatggaagaatatatggataatattgaaatcagtaatactactccagaagaagcaacatatccaaaagatccaccggttgaatatcaaaatgagaaaaaactaagaatttataatcaatcagaagaaaagaaaatagacttagactttttatcatattttgaagctaaaagtaaaaaagaagcatacatgaaagagttgaatcaagaccatttaaatgacggtacttttctgtatatagaaaatgataaaagttatataatgtgtgtaaataaaacagtcgactgggaaatagaagttggatggtcgagatatcttctgcatacaatgtttgaaacatatggtatttttgaagaaatttatgaaaattttaaagtataattaagttagaagaaagttttttgaatttttgtgatttgaaatataatataatttttgtttttattctaatgagggggtgagttgagaaagtcatcaacttttatgcgaaagtcgagccttctattctccacttttcatgatctaaatggaataaaaaacagctcattgttttggttctaaattatgatgagttctccatggagaatttgttaaaaaaaattgaactattggaatatgttcccagcaatctaaaaacgcccttttaattgggtggggtatgtgtaaaaatatttttttcccgctatgctatgtgttggtgatccttgaccctttgtgtagctagaagtgatccataacgccctttaaataaatagggaaaaactacttccattcttttcgtatgttggataaatcggtgtgtgatagacatcagctctttatatacaacataaggagtttcctgtaaaatgacaaccaattgatttcactcctaaactcttgctatgaaacctttctaacaatgcttctcatgttggaatgttaaacgttatgatttatagttgaccgaattattcgtcaaaggtttgaaaaaaatagttcttggaaaattgggtcttgactgcgatggttgcggctactaaaattagaaaagtctttgattgaactttatgtaatagtactaatcaccgttgaggtgaacctatctaatatacacaggctaaatagtatagcttccgataacccaatgaaacatgaaacaaaataaaaagaaaagagaaagtatcacacaataacctgactctcaaataaacgggagtttaggctagtgtacaaggtacgtaactttatagtcaaataaagctaaagacagttgatgtcttacctgcgtatatgcaaagaaactggaaattaaacagaaatttttaatgcaacgttttgaacagatcaaaaatcttgacattaggattctggacgtagttgttatccacaatgttgaccaaaaagtattcatcatgaagtttatccagaacagctctagttttggaatctctaagaacttcaaattcgtcctgatcctggtccttgaacaacgaagaccaagctttgaaaacccggaatgcttcgtctttccaagcaaggaaggagcatcgttctacaatagtaggttggaccacttctttaccaggaaagattccccaagtaacagcgttgatgtcatcttctttgctgttagttattagctctccttgagcattcacagcgtagaaagtcaaagtattgaagttggaagagtatgacttattaagttcttcaatgttgctgatcagctttgtcaagaattttgccggaatgaagaactctaagtattgcttttgatagacaaacccattagatggtccccaaccatgtacgttatggttagaagggagtccattaacgcagggttgagaattgatggttaaaattccttgacggttcaaggccagcaaatcatctaataaaacattgatctccttgctggtttctccatctgaccaaggtagtgaagagagattaccttgtaagtaacgaacgaaaagatcaatcacatcatctatggattgcggcttaccccatagctccactgctcgtttaggagaatggcggatcaaatcaccatcacagagatcaacctcgccaaatgccggcgatctggaatcaccccatcgaccattgggaaactcgtcccagttggaagttctagaaatataggtgaactttctgttgctccaaaatataggtcttatagattcattaactcttgtggggttaagagatcttctccatggaacagtaacctgggattcaacaccacagtcacgaacagaagcgactggctgattgtgtgtgtctattagttgaagcttttctaaaaccataattgtcgatttttcaagattcatagtgtaaaagtgtaaatggttaacatagccagactcaactaacttcaaacacatatcagctactagctgcgtacccagacaacgaacttcagagtcgtcatccttgctggcatctagctgtttctggaaccaggatgggacatttatttgacaccactttgctctacgagagaaagaggcatatgtcgaaatgggcatgattccaggaatgattggtatagtaataccgtaatctctaacttttttacaccaagtgataaactgctctacatcgtagaacatctgagtaatcataaagtcaccaccagcatcctgcttttctttcaatatttcaatcaatcggtcaacatctggttcatcaggatggccttcggggtaagcggctactccaatacaaaagtgatcaccatacttctccttaatatgcttgatcaaatccttagcatatctaaaacagccagtagattcagacccgtctaaaggtggatctccacgaagcgccagaatgttttgacaacctgaatcatacgccgactttagagcttcgtcaatcacttccaaggtcatattggtacaggtcaaatgcatacaggtttccaaccccaatactgtttgcgcagtgttgatcatttcgcaagtgaggttagacgaacgccctccagcattccaagtgatgtctatgaactgcggacttaagttgtacattctatccattctatcatacaagttctggactccttgtgcagtctttggggtgaagaattcgaaagagaatgtgggcggcgcatcctctcttcgatgcgcactagacaatttctcagtgatcttcatgttaatgaagttatcagtttgaatgaacagaacgaatgaaaaaagaaggaaggtggatttttcagtcttttaatatggatctcaagtccggattttttcagttatacgaccaaacgcgaacaagtgcagagaagaattagggtcccacgatgtaattgttggattaactagactattaaaggaagtaggaggaatgtttgtttgttagaagcaattcttcactaagcagcgttcagttgatctgccattgacctattgaggggttcaaatagttcaaacgaagcaagctgaatttaaacttttgggcgaggaaaatcaaaggcctgcacctcgagttttttcttcagcttcagttttttcttttaattaggtctatacaatattctacatgacaattttcaaaaattcagctcccaccaggtctgaggttactggagtgaaaacttgaagatttatatgctattctccgattacaagagccagattctgaatcctgacccatctagttttgttgagcactcatgcatgtgaatcgaggaaaaaaccggtattgccaaatgaggataaaagactccgcctgactccacacttccctgattcagagaccgaacctcttcggataatctaggcaataaaaccgataaatgagatgagataagcagtaactttatttccagccgttgatttccgaaatataatttgcaacgttgttcgagttaaaacttttaatcttgtttagctattctagtttcattgtgcttagctttattggatcttctagttgaacagctgatactttaaagtagctaaaggatgaaatttttatcagtgacttttttcgactctgcaattcttctgctttacagattattattctcccagaagcctgtgcctataaataccagaatatctgttacgtctccggaattgtactaagtattatggtgttcctcagtttatgtagtttctctctggacaaattcagcagtgaaacttctataagtctaaaacagtagccatcctttaagaacttgaaacacaaacaacaaacttgatctaaaatatacctttctgtgtttagctctcattcaattccaagaattctcattcacggatctaagtaatggaaacatggatagcaaccgcatatactctgtcgcttaggtaacaggagcacaataaaaagattgttattgcagtatgctcaacttcctaaagtaaacaaacttggagtacaaggttaccatgaacattccaggtgataaaaatctgctaaagaaatagcaatttcaacatttggatccgcttcacatgctccacatgtacgagcatccagcatccagttgttgcaacaactgagggctgaaaaaataaacgctaggtctattcaaactagccagggttttgcttgattcatacggaccaaccctaaagaacaatcgcccttgcatggagtcgcaattggttgatgcagaggatggaccaagtggaaataggtccaaaaaagaacacagttcacccttagtctccactagcgcatcctctacatccacatgtgacacaccttaattccttttccaactgttctttaggaactctgcaaatacaagtatttttttggttgttctcatcactttgtatgcatcgcaaacaacataacttttcatacccctttttcctccattttgcaatcaaattttgatcagcatacttattcttgagaagccacgtcagtaactccttgcttatcatttttcttttgtagtatagttcatatatgtatcgtgatctttgatgatgcacttggtaaataggccataatgcctctttcttggaaattttcttggatttcgtattttcaatttctttaagtttctccgaaaactgtagtaacgttggctcgatattctgaaaaccctctggtggtggccttttcggtctagccatgataatatgataatattacaatgaggaaagttttattacagataccacaatagagtttcgcatcgaggagacgcaacgaattatataagcattttttttctatgatagttgggggtcactgcgagagtgtgttgtgagattggagttcatgtggggccagatcgtgcacggaaggtttagctccacctttttcaggggagcgtgcccccaaatcgaaagtttgatcaacaggggtagtacgagttctccgaagagattgtgaatgtgttttttctaacgactgggaagtcattgaacgagggaattcttgggcaagagagcctttgattctgttcttcatgtctgatattaaaaatgatggcctttttagtctctgcatcaaggtgtcattgcgagtattagcagtagcagctgaatggccagaactcatcctagatagggtgttgtccatagtcatagttctcataattgcatgtcttgcctgtttgtcgtcacgtttcttcatcttttcagaaggcaacaatatagctctatctagtgagtacggtagtcctctgtgtcttcctctgatcatcatagcaatgatcactaattttgatatgacactgaattgagcactgaaggatgtgttggttcctggatagccaagagacaaccctacagttccataagcagaaacaatttcaaatagcacatggaaaacagtaaatccaggatctccacttgaaagacgacctccatctgcaagacatataataaacaaccccaaaaataagaaccacagatcaaaggatagttgctttctcaaatgagtaccaatgaaagtgccaggtttattttgatgggcatcagactcatcttcctccatttgtccaggaggataataaactcctaaagactgctcttcgtagacattggttcttctaatggaaatggccaaaggaagaactgaaatgtacatcataaccatgtaactcacttggactgctggatggatgtgcgctaaatctacaattgcaaatccggcagttctagttgaaacagactgaaagataccaatcaaaactttgtacccaccaggaattccatcaaccacggatctatgaaaatctaggatgacaaaaagtagccagtcaaacacattcagaattaccagcacaaaaaagagccaccacgtagcagctgatggaaatagcagtgtaaagcatcttctcggatgatctagaaggaatcccaatgactctttacgcattgaaagtggctgggcaaacttgaagagtacccatacaatgaaacgcagcataattgggaatcctgtgtttccaatgatgataaagaatgatgctactacttgaacatatgcgttctgctgaaatggtatgaaggaattataggtcaatgtgattcccaaatcattgaacacactttgagacgtgaaaaatccccaccacgctggagcaaatccttgggacctgaaaagcctagaataatgactctgcaagcaaccaaaagccaaaaacatgattccagctaacaagtgaaacccgacgtagtagcaaactaccactctggacaacattttggtagctctatattcaacgccgcctagctcttctttctgttcatctgttaacgcaataaatgtagagttccttccaatggttggctcccacgataaataattagtggacatccctcgagtggtgtgacttgccaattctctttcatcttcatcctggtcatactcctcgtcgtcatcgtaatcttcatcattgttgtcctcatcgtacattgctgcataactgtcttcagactcgtcggtatcattgttgtttcttgaaaacactgtagaggatgctcgtcgcttcaatttgttgaagttcttggcaaccgggttctttttgataattttgtcgaaggaaactggagttccttgaaagatagacggcttttcacttttctctactggtgactcttcatgatgacgattcagcgtatttccttctgtagaactcgttatcgaaaggggcccggactgagcagtttgatggtgcctattcccttcctcgctttcaggtgcaactgcactctctgaggaaggtcttctaggacctgggattgatttccttttgtaacgtctacgccttctatgtttgcgacgttcagctgggcctttaatatgtaacactggcccagactcgctaagctctgaggtgtacggctgcttattttggagcatggcaatagacatatacatatcttggggttgaacatctttacgtcctgtaggttttggaagctcagaaaattttatgtccttgtgaacccctggctgaatgctagttgtattgacgacaacgctaggatcgtgttcatttctttccaagtcgtcccccgaatcgcttggctcactataatgttccacctggttataatgatcacgaacagaagaattggatgaagtgtcaattggcggtttatcgggcgagtcaggaatacctggttcaacgtctggattggtttgggtcctaaagtttttattgcgcctagattctaatgtttgagttcgtctcattttgctacgaagtttggagttgatcttgatgttgtcaaacgtcttttcaaaccagtaaagcctcaaggctgacaaagaaccatgaataaaaataggagtcgtcaacatgcaaaaaatgtatatcgaaagctgttgaaacagagataagtcattagtatcaacagtattcagtcctgcctgggtgcaagcgccagcagcaaaaaataaagcatcgatgtagtcaatcgtctttactgggtatatccagatagatgctaagacaaccattgtaatgatgtatacaacatgagcaacgatgaaagttggtatcacttttttaattcctggccctatacgtcgttcaattcgggacatccgcctcctaaaacgaaatccaaaggagtgaccatgcttcagttccaccttttggttaacaaaccaattataagcccttcgacgaagagtgtcgaacatggttgggaaccttaactcttctttgcaagaacttatactatgccacgcaccgcgaaatgctatcgaagattatgccgtctgcaacagactaccggccgcagcaacgacgttgaggcacggaggaagagagaatgaacaagaaacttgctcaaattcgaaagagacccatcacatactcttacagtggactggtgccttgattttcgaaattctataaaatctactctcttttgaaacatgaacaaagttgcattataatcataaaaagtttaattctacagcgcttgagtaggaggaatgaagattgtactagatttcctctcaatcattacaagcagggcctctttcacatgtctgattgcttgattctttcctgaaacagacccaagcccacgatcttatatacttggccagaagattttgctcccggcttctggttcacgcagagtcaaagtacagccctgccagaacacttattgccatctgacctcacctcatctctttcgtcacctaatttgcataagtcgtgcatttctttttttctacttcaaaaattttttttccttatgtataaatattcctgcgagttcctcgcagtggttatcttattatttccttctctctctctcctctctttctagatagaagtttagccctcttcgacccctttgactcctacaatccttataaggacctggttacattttgaattctttccccaaaacaaagttaacagtaagtttcgttttgatttaccccaatagagaggtagaggaaggcacagtaaagggtacccggccatttaatctcactccccttagttgtattttatttgcactgactaactctttttttaaagcttcgtcctataataagtattgtcatgtcttcgaacttttcaacgcctattacccctccaatagactctactggagatcggttgatgactttggagacgtatgatggaatctgtttacaaggttattcatttggtgctccaaaatcagtagctggtgaacttgtattccaaactggtatggtgggctaccctgagtctatcacagacccttcttacgagggacagatcttagttatcacttaccccttagtcggtaactatggtgttccagatcgtgaagccagagacgaacttgtcaaccaaattccaaagtactttgagtctaaccgtatccatgtcgctggtttggttgttgctcattacactgaggaatattcacattacttagctacctcctctcttggaaaatggttacaacaagaaggaattccagccatttacggggttgacacaagagctctaaccaagagattgagagaaaatggatccacgttgggtcgtattgctctacaaaaggatggtgctccattagaagcttctttgtcggcaatttcttggaagagtaattttgatcttcctgagtggaaggatcccaacgttgagaacttggttgcctcagtttctgtcaagcagccagttgtctacgatcctccaagtgatttagccgttcttggagctaatggaaaacctttaagaatcgttgctgttgatgttggtatgaagtataaccaaatccgttgcttcgttcgtcgtggtgtttcgttgaaagtcgtcccttgggattatgatttttccgccgaagaatacgatggtttatttatttccaacggtcctggtgatccatccgtgatgcaagaaacagtcaagacactttctaaggtgatggaacaagcaaaaactccaatatttggtatttgtcttggtcaccaattgatggctagagcttctggtgcctctacgttaaaacttaaatttggtaacagaggtcataatattccttgtacctctaccatttcaggtagatgttacattacttcacagaaccacggttatgctgtggacacaaaatctttaactgacggatggaaagaactattcgttaatgccaacgacggctccaatgaaggtatttaccacactgaaaagccttttttctccgttcaatttcatcctgaatctactcctggtccaagagataccgaatttcttttcgacgtattcatccagtcggttattgatttccaacaatcgaaacagctcaagccagtttcattcccaggaggcctattagcagacaacagagccaagttccccagagtcgaagtcaaaaaggtcttggtcttgggatccggtggtttgtctatcggtcaggctggtgagtttgactactctggttcgcaggccatcaaagctttgaatgaagaaggcatttacaccatcttaattaatcccaacattgccactattcaaacttccaagggtttagctgacaaagtctatttccttcctgtcactgcagactttgtccggaaggtcattaaacacgaacgaccggatgctatctactgtacttttggtggtcagacagctttaagtgttggtatccagttaaaagatgaatttgaatcccttggggttaaagttctgggtactcaaattgacacagttattactacagaggatcgtgaactctttgccagagcaatggatgaaattaatgaaaaatgtgcaaaatctcgatctgcctctaatttagccgaagccaaggttgctgtgaaagctattggataccctgttattgtcagagccgcttatgctctcggtggtttaggttccggttttgccaacaatgacgacgagcttattgccctttgtaacaaggcatttgctacctctcctcaagttctgattgaaagatccatgaaaggttggaaggaaattgagtatgaagtcgttcgtgatgcatttgataactgtatcaccgtctgtaacatggaaaattttgatccattaggtatccatactggtgattctattgttgttgcgccatctcagactttgtcggatgaagactacaatatgttgcgtaccactgctgttaacgtgattcgtcatttgggtgttgttggtgagtgtaacattcaatatgctttgaatccattttcaaaggagtactgtattattgaagtgaatgcccgtctttccagatcttctgctttagcttccaaggctaccggatatcctcttgcttatactgctgcaaagttgggtttgaatattcctttgaatgagatcaagaactctgtaacaaaagtcacttgtgcttgctttgagccatctttagattatgttgtcgtcaagatcccaaggtgggatttgaagaagttcactcgtgtttccactcttctttcttcttccatgaagtctgttggtgaagtaatgagtatcggtaggacttttgaagaggccattcagaaagccatcagatctacagattaccataacttgggattcaatgtcactgatgctttgatgtcaattgatattgattcagaacttcaaactccatctgatcaacgattatttgccgttgctaatgctttgggttcaggttattccgttgaaaaagtttacgaattaacgaatattgataaatggttcctgcacaagttggatagcctaatccattttgctaagagaatagagagctacgagtctcaggataacctacctgtttctgtacttcgtcaggcaaaacaacttggttttgaagaccgacaaattgctttgttccttaaatccaatgaagttgccattcgtcgtcttagaaaggatgccggtgttttaccattcgtcaaacaaatcgatactgtggctgctgaattcccagcctttactaactacctatacatgacttacaatgcagactcccatgatttgtcttttgatgatcatggtgtcatcgttctaggatcaggtgtttaccgaattggttcctcagttgaatttgattggtgtgcagttactgctatcagaacattgcgtgaacataagtataaaacaattatgatcaattataacccagaaactgtctcgactgactatgatgaagctgaccgtctatattttgagacaatcaacttagagcgtgtattggatatttacgatgttgaacaatcttcaggtgtgattatctctatgggtggtcaaacttcaaacaatatcgcccttcctttgcatcgtcaaaacgttaaaatattgggtacttcaccagaaatgattgactctgcggagaatcgttataagttttctcgtatgctggatagaattggtgttgatcaacccgcttggaaggaacttacttctattgaagaagcagaggactttgctgacatggtttcataccctgtgcttgttcgtccttcgtatgtgctttccggtgcagccatgaacactgtttattcaagagatgatcttgcctcttatctgactcaagctgttgaggtttctcctgactacccagttgtcattaccaaatacatcgaaaacgccaaagaaattgagatggatgctgttgccaaagatggtaaacttatcatgcatgtcgtttccgaacacgttgagaatgccggtgtgcactctggagacgccactttggttgttccacctcaagacttagcaaaggaaactgttgacagaattgttgaagctaccgccaaaattggacaagccctgcaagtcactggtccttacaatattcaattcattgccaaagacaatgagatcaaggttattgaatgtaatgttcgtgcttctcgttcttatccttttatatccaaggtagtagggactaaccttattgaaatggctactaaggcaattatggacattccagttgttccttatccaggtgagaagcttcctgctgactactgtgctgtgaaggtaccccagttctctttctcacgtctttctggtgctgacccggtcttaggtgttgaaatggcttccactggtgaagttgcctgcttcggtcacaacaaatacgaagcctatctcaaatctttaatttctactggttttcaattgccaaaaaagaacatattattttccattggttcctacaaagagaagcaagaattgatgccctctgttaagaagttgtacgaacttggttacaaattgtttgctaccgcaggtactgctgactttatccaacagcatggagttccagttcaatacttggatctgcttccagaggaaaaccaaaagtcggaatattcattatctcaacatttggccaacaacttaattgatctgtacatcaaccttccttcttctaacagattccgtcgaccagcctcttatatgtccaagggttatagaactcgtcgtatggctgtagactattctgtacctttggtgaccaatgttaagtgtgctaaactgttggttgaggccatctcaagagacatcacgttagatgcttcaagtattgactctcaaacctcgcacaagacaatcacaattccaggtttaatcagtattgctacgttcaatccatcattctctcttgagaacggatccaccaacttggagactataaccaaggctgcacttgcttctggttttacatttacctccattttaccttccagtgttgatgaaacttcaattgtcgattccaggtctttagcgggagctactgaggttgccttgtcttctgcttataccgattactcattttctgttgccgctacggagcagaattccacacaaatagcccaggttatcaacaagactgcttccttgttccttcctttcaacatatttactagaaacaaggttgctgctgtttctgaacatttcagtgtctggcctgagtccaagccaatcatcacagatgccaaaactactgacttggcatccgtcttattgatagcatcattacacaaccgtaagattcacgttacaggtgtttctagtaaagatgatttggctcttatttcattagccaagcagaagaaattgcagattacgtgtgatgtgtcaatctattctctatttgcttctcagactgagtatcctggggcagattttttgcccactaaacaagatcaggaaagtctctgggaaaacattgctgaaattgattgtttctcaattggatccgttccatcattgctcgctcagcatcttggcaagcccattactgcagggctgggtgtttctgatgccttgccattgttattcactgctgtggctgatggccgtcttgccgttactgacattgttagcaaattatacgagcgtcctagagaaatctttgagctaaatgcggacgaatctgttgtggaaattgatttggatcgtgctatgagttctttgaaatcagttaacgacatattctcccctttctcggctgctaaattgaaaggtgttgttgaaagagtttacaggaatggacagacagtttgtttagaaggctctgttgttattggagaaccattaggtaaggaagagatttacagaggcagacatgcttcgtttgttgaatcacaggatgctatgtctccattaatcagaagggctaagcgcttttccttcagtgagccaggtcagcaacttccacttgtaaatgaacaagaagaggttgctcgccagttaggaactaagctggtgtctcagcctcctcgtgagctttctccacctaatgctatcacgacttacattagaaaagagaatcctttcttgcgccgctctgttttatcagtgaatcaattttctcgtaaacatttccacgctctgttcagtgttgctcaggaaatgagattggctgttgagaggcagggtgttttggatgtgttgaagggtagagtgctgactactgctttcttcgaaccatccacaagaaccagatcttcgtttgatgctgctatgcaaagattaggaggtagagtggtttccattaacgaaacccattcttctgtccaaaagggagaaactttgcaggatacaattagaacaatggcctgctattctgatgccattgttcttcgtcatcctgaccccgaaagtgcaagtattgctgacaagtactcacctattccaatcgtcaacggtggtaatggctcaagagagcacccaacacaagcattcttggatttgttcaccattagagaagaattgggtactgtgaatggtatcgttgttactttcatgggtgatctgaaatatggacgtccagtccattctctatgccatttgttacaacattaccaagttcgtatccaattggttgctccaaaggagttgtctttgccaaagaatttgaagcaagagctgattgattccggaattttgattggcgagtacactgaactcacagaaaacatcattgcaaagagtgacgtagtctactgtaccagaattcagaaagagaggttcactgaccctgctcaatatgaatctctcaagaactcgtatgtcattgacaacaaggttatgtcttatgccaaacaacacatgtgcctgttgcaccctcttcctagagttaatgagattcatgaggaagttgactttgaccagcgtgcagcttacttcagacaaatgaaatacggcctgtacgtcagaatggctctacttgccatggttattggtgttgacttttagattaaaatattagaaaatagcttgaccttttaaaaggggaattaaggtcatgattatttgtatataaactgggaatttcaaattctatatttgctgtttcgttatgaagaatcattctcttcatcggagtgtcgtaaagtcatgtagtccgtttggacgcttgtctcggtggcttgcattaatgctctagcaatgtttatttcttctcctgggttaacttgtccatcgaacgcattagatacctgtgaatccaccggcaagtcacttgggtcttgagtatccctggtgtactgatgataatatcctgagtcttggttcgcttgattttgctgtcggcttttaccgtgtgagttctgcggttctgattgttcttcagctggttgctcatgtttgccatgacgtttttgatgtgggggaagattccgctgctgatcctgctcttgctgttgctgatgttgttgtctttgagccagttcgaccgctgccatgatattactggcgtcatcaaatcccgaaagagcgcctgatagtagagatgtatcgacgttgtctctgcttatatgtgatggtagttgatgaagctgatcatcaatttccaattttgtagagcgaggatgttgcattgatgattgagatgattcggacgtgttttgtttgctaacatgtctcgagttgtccaaagtagatgaaattgatgttgcgttgatttttggtaccgaaatagggtacttgtttggtaaaaatgtcctttttggtatcttagactggtctctgcactgtgaacaatttctaattgcagttgcaacggtatccttgattcttgaccaatgatatttatccgtgatcaaagatgtggttttgttgataccgccatgactaagcatgtgcatttcttgacatatctgtaattgcctgtgggggtcagacaccacttctttaccttttagcattaactttccgttgataagtcgataatgagacgcagacgatctcagtcttgatttttcttgtcgatctgcagagggaggatatcttccagtttccagatagtacttaatcttatcaaaacgatacgatccaatattgggatcaggtatttcgactagttcttttcctagtatcaaagcatccactgctgagtcgtgaccttttagtataccggcggctttgatctttccaattttcttgaacccaagactttccagtattcttttgatggatacatttgtttcaaagatcaagttaaaaattgcataggtgtaccctagtcttggagcccactccaagaaacattctgcaagagttcttccaatagacttgcctctgataccagcattgactaaaaagccagcggtacaaatatgagagcacctacctggatagttggctttgatataaaaagttcccagacattccttttcccactgcctttcgtcgtccaatgttggagagtctccaagcaccataactgcggcaaaagagccaaaccaataatgctgaaaagtttccaaatgtaaagtttcgaaaaatggaaaggtgtcacctctttcaatttccatgttaaactcatcacataaaaactgaagtaggcctggaggtaactcgtttggtgaatatagagggtagatcgtcgccgttgtctccccatctttgagcagtaccgtgtagcgctcaatgatagagacggggtactctaaatgacttctaaaatgctgattctgagtcacgtcgtcaaaattgctagccattagagagacctcagttgccgaaaatgacgattaggagtagagtggtaaatagacggtattttgcgaagttaaagaaagataaataaatgtatctacaacctcctaacattatacggattatgtaaagtgtatctaatcgttttttggggcatgagtgggtcgttctgatatggagaagtccttgcaacagacttgttaagaaaggtccgtatcgcatgtacattcaccttcacagagcaggcaccttccataaataatagcatttacatttttggaatggccttttagattggcagcacgaggtataactcctattttattgaatcccaatttgtcccaaattctacagctggctgtgttagattcaaagaccaaattgaaaatggagtagctataccccaatttcggagcccatttaaggtaaactttgcccattttgcttcccagaccttctcctctggctgaagggtggaccaaaaatcctccattacatatatgcgaacatctgcccacgtagttaggtttgatgtaaaagcttcccagaaagatctttgagaagtcctcaattgttttgagcgattcgattgaagcatcatggaaatcacctctcagggccaccgctacaaagttaggagcgtaatagttgaaaaattgttggtcgtccaggggctccttttggggatatgtgtcaccctgttcaacctcgtagtttaacaagtgatggatctgttgtagaagcctctttggtacctgagccgaagattggaagggatatactgtgatcgagggggttattagttcaggatctagagtagaactcatttggtagattttgggtagatcgcccacacctgcgaattatatggggagggagggatttttccaaaatgagatggctccaaaaaaacagtcatgaagtgtcatagataagagataacgaaggcattaaaaacctgaccctgaatataagtatgagtttcaagtatatgagaatactgtgtaattcaaaggagcatattccaaacttttgtaagctctgatgagaggcaaaagatgaacgatctattggggttaactgcctagtgatgaagaataaattagaaatagcgcaacaaccggtgtttcggcttgaaaaagtatgagtaaaataacggtatcatcttgatgtagttatggctcctattgaatctttcgacattcaaaataagtggcattgacattgtccggcaaagagcagaaataatcaaatttctgcattttcttgaacagttcaacacagttgaaccctaattttatacaggactggccacctgtttcattgcttctacatatcagcgattcattggaacctttctgtccgtcgatggtgtacatggctaatggtttttgggcaacaaatgattgcaatgactcctgattctgaggctcttgtttggacaggagttcatcgggtggagtggccattgtgctagacttcttaaaccaagacattgttgatgttaaaaatactgggtcgtaattgctgtctgttttaaagatgggcagagagaagctttcaaattatgcttttgaagcaatttagtttttcatggcgaaagcagatgagatgtcagcattttatttttattctcccccatcgcaagatttatgctgagatcaattgcaaggcaactacatacaataagtgtagataatggcaagcctcctctgttggttctagcgtctattggtaatcccgaatcgtcatttagaggcactcgacactccataggacaccatattctcaatagattgaaacaaatctatcaggcagatgagcagttgacgatcgacaaaaacaagttctactacaatagacgggaagagccacaagtgctcttttaccagagcaactccctcatgaatttatcagggaagcccatatcaaaagctttcaaatctgtgcataagtggacggatgagtacaacccagtattagtcatactgcatgatgaactggattgtccggttggaaaattcaaaactagaaggcaaatgtcttctcataggggtcataacggtctaagatccataaaccaacacatgggaggcgggtttacgactatatcaattggaatagataggcctgaaagcaagagctcaaatgcggtcgcaagttatgtccttgctaaagttcctccacatgacttggaacgcatagatagaacaattccttcaattcagaagacagtagaagacatgaagttgggaaaattgatcttcgatacgaatcccaattataaagggtaggggggtggaacactacaggtatagatatagtagtatagtagcataataaacgccagtgaaagtacgtgtgctttgacaaatgtaagagccctgagatagagattccacaggtacaagagtaaaccagggtaaattgtcaaactcaagtatgactcctcaccttatccttggaacttttttcaatcatctcatctatgccgcgtgtgggtagttttcagatgtctgttagatcttcgcaactgtggcatttataatcattccatcttagcctttttcttttcttttcttttcagaaatacatactatgtcagacaacaaccaacctttgccaccggtttccaactccattctggagcacattggaaagactccacttgttaaacttaacagaatacccaaaattcttaatttgaaaccacaggtttatgctaaagttgaactgttcaactcaggtggttccatcaaggaccgtattgctctgagaatggttgagcaagctgagaaagagggtagaatcaagccagggtacacgctaattgagccaacgtcaggtaacactggtattggtctggcattagtaggtgcagtcaagggctacagaactattatcactcttccagagaaaatgtctaatgaaaaagttgctgtgctgaaagctctcggggctgaaattataagaactccaaccgaggctgcttgggattccccagagtctcacattggtgttgcaagaaggttggagaaagaaattccaaatgctgtaatcttagaccagtatggtaatgttaacaatccagatgcccatttctacaccactggtgcggaaatctgggatcagactaatggtaaagttacccacgttgttgctggtgcaggaactggaggtacgattacaggtattgccaaatttttgaagtctaaaaaccctaatattcaaattatcggtgctgatcctcatggttccattctagctcttcctgaatcattgaacactagtaatgagcaatacaaagttgaaggtattgggtatgactttatcccagaagttttggatagagaaattgtggacacttggtacaaaacagatgataaggattccttcaagctggccaggcaattgatttctgaagaaggaattctagttggaggatcttccggctctgcgctttctgctgctgttaaaataatcaatgatgccaagcttgatgaaagtgctgtagttgttgtcgtttgtccagacagtatcagatcttatctaaccaagttcgctgatgatgactggatgaaactcaatggattcactgaagacgagcctgcacctctcaaaaggaagtccagcttttcaaaggacactctgtcgtcctatacgatcaaagatttggcgctcaaacctgtggtctctgtcaccattgacgattcaattgaatccacaattaatatccttcaaaccaagggttttgatcagttaccagtgttgaagaacgataagcttgctggtattgtcactctgtctcaattgttacgattactttctaataagaagattcatcttacttccaaggtagaatctgcctactttgatttttccaagcttgaaaactttgaaaaatcttacaacattaacaaggagtcaacaaacaagagaagagaataccagaagatcactactagcaccacgctggccaaattgaacaagttttttgagaccagttcagctgctatagtagaaaatgataagggtcaaccgatccacatcgtttccaaggttgatctgctttctttcttagcctccaaaggagagtttaattaatatgtaaactatgcagaattttagaaaagatatttccgtgcctgcgtaccatctaggcatacactatctattccgtacttcgtattgcctccacctttacacctcaatgcgatctagttcgagaaatttcattcatgagcaggccttttacaaactcctcaagaaatgtttgctaggtccttcttctttcaatccagaacccttggaacgaggctcacagctctaagattccagtcttcagcagctaataagcgcttgcaggagctagtggagaaaatggaccaacatccacaatgcaaggaagcattagcaagagtcggaaatatcattaaagaaaagggatatggagctactgacccaaagaaattgtcctcaatttccacgcagttgaagtttttaatggataaagacataagggaatccttgggaaatttcaagagagagctggataatgctggaatctctcttactccagaagatattaagaattttatgggattatacaaagatagattgattaaataaaaagtaaagcatggatttgatctaaagatgaagaaggtggttcaactaaacttccacctattaccacagttctcacatttacaaaaggtggtcaacggttcatcagccgaccttgtctgtttctggaagtaactgaccttcctttgcttacacttaccacactcaaatctatctgtaacagagttattctccgtggcgccttgagcgtcaaataagttcttcttgtatatttcctccatttcctttttgagagaatcgggagctaactcttgggcagacatggtcactagtttggatgggattatttcgtgatctagaatagaccttcgaagagttggattgttcttattcttcaaattcattattaatgaccgtaatttgtttctataggtatcatcaacggtaaaattgacagctttgaaacactgtttctcaatatccttgactaactcaaagatcttgctaggctgttcatcagaatccatagccaatgctgtgtatatggcgctaatagatccgttacgagtcttgttctcgtagatctcaactttgaccccgtcattctttggagttcttggtcctttactgacaaacctctcattcgtcgttgtactggtcgtactcttagcaggactacccgctgaactaactgctttctttttcttttcttgagatacgccatccttccaggtctttataatcttcttaactaaggttccaacctcaggatttgcgtgagacctgagcctattcactgtgacaccaactttggtctccctcaaaactttctccgtgggaacaacatccgtctgcaaaagtgttaaaagccttattatctgggaatcactttcggccttttcaaggtctttcatcacagtgacgatctcttttgcgtccatttggtgcttcacctcggttttagtagatccgcagaatttgatagactgagcgcttgttaaaagtatacgagcgcgaaagatttttaaactcctaggaggagtcacgctggctagaaggagcacgaaaaacatggtagggaaccaagttttgaaaggcgctatttcactttaatatcctgaacttcacaagccctctaatgaatcaaccgacaaaggtggtgtaccttgggtcacttccttttgatcaaactgaacagcaggtgctagaagttgcaagaagtgtggggcctgtagttgacttcaaattattttttgatcaagaaactgggaaaccgaagggctatgcctatgtggagtatcaagacatggaaacagctgccagcgctgtcaggaacttgaacaattatacaatgggaaacagaaacatcaaatgctcgtattcaggacgattaagcatcgaagataacatagcagaatcaggcgatgggatcaaactacctcctttacctttaggaattgacttgatcggtacttcagacccgacagaattaacgtttaaggtggtggagactttggagtataataagctcctttctgtactgaaggaggctcgttcaatggccaagacgtcgccgttagcgatgaagaaacttttggatgaaaacccacaactggcctacgctctggttcatgctggcaatctcactcataagatgagcccagatgatataaatgcggttttagctaagccggttgcaaatggcgtacagaatgctgctgcacaagagtttgcaagccttccccttcaagcacaggaacaaatacgtgcagtttgcgccttgacacagaatcaaatagagcaacttcagccttccgagaagaacatgattatacagttaaaggagaaatactcaaacgtagttaataatatatagagagagtttacgattgtaatcagtatgtactacgccaatgcactgcccttgtagaagttttcctgccactgtcgttctccttcgagcgtcccatagcttaaatccaccgcgaggtgaactttttggtttcatcattctccctagcagtgaatgagttctgtagtttacctgggaggtatcccgtaccactgggatctagataccataaaaagtgttgtctatggaagcggccgcatagtcgatgtcagatgtatgatggatcatcctggaaagaataaaggattttgcttcgtagaataccaaacacctgcagaggcagagagggccgtcgatatcttggcaaggatacacattcaagggaataatcgtacactgagagcagagttatcaaaagaaggcttgcgatttggtgcggtgaccaagttgaaagatgagcttattcttgatcggagtcattttcctcctaatgtaacgctaccacctgagatgacctccaatccaaacgtcatgggaaactcagccatgaacggtggaggaggaatgcatgataatggcttaggtggactggacccatcaatgcttcaacaattaagtgaatggtcccaaaatccagaaattgcgagtataatacaacaactctcaaacaatggaatgaacattcaacagatataccaaatgttacaacagtcgatcaacaagcctccacaagagcaaatgcctacgaactttgttcaaccaatatctggtgcaaacatggaaggtggtgcggatgtcgttcctgagtatctattgagagcttctgaccttcttgaactcaataccgcactcccgtttagaaccgacagtgtaatttctgaaaattgctctaaattgactccgccggtattcgttcaattgatcgccaatttgaaaaatgccttgaacaaaaacgcctcccttgaagataccaaaaaccttttgcagaaatcacccgactctgtaactaatattgctcaagccttacttttgatgggcttaattgacgaatcagtgattcaatatataacaacaaagcagcaacaacaacaacaaagtatatcgcctcctccagcgcaaaccccaacccctgttctacctacagttactataccaccacaatttcagggtctacaacagcatacggttgaaaaattatcccagcttactccacaggaagcggagatggttgcccaagtccttcgatttgccccatcctacatccagacactacctcctgatcaacgccaagtagctgaacagatcagagcacaatacttatagattcattggattaattatgtaatataggaaatgtatctccttgcgcgcgctcggttctgacatatttatagctatttgaatagtctgtctcacccagcgactctaccctactaacacgtaagataatttctgctgaacgaactgatggggctgaagaaactattgaaacttcaacctccctctcaagaggaaattgaaaagcaaaatagagaaaacttgcaagctcagggagttagcattcgctccgagaaaaagagaccagacaagtttgccgcctttaaacagtacgcccaagacaaggtcactcaatctcccacttataggccagtttccaaagagtctgttcaagcaaattaccagccttatcaaagcgatcgaaaactcaagaaagctcaagaggaaaagatctccgcttccaacagtaataacccttacgctcagtactccgatagttatggggctcagtccggaaccaatggttcatcaatttccaacttaaattcccaagagtacagtagtggacgcatcaataacccatattctagctacgaaaattcggaaaacgtggcagctttggaacaagaagaagagttgtcgtttggtggcgctaatgatgctggccctcaacaattgagaagactccagaccaaccagacagcacaaactaatggattttctcaatttggtgacttgaatgatcttcctgaaagcgtattaaacgctcctgtcagttcgcaagctcacgagcaatcacttatgacccctgaggaaatcgaagaggaggaagaagttgaagcgattaaacaagatatcaaatttaccaagcaacagtcagttgggtccacaaggaatacgttaaggatggcacaagaagctgagcagtcgggtcaaaatacccttggtgttctggggtctcaaagtgaacggctatacaatgttgaaagaactttggctttagccgatactcagaacaagattgctgatgacaaggtcaaggaattaaagaaagttaatcgttcgatatttgctgttcatgcaggaaatccttttaattctaaaagaagacttagaagacaggaagaagatataaagaataggaggatggaagagaagttgatttcagaacagctaagatctcaagtctatcgatcagaacatcgtattacttccagtttaagagaacaaaatgcaaagtcagaacttcaagaaaaatacgacaaagaacggaagctcaaagaggctcaaaggtaccagtttgaaaatgattctgaagacgatgatatggagttggagattgccagtaacttggaccaaattggaaatgctacctctagattaaaaaaactagctgtgaccgctagtgaagaaattgatcaccagaataaaagactgaaaaacatcgaagaagatgccgacaggcttgatattaatgtccacttgaaccaacacagaattcaacatatacgatgaagaaaatttgaatttaagttaatcatagagggctggtgcaaattaaataaataaataaatataaaacttaatggtgatgagcgtcatgtggaatagggttacttacgaccttaccatccaacaccttacccttggaagtccaaccaccgtaagatacggactcccctaatttagcctcgtattgttttattctctccaccatttcaggacggaacgatttgatcagaccttgaacaggccaagcagcggcatcacccagagcgcaaattgtgtgaccctcgatctctttggaaagttcgtaaatgaggtcaatttccttctctttagcttgaccggtaacgaaacggtccatcattctttggaggtatgtagtaccctcacggcaaggggtacattgaccacaggattcatgcttgtagaaagcggaaaatctctgaatggctctaataatgtcagtctgtttgttaaggacgatgacagcagccgttcctaaaccggatccaacatccttcaatgcatcaaagtccatcaacacatcctcacagacgtgtttgggcataattgggacggacgacccaccaggaacgacacctaataaattgtcccatccacctttgattcccccacaatgcttctctaagagttccttcaaaggaatagacattgactcctcgacggtacaaggctcgttaacgtgtcccgagatacagaataactttgtaccttgatttctgtctctaccaaatgaagcaaaccatgctccacttcttctaaagattgttggagtgacagcgacggtttcaacatttgttactgttgttggacgaccgaacaaaccaacacctgcggggaaaggaggcttcagtcttggcttaccagctttgccctcaatggactcaataagtgcagtttcttcaccacaaatataagcacccataccacggtgaatgtaaacgtcgaagtcgtatccggaaccacaggcgttctttcccagtagtccagctttgtaagcctcgttaatagctgtctgcaaagcaacagcttcgttgtaaaactcccctctaatatagatataggccgcagtggcattcatggctcttccggccagcagacagccctctaccaatttgtggggctcctttctaatgatttctctatctttacatgttcctggttcaccttcatcagcattgaccaccaggtattgtggttctctgtttgggttaggaggcatgaaactatacttaaggccagatgggaaaccggcaccacctcttccacgtagaccagaagccttcaattcgttgataagccattcgtgtcccttgaggatgatttccttggtcttgtaccagtcaccacgttgctgtgaactcttcaggtcttcaccatatttactgtacacattttggaagatacggtcactatccttcaagccactgaagaaacgcttggatacaagctttctacccacttgttgtcttagcatgattgtgacctttgtctctatgtgagagtttagttttctgatgatgtttcgatcatcgttgattggcctacatcggacaacgctcgtaaccgatgaggtaagcgaataccgttatggagaattgttatttgaccagtagtagaagcagcgcgaaggctagagtcccccacaaaatgatgtgctggaaaggataatgaaccgagaatgacaatccctctttctgttctacaaattaccgaagttaaagaatctttaattaataataaatatagttagcctacaatcttgctgcagagtcacctcttggagatagctgcaatacttctttacgaatctggtcaccaatttcagggtaaaccttggagaagtattcaaaaaccctgtcttgaatttcatggttggcagccgcaacgtgaacggcaacgttgtggcagaagttacgttgctgaccaggagttttgccgaatactttccaaagcgctcttggctgttcaaaatcgtagctcttactgtcaaggatacctccccagtggaatttctcagtgtgagcagccaaaacttcttctggtgtgtgtgaattggtctggatctgtgcctctgtagagaatggacagaaagaagacttgtagttgggagtagacccaaggttgccattgacagtcatggaaccatcacgcatctgaggggtaaaaacaggagccactggacaattgacaggaatctgctgatagttaacacccaatctatgacggtgagtatctgggtaggagaacagtcgagattgaaggactggatcagcagatggctgcatactagggatagtatgagatggagagaaggcggcttgctcaacttcggcaaagtagttctttgggttttcgttcaaagtgaatttaccaaatctcctcaatgggaagtctttgtgtggccaaaccttggtcaagtcaaacacggaaaatggttgcttggcagcttgttcttgagtcatggtctgaatgtaacaagtccatgaaggatactcgcctctctcaatggcgttgaaaagatcaccggtgtggtagtctggatcctcgccagcaagctttccagcctcttcattgttgaagtttacgacacccaggtccgacttgaagtgaacttgtacgtaaacccactcacctttcttgttgtaccatttgtaagtgtgaccagagtacccgttcatttttctaagagaagcaggagttccacgatctgagaacaagtacatcacctgatgaatggactcttggttgttaacaaggtaatcccagaacatattggcgtccttcaggttagtagcaggattcctcttttgggtgtggatgaaatgtgggaacttggatggatctctgataaagaagatgggagtgttgttgtacacaaggtccaagttaccttcctctgtgtaaaacttggtggaaaaccctcttgggtcacgggcactgtcggcagaacctttctcacctccaacggtggagaatcgagtgaagatacgggttttcttcccaatagtatccaagaatttggcagcacaaacgtcagatatgtcgtcagtcacctcaaactcaccgaaagctcccgcacctttggcatgcacaactctctctggaatacgttctctgtcgaaatgggcaagagaatcaatcaattgaaagtcttgtagcagcagaggcccaactttgggggcattgttagcgtgattagcgttgtcgaaggtggctctctctgtagcaaatacatcggagacaggagcaccatttgatgttgtccatttaggtggttgagacattttaattgtaagtcttgactagagcaagtgttatggtgaatttcaagtaattgaagtgctgggtctacagcttatatatgattttggcctgatgagcaacagaggctatcaccccgctgggataatgaaacttaccgattgcggcaggctaagcgaaaagtccaggccaatcgagggaagttaattgctcagctttcctgactaatcccaactttgaggggtgcatagtatggattcggtctcgtgcgagaagcttaaactttgttcaattccattagtagagggtatcatggaacttgcatgtgatgattacttcatatgatatcaggtactagcaatctcgattcgaatttattaggtaatgccgaccggaacaatagaaagacttcaagattgctaaaagaccaataagaacgtgtacagatgtcaggccatgagtttatttaagtgatctatgctacaattaaggttacaggagaaccgcattcggagttcgattacgtagaaaaaaatgtggtgaaacagtttcataagagttatatactttattatttatagttaaatatatggagaagactgtagttagatatcaaaatcataaatataaactgtgcgtatatttcagaaacttcgactcgttaaatctctattcaattattattcctcatttattatatatatgattacacactttagtttcctctgcgtctttttgctctttcccaggcggaggaagcagtatttttattcttcctcgcacttttcttcatgtcttcatctctgtccttgccaaagaatgaccaatcctctcctgcaaaggtgttcaatctatgatctttcttttgtttctttgacttctcagtaaccgaagttggtaatctagtgaaattggtctcctcgtattctctgatctcttcctctctatcacgctctctagatgtcttaacacctcctctaccatgtgccatgatgttagacccaacactctccgtcaacataggagcctcgttggtctcttgcaagtattcctccatactctgcaacttcttgtgctttttctttgatctttcctggttggcttcactacttggaggtgcaacagctgcaattctgggtggtctatatttatcggaagaacttgaagacaaaggtttggaggtgcttgatttgagtttctccaacatagctgaagggtttggtctgtatgacatgccttcttcttcttcttcttcctcttcttcttcttcctctttctcagcttcatccatctcttctttttcttctccatcttcgtccaactgttgagtttgtttctcttttaaatctttctcgtcttgctccatgcgagtatatgctcttaccattttttctatttgatactgtaatcttttctccaaacccttgactcccttatcaagagtaactctctgcacaatactatttttcacgatcgattctctctgaaagttaaactcttcatcctttccatttaacttcattctctcaatgttacttagtataatgagaatcaggctattcacgtaggaagcgatagccgagttcttcaagtctaacaacgatactccttcaacatcagacccctcacccttgacagcttttatgatctctggaagttcactatccaaagaccccaacatttctttaacggccttctcggtagtttccactgaagcgcttatggtctcaattagctcttccattttatcagattgtgtcttggaattgcgtcctaatatttttttcttcatccgctaaatttattttttcatgtcaagttactgcccgatacagaaattgcagtagttcgcacatcataaaatttttttttcaactagtttcaccccttccttagaataaccctttaccaaccatgcctcagaacgagtacattgagcagcatatcaagcagcatggtcgaagactagatcacgatgaaaagaagcgtaagaaggctgccagagagggtcacagaattgccaaagatgctcagaatctgaaaggttggaagggtaagatgtttgctaagaagagatactcagaaaaggtcgaaatgaagaagaagattaaggctcacgaagaatcaaagatcaagggaccttccaaacctaaggaggatgacggagaagctttacccacatatttgttggatcgtcaaactaccaatacagctaaggccatttcttcatcgattaagcagaaacgtctggagaaagcttccaagttccaagttcccttgccaaaagtgcgtggtataactgaagaagagatgttcaaggtcatcaaaactggtaaatccaagtcaaagtcgtggaagcgtatgattaccaaacatacttttgttggtgaaggttttaccagaaatccggttaagatggaaagaattattcgcccatctgccctaagacagaagaaagccaatgtaacccatccagagcttggtgtcactgtctttttgcccattctggctgtaaagaaaaaccctcaatcccctatgtacactaaactgggagttcttactaaaggaactatcatagaggtcaacgtttctgatttgggactggttactgcaggtggtaaagttgtctggggtaaatacgctcaaatcaccaatgaaccggacagagatggatgtgtcaatgcagttctcttggtttaagtgaaaaagaaaagaaacgtcctacaacggtactatcacacacagtcaccttcttctttgtacattactactatctaccatccgactcaggttcagatctcaggctagaaaacttataatacaacaacatatcactataaaattaaatgttttgatcgacgtagttttccatttcaacagcatcttgatgcacccaagaaccttcttcgttatacaactttgcattcgtaaacattgttcgtagttcttgaatgaaattatcatacgtgtcaaaatctccatccttcaacttcttttccagtcctgtaacacaaactggttgcttgatcagttgatagtagtcgggatactgttgtttgttgggtagactcaaaaataaatctaccctgtgacggtcttcatcttcgggcttcaaacttttaatcccttcaattaatgacagagccttatctgtgaaatctggcaaagacttcttggtcttttttccttttctttttttagttactggttgttcttcttcaccatctataatatcagtgtcattcacgccttcatggaaagagacttcccaatcatcatcttctgcatcacccaatccccttttagctcttcttctagccagagaatctttcttacgacgaattgcatcttctacagaatcatcatcgtcatccatggcctctagccattgctcttcggtcaatccatcgtcatacataacccttttcttttctcgggtgcgccctagttcaaaggtaggctgctctaagtgtttgccaacatcttccttgaatacttgaggcagctcttcatctgagaaaagtctcggatgggtctgtccatccatacgagccttagcaagcctatcggtgtccattttgtcgaataaaatcttttcgtcttcagaacgtgccagtatctcgtttagctcgtcatcttccatttcatcatcactttcggcgttgccttctcgtttcaattgttcagcttcaattaatcttttcaggaatgcttcttgctcctcagaagttgatttattgtcgaatttaccagcttgaataacttttccgtcaatgtctaacttttggtgagctctttccaagataacttcttcaaccgagtccgttgtgatcagtcttaaaattctcacttcgttcttttgaccaatacgatgtgcacgatcctgtgcttgcaagtcctgatgaggattccaatcagtgtcaaaaataatgacagtgtccgccgtttgtaaattcaaacccagcccaccagctcttgtggacaaaaggaagcagaagtattcagaatcgggggcattgaacgccttcagcatgtcttgtctgtcatcagcgttagtactaccgtccaaccttaagtatttcatctctctatatctcaaataatcttccataatgtccattacttgggtcatctgaaagaaaatcagaactctatgtccagtggcacagaacttgggcaatacacggtctagcaactcaaacttagcacttgttctccaaattaagtcagctgtgcttctagtaggatcaacaacattttccacttcatcaaacacgaaaggatggttacatatctttcttaattgcataatcttgttgtttagacccttaataccacttttcgataccccgggcccagaggatgcgccaataaaaagagcattatgcttcagcatctgctgatacaaagccgcttgtaaacttgagaacttacatttgatgactttctccactttgtctggcaaatccttttcaacatccttcttcaatcttctaagcaagaagggacgaagcaccttatgcaatcttctaataaccaataaactctcctcctcagtcaactccattttgtcttgagtacctgtattggcaaatggagtgttgaaccattcatcaaacgatttcaccgaattgaaaatcttgggtaacacaaaattaagcaacgcccacagttcaggcaagttattttgaagtggggttcctgtaaggataagtctattccttgtgtgatagtaatttgtaagcgtgtacgaaagtttggatttagaattcttcattctgtgaccttcatcaatgatcatgtgagcccatttaaatttacaaagtaatggtctatcttttatgacgtattcgtaagtagtcagtaggacagtgaagttgccggaacgaatatcatattgtagcatttttcgttgcgactgagcacctttgtagactattgttctgattgaaggagcccacttttcaaattccattgtccaatttgtaattgtagacagtggaacaatgaccaaaaacttaccatattcttgtttatactcaatcagataggcgataagcgaaatggactggattgtcttacctagtcccatttcatctgctagaataccattcagatgattattatataaagacaccatccattcaagacctttcacttgatattctttcaaggtaccacctatcaaaatactaggctgtttcacaccttctttgatgcggtgagcaacttcgtagtaatctaccttctctcttgttgcatctgggttctcgttttctatttgtggggcttgattaacaacttgagactcgttttgttgagctttcacagcattggctaaagagtctaagaaggagtttgtttgttttaaaagatgggtaattcttgtgtcctttgtttggtcaagcagtttcaaataggcctcctcatcgttagccttcaaagcctgcaatctctgtttagcagtcttttcaagttttttgctttcgtctttttcaatgtagctatgaaggtttcccattactcttccaagattggatctttgagtagctttttcggatctgatctctaagaactgacttacaccttccaggatcttttcagatttgcgtaactgaagattcatttccagccgtttcttttcctttttctgttgctcttctaattgttcagcgagacgagcagtctgaggagccctaattttgggccttgtgtgaactgaacgagtggcagctaaccttgtatggttcttcgccaagtaatcaatgctagaatgagacgaggcaaactgctggctcagcaaagatctttttaaatgtttctgtttgtaaagtaatctcaaggatttgagttcaatcaacgctctcaccttcaagtcgtctacccctaatagcggtttgtcagatgggttcgtaatattttctaaattgttgacatcaaaggtacccaagttgttaggtaaattttccaactcaataatcctatttgcaatctttttcacaacgatctcctcattctgagggttggaaacggcatgaacagctggatcagccttctttaaatcgggctgcaaacctagtaattttgccctttgtttatggtcttccaggggtaacgcaatcggatattcaattttgctgtcctcactgtcttgatattccgaagcaaaatcgctttgtagatacgttggtagatcaagatccttacttagtaattgcaaaccaacaacttgttctcttagcaaatcaaggtccaaatcaccatccggtttcacagatgagtaaaaggagttcaaatctgcaatatatttatcctgctgtttggaaatgcgcttgaagaggtactcaatagcgagtttgtcagcttgactaccaccattcgtctccagttccctgaatcgagccaacaacaggtgcaatttttgtgtggattcgggcatgggcagtacagctggttgagctgaaccattcacaaactgctgtttcaagtcaaacatcttagagttggtgccattcggagactgtgatctctcaaggggaacaggcgtgtttgttattgacattttgcctgaggttaggaacaaacaaaaaggttgattgatttcagagagattcgtgtactctgattattcgagggtgagttcgggggttggttggtgaacgaaaaaaaattctgaacggctgagattattagggatgaatcaggtggttatagagccggagatggactggtatagatagtggcacaactgagagggagatgttttagccaaagtattacgtctttatcctagataagtagtaattatccggaggcattgtgagataccaggtaccataaccatacaacaggttcaatgtggttacaggatacgatagaaggattcataggagctgcattacgactctgttccactactgggcgtttcaaggtgaatggaaaataaaccaaggaagtgctctctggctttctggaaaactttaagtcatcagagatttaagtccctcggttctgcgtgggcgctaaaaacgatcccccactagctagctctgctctacttcagtcatgtctcatgatcacgatcatgatttggtcatattcgtgcaccacataattgtgtccaatcaggaatgaataatttcaaagacggttgtaatgaggcagatgacataatcaatcgactgtaaacctagtgagagacttttacccaattggcgtcgaaatagccgtgaaacctagctagattccagacagaaaacgtctagggaatcgtagagaatataaggctttgaacgtctgtacagtttcagctcaaatctgcggaattaaatgatcgtctagactgtagtagattacagttatgtatccccgcgccatctgcggaactatattattcatcggctcacttctagaatgcaggaaaattaggtctcctctgtgggaagcggagaactataaatactgccaatatccacatattgattcttcctaggctattatactttttaacatgtcgtccattgcattccatacattcagaggttccagagctaagatggctacggccctccttctgacaggagccgtgggagctggaagctaccactacgagaaaaagagacgtcaatttaacaataggaacaataacaacaataacaataagaacaacaagaattttgccaaagctctattcggattttctacaggaactgctgctgccactttaaccgatgagagtaaagtgaaagtagctactttatcagatatccattctttcaaagaataccaacaggtctataatgatatcgccaagaagatagaggacgaggacgactttgacgtagacggatctgctggacctaacttggtgagattggcatggcattctgctggaacttacgacaagtacgacaagaaccctcataccaacggtggttcttacggaggaacaatgagattttctaaggaagggggtgacggtgccaataacggattagccaaaggaagagagtttctagagccccttttaaagaagtacacatggctttcacacggtgacttgtggaccttggctggtgttgttgctattcaagagatgggtggtccaaagataaaatggagaccaggaagaaaagatttgtctgaagagtaccaagcaccaaacggaaagctaccagatgcagctcaaggacctgattatgttcgtaaatttttcaaccgtctagattttaccgatagagaaatggttgctctgattggtgcccacaccctgggaagatgtcatgttacgagcagtggttacgatggaccatgggattttgctcctaccatgtttgacaacggatttttcactcaattacaaaaaggagtaggttcaggtgaagggcaatggcatttgagaaaatgggatggccctgaacagtacgaagacaacaattccaattctttgatgatgctgcctgctgacatggctcttgttcaggatccaaagttcaagaagattgttgatgagtttgctgcttcacaggaggcatttttcaatgagtttgcccctgccttccagaagctgttggagagtggtattcatttccccaaggaatccaaagagttggtgttcaggacactagacgagcagagttagattcaacgtgaatcatatattatttatttactcattttatctgattatttattgattaatcttgtttggttttgttgagctaagttaagttctttatttacatacacaccctagtgataccagtcaattcagtggtttcgaaatctcagacaaactcacgagccctcctcctatacgaattgcagtctcttagccattgacggtactcctttaaagaacctattttttcaccgtagtaatctggaactgggttggcaacagattgtctcgtggcatcaactctatttttcttaattcgatccaaaaacactttctgcttctctgtaaactcgtggataatcttcctgtgtctcaagttgaaaataccgtccccaaataaaggccctagaagatatcctaaaactgaagcacccatcattccaatggcagatgccataaatgggtcaattccaaagattaattcagttggattcatttcgatttgcgaaatatatccccatgaagctgaagatgcaaacagagcactgaatatggaggttaccaagttgactcgtcgttggcttttacgtaaagccaagaattgttcccaatttagcggattatctgagtgtgatttttgtggttgtgcctgttgttgcatttgaggaacagacaaagcaaatgatctggtcaacatctgattgacacctaaggatctgacaccgatatttctaattgaaagcattttcggccgtttgctagtttcaagtaggtggaaatagaagggttgacttgatcgtaatcgtgagaaatttgaccttctctgaggtagtgcatctactaaattgcagattcaagatgattggggaccatgaagacataaaggggttggtggggttgacagaatgataatccaaggatccaaggagacagaggcctaaagcgctacccaatatgtagtactacttagttttggccttgaacttgacttggctcatgactaatttctgggataaaacaagatcgaaaaattgagaatatagggtcttgaatactagcctagttcacaaccattaaaaaaccacctatattggatgatccaaattacaataggtgcaccctgattgttagttcaagtcgttgaaccactcactatacacaatgtaataagttcgagcttacctgaaacctaattcgttatgagcgcgcgcagatgtgttatctcgaaatctaaatatctttaacggcgtcaagtaaatcaagaaacacgaacatctttttctaagcatgtatttgggacggtcggagaaagatgctttcaaaccaaaaaagaatcgtatacttgtgcctcggtcattagcgatatatttggtgatcagcgtacttttgacaaactttttggttttccaattgttcaacatcaacctgattccattcctaaacggtcgatcttccaagaataattttgattatctggtcaagaaagagtttttgaacctagaagaaccatatcgtggtttctacaaagaggagattgaaaatcctaccaattattttttccctacgatcgaacatgcctcccgattaaacgaaatgggattagacaacttgtttcagtatactgttgacaagcaaaccaaggttcatcaatacatgctggatcctgagttaaaatatgaagaccagccaaaggggaacgaactagactttgttcgaagagaatttttgagcaatggcatgaaggtgcatcgtggtgctaattctccagaattggttattgttacaggtattgattttgagaccttcgatagtagctatttgggcaatattacacagaatagaattgattatgcccaaaaatacaattttggagtctatgttcgttggattcaggagtttgcaccccagttcaataactttcagcaaagtaaggattggactaaggctttacttatgagggctgcaatgctggccttcccgaattcaaaatacttttggtacatcgattccaactgtttcattatgaacatggaaactaacatcattccatacattcttgaaccacacgtgctgggtcctatcattttaagagatcaccccctaatactccctgatggtggcattaaaacctatgctaacatagacccaaaagatgttcatttgatcttgacacagtcagctacttccattagaactgacagttttgttatggtcaattcaatctactctaaggcattgctggaatatctttccgaccccctatttaccaattttagcacctttgcccatggattctatgctggattgactcatttgctacaatggcatccatattttctttccaaagcggttctcattcctcagagaacaatagctgccgaacattcttctgtaattagcgaagatgagaatgatatgagatcttaccatgagggagatcttctgcttctcatgcctgattgtgtcaaaaataatgattgtgccaagatattggaaagctacactaagaagaagaaaagccaatcttagtttcataatagaacgaaatagatatatactcatacactttgtgcaacagagacctctgttttagtagtctcttcagttttgtggttgtcaactgcttggtcctcaggggattggggttcgtcgttaccaagacgctcttctaatacttttaaggctacctgtcgtcttctttctgcaatatctcttgattgagaagttttattgattcgtctaatactcctcaagttgccagattctctctcatcgtcattgaaccctttgattaggccaaaaaggattagcaaatgatagaatatgcgacacagtggtttcaaatatttgtgaagaggagcgggaaagaactgcatgaaattgaacgtatcagacgcatcaccttgaattgaatttttggtgttgtctggtagaacatcgttgataacgttgagtctttggtaaaatcgtaggtaagtccatgaaactaggaaactattccaaatcggtagaaatggagttaacttctgcaaaacgatcgaaataaacagcgacaaaaccagtacaataaaaggaatctgttttaccctaaggtttaggaatttcacttgatgctcaggagagtactgcttgagtacgactagaaaaggcatcaaaaatacaaaacttccatgattgacaggcaccaaaggatcgtaactactgctagcagtagccacaatgaccttgatcagacaagtgaataaattggtaaaaaatgctgacactagcaaatacgtgatggtttcactaaagccagcactgaaaaattgtataccgtcaacattctcctctaaattccactgtttctctgtgtaagcagttccaaaaaagatattagcagcacctatgaggaattgaatgatattaacatcagtaaatgcaccagtgataaacgtccatgggaaaataaaactcgtctttggaactagttccaacatagggataactatatcccttacgctttcaccactgttccccaaacttttagatttcagcacgtacgcggtgaaactaaaaaagataagtattcctacgaatagttcaacaactattgtcacatgaattcctttcaacatgatctaggtttggtgtggtattaaatcattagaggaattgctggtgctttggtaggtggtgttcatggtagtgtaccgccccaaatttcacattgcatgcaaagacaatgcacaacaagaaacaacagaaacgagtctggtaaaggatattgacgggaccggattctgggctacttaggaatgtagttaatatctatggagtcagaacttgaagtaaataaatacctttaaacagttatgattcggttgaagacaatattccttcccttccccagactctcgcgaacccttctagatgtatcctgcgctgtatcttccttgctagttaatccagtagtagccttcttggaactttgcgaatataaaaatgagttcagataaagatcgaaagccgtcgcttcctgctcaactatcggatgagcaaaagaaaatcaaccatatacaaagcgaacaaagacgaagagagcagatacggtctacctatgacaaattggtggacatcgtgccagatctaactacaaaggaaaaccgatcagagttatcaattttaacgaaaagtaagtattccataaagcaaagaacgtagggtttaccaagattgtactaactttccagccagctcatacattaggaagctaagggaggaaaacgagagattgctagacgaaacaaagaaacaaggcatagatccggaggctgtgatcaatgagatcaatttcaaatatgatgagaagaatgctactgctaagagggaggagatgaagtgattttaatttgacttgggccgttttctttgttcttaggaacagttaatactcaggttagtatcacatgcgaatagtttcgatgttcgtttggcacctaccgaaaatcctacccgttctgccaataatatcacgagttactgtctcactcaacacataaggttacttttttgcaattggccagctacatagaagaatttgttaggttttagtgttaataatacaattcgcctgatgaacttctccacggtcaacgtcacgcgaactatcaactcatctctacaacatatctctgttgtatgtcttctagtaccacccaaccaaccgatgattttgagacaacagcaacagaattaggcgatgcattctaggttataaaatttgctacgggatacattatcattttatgttaaccgtttgaagaaacgaaaacgagtgcattctggtccatctaaactagtagataatatgtatacaagttgcctagttaacagatgtcaactcggttgcctccttcactatatgttttcctattccaattattcataccccaaataacaactgctaaatccggtacttgataaactacagacgcctggtctggtttcattcctgttgtgtgaatcagctggtcatacaggcattattaaaaagagcaaacctaaatcactcaaatgcatcttctggccaccaatcaggaataaaaactttcacaccaattgtttttccatcaaccttagtatctaggatgaattcgttatgtccgatagaattgtcaggcgttatgtgtttcaagtttaccagcgcaagaccaatattcttttccatatgaagaagctttccaacttcggatctcttccgcttagatgctcttttggtgggagaatttccgaaaggtgatgtagcaaacggggtctcttcctgtggttgctcagcttcactttcattttcgttaataatcttaatatcccgacatgatttgagtaaaggctcaaaattgtcgccctcaatagaaatcgtgtctttcaaggattccttatcaatggtagtcagatcatacagcttgataggcatgatacgttttctgattataccagtggtataggttctagtggttagttcttgcccgacgtaacatcctttttcgaatgagatcccatttgtgaaatccacattaagttcaaacggtaacactgaatgttccatatctaagtcagcaggctctacaataccgttgattatacgacgcagtttatattctgaggaattgctggccatatgaatttcatcaagattacgtaaaggcgacagttgggatagttcaagagcagttccagtgactagctttaagccaaaatagggtgatctattgtcaatggcaaatcctttcacgtcatcactgtaggaatccaacaacgcccttgatctgataaactcttgcattgaaatattggctgtttcgggatctgtggaagtagcattattgaaaaaggtattttgaatcttataaatatagttttcaaatatctctttctcactataaatataccaacttttcaattctggtttggtaagttttatcttagccgtcaatttgtgcatgttcatcatcataaaaagctggttcgttattttatggtcaacttctaccagatatgacggctcacttgtatcagaatcttccataattaaaggcgtggggtaaataaaagcatcagagaacactctgcctcgggagtttaaaaatagggtatagagcccatcccgtcggatccctagtttcatgggatcttcgtcgcttagataggaatcttcgtgcaatattccccaatttgtttccttaatttcttctggagttaattgaatctgtttggccaatattccttccagttgcaagtctttgttggtgattgtgtgctgatttttcttggtaaacgttggcaaaagcatcgttgtaatcaagccgttaagaaattccgtcgaatctggaccttgcacctggataaaacctttatctaatcgagctaccttcgtagagtatgtcctatgtaaaagggcactgaagcaagtcctaacatatggcagtcgtaccgtcattttgccgagcggttgacgagagaataccctacagtaacgcataaatgatagtgttcgctgtttagctgttgattatgtaagtaagaaaatgctatatatggacgaggaatccgtgttctctctatctttctgtgtcttgacatgttcgaatcattagtcactatcttcatcaacaccctcatccaataaccgcctttcaacgtccagatctgcttcattagattgacttttcatcctttctgtgagaaaaacatttatatcatcttgtaaggtagtcaattgagagcgtagtgatcccatggcattcttggacgcttcagaaggcgcatctctatctactgcaccggcttgcaaaacatgatcacttggtccggtagtttgaccgttggtggtatgttcgacagtgcagtcaacgataaaatcctttttcaaatcgggtgactcgtatttagcaaaaggagtcaacatttgaagatattgaaaacccgtttaaagatggacagaacaaaacaaaatgttccccggaaaattatagttagccaggtttgttttacttaattccagcatataatttaagttggtgttcgagaaatgttagatgcctattcatatcgaagtgatccaacaagtattctcagaaaaaatacgacgaccaacaagccgaccaacgttaaggccaatcctttctaaaccgataggcgctcttccataggaactaagtttcgacagtcaattcatcacttgaaaggaatatttcctctccataatggaggctacaccagtatatcggtagttgcacgaccttcctttgaaatttttttctgtcagtaatcgttggttccctctatcaacagacatacacaacccaataatgttgaacatagttgtggacggaactattgaagactccatttacgagtatggagttgttttggacacgctgctaaaatcgaagccaaagtacgatgaactatttcacaatgtcacagaagctggtgaggagttatcttccaaagttacagaaactttggatagcttctacctattggatgatagacaatttgagcccattttcaacttagcatttcatcttctgacctcatcgaactctgatattgagtctgttttggaaaaaacccaattggttaacaaaattgttcaaattgaagagaaagttcaacaagaagattccaagagccgcaagcttattgaacccacatcactagtctctgttttgactaccgtattcaactcgcttccagagaattctgctacaagattggaccttttaaatgctattgtcggtcttttggaaagaaataagcttcagtatctgattactcccaccttactggacatattctatgaaagtgcaaaagctcttggaacatctgaatcaagcagtgaagtactgtttaacctgtatcgtgttggaaacatctcggatgtttccttcgtcaaaaaagtcattcttaatttttcagtcgacgtcaaacacataaacgagttcttaactgacgccctaaataatgagaagttgttagacttatctgagtacatcaatatagagaaggtctcgtccgctgattctgctcttttggatttattgaagatttatacgtcggtggacttggaggccttcaacaagttcgattttacaaccgttccaagtgttaacaaatctgcagttttgtctaaacttcactctttggttattgctcaactagcttctgccaactctacgttgaaatttgctgatattgcttctgctttgtctgtagaaagagaagctgttccagactttgtcatcaacacaatctacatgggatctatacaggccaggatagatcaacctaacgaacttgtctacatcaataaggttaatatcttgacagcatttgatttggcacagtgggaggctgtccgagcctcccttcaggcatggaaaggttgtttgaatgaagttagatcaaacataaacagcaacaaaaagaacaagtttattcaacagcaaagagatcagaaagagagagatagagaggaggaataaatagtgaacaggttactagtaacgtgatagtaggaataaacttcgtagtaggcacttactgttagctttttttgtctcccttcgcgaattgcctttcaaggtgggaggatcaactcttgtcattattgtttcgtcccagtcaaactgttctagaaaaatgtcctatctattgaaaactaatcttactagaagtataaggttcttttcaactggaagagctattaggtatgctcagccgctagcaactgaaccaagtatagaaacaaatgcaccctctgaaacgaataggctggagaaaactttgcaaaccttctgggaaaaagttgatgttgcgaaagagaaggatgggtttcatgtccgtttggatggcaagtctttgaaaactcctcttgggaaccagctagttattccttctgctaaaaagtctttggcctatatggtttgcaatgaatggaagaacctttcgaatttgaaggttaagccacatagcgtcccccttacttcgctgagtactagagcaattgatttgggtatatctcatgctgtccaagatttggaggcattaaccaagcttggaaatatagaagatatcaagaccgaccttttgagatacctggatactgacaccgtgttgatcttctcgcccaaagaagactgtgatggaaaattgagacgagctcaagaagagatgtacaggcctttaattgcttcaatggagtcctatttacagcaatttgcagaaaactcttcggagaagataaccttgaactttttagactcggatactgatggatttagatcgaattaccagaatgaagccactaaaagagctgcgcttaattggatgaataaattaaacgtttgggaattggtggctttggaaaaagctacactgactgctaaatcttttctctgtggcgttgctattgttagagccaacaataagactttaactgataacgaagctccaatggatttggagtctattgctagagctgcttcgttggaagtaatataccagactgaaagatggggcgaggtagaagacacccatgatgttgataaagtggatttgagaaggaatttggctgctgctgccttggtggcatacgagttaccgattgatgaaaactgacctaatctgtaaatagggtaattataggagtgaaaaatgctgatttatacaattatgtacttacaatatcgtagaaatgtctagttgtgcttttgttcttgaactgtaacgttaatggttcctccaaacccagtttgactgttgtaggagtcaacaactcgacacaggaacctggaaaaattgtctgaacgtttgttccatctactaccaacttgaagaaatctggggattttaccaacgagtaaagaaacaaacgtcccttgatgttgttcactgctacctggaaattcttcagtaacagtaactcaaatgatggctttgatttcagagagtcataagaactggagttgctgttgaagaaactgtcttgcggagaaaccaatgaaactgctgaagagttacgggatttgggtatgacaatattcaaattgggttttcctagagacaaaatgtcttcgtttatggcgctgatggatgtcatagaagtggcggctgttccagcttcggaaaagtatgctgatgaggctgatgaatcatgcgacataaatgataatttgctcttcaaagctggctgaagctgatgttgagggtcctctaataggggtcgagttattgaactcaacaaagagttgagcgctttggaggactgacaacgtatcagatatttattatactccgattgcagagaaatatccagtcccgagaaactggaagctttcaccttatcggaagaaagtgagatcatcattgagggcatttcttctcccttctcatatgctaagaaataagattgcttggataatacattaacctttatagtcagagtatttccctctggatcaacattctcccataaattattcctccatacgcaaatacgggcttgggtggtaattattggtatagagtgtgtaaggaaatgttcctcctcttgggttaatctctcatctgtatatggtaactcatctgtggattgggcaaatgggccttgcaactgcatctgaggtttggagacaattgtttcagtatcattggcgctgacgccgttgcaagtctccgtggcctttaaagtggtaaatgtcgtggttgtacccagtgttgtattggattggttttgttgctcatagatggattctgattccgtgtgagggaggtctgatacaattggtttgttcaaagaatctgtggtgtcaatgtacaacgattttagttgattgggtttctctttctgtgacttctttgataacgtaaatgcactgaaaagagattttcttctggactttttaattgaatcgttcttggacaccgcctcaatgaatggtttgtactgagcaaaagctgaaagatcaactttgggtgttgtgcattctgttttatcagaaacatcatccggactggtctctggagtagttggaacttcaatctctctcagctcgtcttttgtttcagatggcttggtatcagccgaactaacgtatataatcggtttggtttcagaagccttcttttcaagggtggttctttcgaaaacaaaagtttcatctggcattggctctttgacctccgaaacttccgatgtatcttcagttgttacaagacccttcaaattcaggtttcttgaatatggatgtggtatcttaacctcagaactggcacttgtaggagaaagatttcgggattggtgtaactctgactttattggtggtaaggccttgttgttgaatgaagactcacttgcaggaatgaaaatagaaagtcctttgaagttgctagcacttgcaacagttggcgcagtaaaaaaatcatgggatatcttggcccatttgtcagtcatataagagtttttgaaagaaacggttaagttaatatgcgggttagtagcatgatccaaaacaataaaattttctgagatttttcccagctttaagctgtgtttagtgaatggtgggaagagtaatgaagagttagcctcttccaaattacatagagcaatttgttccaatgaatcagaactggggtactttactccgatgatttctatttggtaatcaaacgtcccatgctctggatgggatagtctcaattgagcggtatctctgtgtctgatgttatgagaatcaaaggtagcaccgacgacagccatggactccagacatttaacattactgaagtcaatcgagtgaaacttggagttatgtctttccgattcatctttctgtcttgcagcctggagtagtccatcaagtgcctgtttcaagtatcccaatctccaagttgaacattctgagagcttcgaaatgaacttctgcaaatatcttatcctaactaatggtcgccttttcaaatgtgcttcagaagcaagctggtgggtgtcctggtggaaccattgtatataagagctgtaaactttcagcatttcgttcagccaatcaagaaaacttgataattgtaagtcgatctgggatcgggtttggtccaaacagagctgaagatcttcatgttttctcaacaattgcaaggttacttcgtgtaatttctttcccttttccagttgctgctccatttgttggtctcttactccctggtcgaacagtctagagtctttaaccacattaagtttgcaacactcttctaatcccctcaggtgtgacagatattcggcttctgttttgcacaaatcatgtaccaaataagttctgaccttttccatgaccggctgctagaaacactcaacaggaaaaacactctgctaagtcttaagagaatagttcaagaagtgtatccagtggtattgatattggggtaagatagaaaggtacacactcctggcagaggcgcgtcaaacacgtagacacgttgaaaaactgcaaacgagcataaaggagaaaaaaacgcgctgacgtgacatgtcaaaagggatgaagggggagcaactcgacggatagaggatgggacgctgttagcggcacgaaaccctgtaagatgtaggggttttcgttgtaacagaaaagaataaattgaacgatgatacaaataagagtggattgtaagagtggatatgcatatcatttgtttggttagatcttgagattttccaaaaatagaacagtcttgcactacaagctccaggcactaaacgtccctcaaactcattcctcttcgcatcggcgttcacttccaaaacagttagtacaattagaatgttctgtaccaaacagtcttattttggaggagaatctgctcatttacccgatcgggcagtaagtatacccgattgggattcatgggggaattaaacatgcattgttggaagttatagtgtgacgcaagagatttacccaattaggaaagataaactaagggaaaacttagacaagatttcacctgtcatttaaaagaccacatttgtgccttttttacctcacaactttcggtccaaaagaaatcatgaagttgtttcacttactagcggcattgtctctgagtgtttctgttcttgcagacactagtaacactcacaacaaggctattttggccacttttgtcacagttacaactaccgaatacctcaatggtaccccaacaggtagcttgacagagaacaccccttctggattagcaccaagtgtttctagagaagagagcacttacgtgaccaccttattcagcaatggccaaccatacaccacagtttcacaaacgattctgccacaaatagtagttgctcaaactgtgtaccagaccgtcacggtcgaccttgctacagtttccggatatggatctcaagctgattctgaaagtgcaagtgcaagtgcaagcgctagcggatctgctagtgttacctccagcggtagcgaaaattcctctgagtcgtcggggtcctctcaagcatctaacagtggtaattctgggtcaattggctcgtcttccaccttccataactattcgtcgtcatttggttccacttcttcgtacagttcttccacattatcccatggaaattccagtaccattacaacatcgagcggacgatttcaaaactcaacaacgataacttccagttcgttcacgacttcacatactggtccagctgattctggctccaactcaggatcaggtgtcaactcttcttctactactatctcagactcaaaccctgacaatgcgggttcaattggcaccagattttcaccatatcttatattaatgtgtttggcaatggctttgatatgaatagaatacgatttgcataccttaaatttcaaaatgaactatatacatatttaccgattctaaaattatcattcgttagttaatcactagaagtgccattttatttccccttcaggcgaatttcatcgtggttagatgttacgggttatttgctatcccagtctcgaaataaaaaactgctccgcaatctacttacatgcctgcgccttgcttccttactccttagcaatagtcatgtcaacacccaaaatcgtcacatcgtcgccaaagattatagtacactggtaagtgaaaacattcgtcgaatgctcaattgaaccttactaacatacaggctcaatcaatctagagcaaattacattatctggtttctggaagagctagggctaacctatgaagtcaaggtttatgaacgtgacaaaaacatgcgagctcctgaagagttgaaaaagattcaccccctgggaaagtcaccagtgctggaggttgatggagaaattctggctgagagtggttacatgatgagctacctgttgaaaaattatgataaggattacagattaacaccaagctctattgcccttcaaaacaaagttgattattatctacattactcagagggatcgtttcatccccctgaagtgatgttggtcgtgctgaatgtcaccaggaaaaaattgccctttggaattaaattccttggaggcaagatcctggacgcaatagctgataactacgcccttccagaggtcgtaacccatctgaactaccttgaaaacaaccttgaaggccaagaatacttttgcggagataaattgagtgctgctgatatcattctatcgtttcctttgcgcaactctctcaagttgctacgaaaccctgaaagagagagaaagaattatcctaacgttcttgcctggttagatcgtatctctaaaagagaaggatacaaaaaggcccaagaaatggataaggaacacccagctaaattttagtttccctgtgtaagttttgtaagatgaatgcacttgccgcgtgagtatctaacatttccagttgatctgggggaaagatcctgtcaaaaaatgtagcaaatatagcaaaaaacatcaacacccctggaaagccaatagcccctcttgtacaagttattccaaattcacaagcaaaagcgattaattcaaaaataacaaacaagatgagccacttccgttcaatcttgctaagcttggcttgatattcagtaggattcaaccttatagtctcaggatcagtaaatagaaatcgaagtttgttggttacttcattcccattcagcccactgagacccatgatccaaaacaggcctgctaagacactttgaggaacatttcccaaaactatcaacaacggcctagccatcatcccaagagtgagtagcccttgggctatatttgtgaccctttgctcaaccatacctgtcactatatcaaccccagattcgtagtcgtgagtttttatgcatagagacgacgaatgcagcggagcttgtggtataagtccgttaggtgcagggatacctagaatccctgaaacgccagtagtaatccccaataaaaagtaatcccaatggaatgatgagggcttggtcactggaaattggtgtgcttggcacattaaagatgaaacattatgatcaaaatagaatagaaatgtcaatagaagtgcaaaaggaagtgctagaaatacatctccgacggtacaaccttcccagaaccttatgaaccaatcggatcgtcttccctcaaaagttggtcgaaacgactgggaaatgggtagagtttcaaagtcgatattattcagatatccgccaaaatgaatgaatcccgaaaagaatactaccgacaagggtagtccataatcagagaaaattttccgtactactggcttaatgtaatgtgaatcggtgccaaagaatactgaggccaaaccaaatatgcacatcaatagagccaccattacagaggcaaaacccttcgcatagtccccatcagcaaactgtcttgtcaaaatttgaattcctttctgaatatagatgcaattaatgaagaacccgaatacgtcacaagagtacatggtgatgtaccttatgtaattaacggtattgaagattgctaaaatgaaatgcattaacgtactccaaaggcaaacccaacacatgaaagaaaaatagtcaacatctctatcctttataagatcataaactgtaaagttgaagattgcaataggacctgtcactccaactatgcatagaggttgtccactaaatagtccaaatacgattcctcccatggcagaactcatgagcacttcgttcaagccataagagttatctgtgtggtcaaacatatcttgggcaaatgcgattgctggtagcaaattcgtaaagaaaatgtacacagtagacggaatcactctgtagttgatagcatctgaataatctgagcgaaggtaggggagtctattccggatatctgttataatcccttgcccgatacgtttgtagtggaatttttcccttattttgaccttcggtagattgctcatgatttcaagtatgccttttaaagtttatggccggagtatttatggcttttcacctgatggggagcaaaacgaaggtacattaattactcttggcgctgaattgttttcagtgcggaggatcgccctatcgcgatcctcgtgggcctgagacaccttagatttgaaaagcatcgatctactataaaggttcttcctactggcttcttccacgtgatatgctgaagagacagtgtatagcctttgctttcataatcaattgcatattagttctgggctcacccggtgatagacttcccaagttcaaagaatgtgtgaagagatgtgatattctaacgtgcgggaattcccaaggattcaacaatccctctaagcaagagctaaggagttggaagaaagaacagctgaaagaaggattgtttcaagaactacccctggactggtctttgcaactactagggtgggaatgttttccaaattgtgattatcaatgccagagattggttacagaggatcgaagagccaaaggagaaaaagtactacagtttcatggaaaatggccctttgttcgggtatttggaatccaagagttcttcagtacagtatttagtatcgccaattttgtccccaactacagaggctatagaatgttgaggagaaattatagatatgaacaggtgaaggggaataccgaaattgtcaatttattgtggggttatttgatcatatcattggtatcactgggagcttggactttttctgctatttttcatttgagagatacgtggaccagagagaaactggactattattttgccggggccactgtcttgagtggattttatgggatattttgtcgagtcttccgattgcaccaaatcaaggctaacaccaaacgtcgtttatttgccatttttttgatttgttgttacattggtcatatcacaaggcttacattaaactggtcttatacatacaatatgcaagcgaatgtgctgtgtgggtttctacagaatatagggtggacctaccaatcacttaacacgtttgtgtatcagagcgaaacaaagaggggaagtgcaagtaagaaacacatagtaaaaaggatagcagacgcattgcgcagagatttcgccaatcctgaggttaattggactctcctcccgattgtgttggtaacttctgtatgttttgggatgtcatttgaactgctcgactttgctcctctgggcgacttgttagatgctcatgccatttggcattttgttaccatatggccagcgtactactggtatccgtacatgataaaagatattaactacaacataaagcagtccaaactcaaatagcttacaacattgaaagatgcccaggaaggtttgctatttgattgggtcgctgaggagtttcaataatgatcttcagccatgtgaatgggcaatagtacgattttcagttactgaaaactcacttgtgacaatagaagaagacattgctattatagctgttcgaaggataactaaaggtctggtcatttctaatttagaggttatcgaccttttttaacgtgttaatatgagtgatcatgatagcatcactagagaaagtccttcaaagaagtatgcacttcaaacgcaatgaaatcaaaacggtagtcttttgcttcagatcaagtgtataaaacgtatctgcaagaagagttttacataactttaggcataggtacgaaatgatgtaatatactagattccgaggctgcaacttttcatctcggttttcaaggttccaatttcgatataaatatatgtgatcaggttcaacaatattggccaatcaagcagttgtagcaacaatatgaaggcagtgttatctgaagaagcaccagttgaaagcgacagacttttgagcaactaaagtaaccacctatttatacagctccttgcacgctctattgcttgtacactcttgagcgtacatagagatgacataagcacacgacgacaacttgattaacaccgaaaaaatggcccgggaatacctgctacttaattgggtaattgaattccgattaccaaatttggtacgttgttacagccctggttactgaaaaaggaaacattttgtcgtgattttcggcaagtctccgttgtggaccccatgggtcgaggtggtagcctgcatgaattgaattaattgaaacagcaaaacaacccaagtgggaactatgctgtttaaaagttggaatcctttgattaaaatatcaccgctgtaaaactgagctctgaacgattcgattggtatatatatcatgtccaaactaatccctacgagtaagtattcaaggcgcaactaggaatcatctggacgcgcctcaaatcatttgcgtacatattttaattttgttgagtcgatttgttttgtaacatatgggatcgaggagataagctgtaaatgtataaatagggatccttttctcttcttgcctcttatcctttgtgctcaatcacttaataaactttaatcatgactattcaatacactcctaaagtccaagtcaacactgacaaggcaagatacaccgagaatgaactgcttaccgactacacctatgagaacactatagttgaaaagcaagctgacggtacttacaacgtcactccaacttccctggactttgagttcaaggttgacttgaagacaccaaagacgggtttgttgctggtaggtcttggtggtaacaatggtaccaccttggttggttccgtgttagccaacaaacacaatatatcctttgagaccaagacgggtattcagcagccaaactactatggttctgttacacaagcttctactgttaagttgggaattgacagcaatggtagagatgtctacgcccctttcaactctttgttaccattggttcaccccaatgactttgtagttggaggttgggatatcagtggccttgatttggcctcctctatgagaagatctcaagtcttgcaaccagacttggtcagaaagttggagccttacatgaaggatattgttcctctgccttctgtctactacccagatttcattgctgctaaccagaacgaaagagccgacaactgtttcaatagagaaggcaaagatggagaagtttctaccaagggtaaatggtcccacgttgagcgcattagaagtgacattgccgaattcaagcagaagaacgacttggacaaggttatcgtcctttggactgccaacactgagagatatgccgagctgatcccaggtgtcaatgacaccgctgagaacctgatcaaggctatcaaaaacgaccatgaggaagtctctgcttctacaatttttgctgttgcttgtattttggacaagattccttacatcaatggttccccacagaacacattcgtaccaggatgcatcgagttggctgaaaccgaaggttctttcatcggtggtgacgatttcaaatctggacagaccaagctcaagtctgtgctggcacaattcttggtagatgctggtattagaccagtctcaatcgcatcttacaaccatcttggaaacaatgacggttacaatttgagtgcaccacaacaattcagatccaaagaaatctccaaggcttcagtcgttgatgacatgatcgagagtaacgagattttgtacaatgagaagaacggaaataccattgaccattgcattgtcatcaagtacatgaaggccgttggtgacgacaaagttgccatggatgaataccattccgaactgatgctgggtggacacaacaccatctctatccacaatatttgcgaggactcactactggccactccattgatcattgatctggttgtaatggctgaattcctttccagagtttcttacaagaagaagggtgatgctgaatacgaatctctacactcagtcctctcattcctcagttattggttgaaggctccactgactagaccaggataccaggctattaacggattgaataaacaaagggccggattggacaatttcttgagaatgctaattggtcttccaactcagaatgagctgagatttgaggagagattacagtagttatttttgtattatgtaaggtagccaagccctgaatatcatagaggctttttaaacctatcgcccctgccgacgcttatctgagcggatctagaatctgagaccgttttgttcgctaccgcggatcgccccgcgctccaatatctgctatcagttgctgtagtagtccatccagtgctagatatgataatgatacaaagttgtttttttttcccactagaattcttcactagcaaaggatgacaacaacagtgtatggaaagttaacaccgtcgtcttcggactcgtcgatggatcaccagaagtccaaattgtggactatggacactaccccacaagatataaccgtcgtccacccatatctctctcatattgcttttagtaatacgcttaagttttaccttaatggccgtttgatggtcgtgaagaaccccaatcctgagggaacattgcttgatttcattagaactcaagcgaatcttactggaacgaaactatgctgttcagagggcggctgtggtgcatgtacagtgaccgtcgctgaattcgaccaggaaaagtcgaccatcaggtatcaagcagtcaactcctgtatcgtaccgcttatttcagtcgatggcaagcatctgataactgtagaggggataggatcaacaaatgatcctcatccagttcaagagcggatggctaaatttcacggatcgcagtgtggattctgtacacctggaattattatgagcatgtatgctttattgcgaagcaaaaatggcacagtttccatggaggaagttagcgaagctctagatggaaatttgtgtcgctgtaccggtctgatacccatcctcgatggcctgaatagttttgcctatgacagtgagcattacaacaaaatcaaacagtatccaaaggatgccagctttgtatgttcgaagggtgctgactgttgcaggaataaagcaaacaaggacggtgaaaccgaatcgaattctaacccagacatggagatcgacatgactgaactcttctccccggacgggctctctttgaaatcctatgatccaaaaagagatttggcatttcctcaaaggctgcagcagatgccagtacaaccaaaattttatggtaatgaatacaaagtctggttcaagcctacaacaaaagctcagctattgcaggtcaaagccatatacccaaagtccaagattgtagctggtgcgtcagaggttcaagtcgaagtgaaaatgaaagctgctgactacaaagtaaacatatttgccaatgatattaaagagctcaaaggctgggagtatcaggatggttttgggttgaccgttggaggaaacatatccctttccgatttagaacatgtttgtggaaatttaagcaagaagctcggttcaagaggaatggtctacggttgcatcaacaaacagttgaaatattttgccgggagacagattagaaatgcaggaacacctgcgggcaatattttcactgcctctccaattgcggatttgaatcccgtgttagttggagctagatctattgtgaccacggaaaagcttgatgcttgttctgacaagattacagtggagtcatttgacctctctgataattttttcacaggttataggcaacacaagctggatccagagagcgtaatcactaaaatattcatcccagaaactaaagataatgaatatatttcctcctttaaacaaagcaaaagaaaagatgatgacattgccatagtttccgcttgtttaagagttcaactcgatgacttgggaaatgtagtggactcaacacttgcttacggaggtatggcgcctatgactactactagcaagaatactgaatcatttattcaaggtaagagtatttttgaagaatccttcctgcaaggtgccattgaggctcttgataaggactatccattaccgtatagtgttcctggaggaatggctacgtatcgaagaaccttgacattttcatttttcttcaaattgtggcaaacaatgttgagagaatttcaaccaaccgatctggatgcattaatgaaaccagcgtctagcctttgcgatgtagactcaaatcaagaggttaccagaaattttccccgtggtacaagggatctaactactccatttgaagaaggctccattgttggaaaaccagtgccacatttatctggtttaaagcaagctagtggagaagctgtttatgttgacgatatcccacctcatcacaacgaactttttgctgtgaatatcacttctgcccgaccccatgctaagatattatctgtcaactacgatgaagcgttggaagtcgaaggtgttatgggatatgtggatatcaatgacgtgccatcgaaacatgctaacctttatggtcctttgccattcggtaagcagccattctttgcggatggagaagtgttctacgttggacagactattgctgtgatcttggctcgtgatagggaacgtgctgctgaagcagctagaaaggtcaaagttgaatacgaagatcttccgaatattatcagtgtcgaagatggtgttgaacagaagtcatttttccctgattcccgtaaatatgaaaagggagacactaaagctgctttcgaagagtctgattatgtgtttgaaggtcaggttcgaatgggagctcaagagcacttctactttgagccacaagggtgcttggtggtacctgaggaagatggggaaatgaaagtttactcgtcttcgcagaatccaacagaaacacaggaatatgcagctcacatcacaggcgtccctattaatcgaattgtagccagagtcaaaagactaggcggagggtttggtggtaaagagttgagtcctgtctcctattcttcagtttgtgccctggcagccaagaaattcaaaagtcctgtacgaatgatattgtccagaggagaggatatgatgacttcaggccaaagacatcccttcctgatgaagtacaaaatcggtgtcaataaggactacaaattcactgcagtagaggctaccctgtatgcaaacgctggctggagtatggatttgacaaggggagttgttgatcgagccgtgtttcattccttaaattgctactttattccaaatgtcgttatcgaaggaataccagtcatgaccaacactgcttcaaatactgcttttaggggatttggggccccgcaaggaatgtttttggctgagtcaatggtaacaagagtcagtgaagagttgcgggtaaatccagacgttattcgggatctcaattatttcaaagttgggcagacaactggatacaaacaacctatagatgaggatttcactgttcctgaacttgtgcttcaaaacaaaaaagaagcgaagtttgatcaactcgtagaggaggtgaaggaattcaacagtaaatccaaatggatcaaaaggggtatttctcatatccccactatgtttggagtctcatttggagtattatttctgaaccaaggaggagcactacttcacatttatcaggatgggtcggtgctggtatctcatggtggtgttgaaattggccaaggtcttaataccaaaatgacaatgattgccgccaaagagttgggtgttcctttagacaaatgttttataagtgaaacttccacccaaagtgttcccaatacgtcggcaactgcagcatctgcagcctccgatttgaatggtatggcagtgaagaatgcttgtgacaaactcaatgaaaggctatctcctgtgaaagaaaagctaggagactcggccacatgggaggatattattcgaacagcttatcttgaccgaatttctctctctgcaactggattctacaaaactccaaagattggatatgtgttcggggatccaaaccccaagcctgcatttttctactatacacagggctcagcaatcagtgtagtcgaagtcgatactttgactggagattggtcatgcctaagctcccatattaaaatggaccttgggaggccgataaaccatgcaatcgacacatatcaaataacgggcgcatatatgcagggagtcggactttgcacaatggagcaaagtctctggctgcgtaacaatgggcgcctctttacaaccgggcctggcgcttacaaagtgcctggatttagagatttgcctcaaaaattccacgtttctattctcaaagaccgcgagttcaagcatctagacacaatatggagatccaaaggcataggtgaaccgcctctgttcttgggattcagcgttcatttcgcactacgtgatgctatagcaactgctagaaggagtcaaggcatcgaggaagggtgcaatggcctacccttcagaagtccattgaccacagaacgtatcagaaccatgatggctgatcctattcttttggcggctcaagtgcccgccgaaggcaatgagtggttcattgaggcctagaagtgttgtgattattttatttatttaatttatttttgcctttcaattttttatttttcggctgccaccctagcgcgcgctcgcactaaaggctacttctccgtctccaacccagcgagacggactccaaagttccttctagtaaatgtacttaaccagcacagtgagagcgctgccagtacattttttcagatcaagacattgtattagaaccatgagtaacattgttgagaagaaacagtccgaattctcgagagctgagcctttccgtgtggcggttattggctccggaaattgggggactactgttgcaaaaattattgccgagaacaccaatgaaagaccagaagaattcgttagagatgtcaatatgtgggtctacgaagaagacattgaaggccgcaagttgacggatattatcaacgaggagcatgagaatgttaagtaccttcctggggtaaaattacccaagaatttgcatgccaccccagacttgttggctgttgcaagccctgcagatattctggtgttcaacgttcctcaccaatttttaagccgaatcctacagcaattgaagggtaaaattaaaccgaccgccagagccatttcatgtctaaagggcctcaatgtagagaagaactcatgtcaacttttgagcacacaaattgagaacgaattgaacattcattgcggagtgttgtcaggagctaatcttgcacctgagatagctagagaatgctggtctgaaaccacgattgcctacgttaagccaaaggattatcgtggcaagtatgacgatgtgacacctttcacgatcaaacatttgttccacagacctgcttattttcatgtgcaagttattgaggatatcgctggtgcatccttgggtggagctctgaagaacgtcattgctctagctgttggatttgtggatgggcttaattggggagataatgctaaaggtgccatcattagactgggacttcgtgaaatgattcatttcggacacacgtatttccctggtgctaagagttacactctaacctgtgaaagtgctggtgctgccgatcttatcacttcctgtgcaggaggccgcaattttaaggttggaagagaaatagctgccacaggaaagcctgctgagcaggtagaagcagagcttctgaatggtcagtctgcccaaggaattattactgctgcggaagtgtatgaatttctgtcaagcaagggagacttaaacagctaccccttactcattacggtatatctgatcttgaagggggaacggtcagctgaatgtattccagagtacttcaacaagaccgaggacgttaagcattgggaagactaattagaagcctgtgtgggttcagcttgcagtactagacctttgaggcaactatcccaacccccatgctaaataaacaattgtatactagcgcgaacatcgaactgttaaatgtgattatatttcatgtaccgtaacctactcgcttaaccacctttgatcatgtcagctcctccagaagctctacagaaagtatgttgcactttggttcctgcttattactatgtactaacagataggttctggtggaaatgaaccagcaaatacaaaaatcccaatcggaattggcaatgactcgtattcaacttcaaagaaacgagaccaatcttcgcatactaaaattggcaaactctgaggtctccaattctaaacaagatcacgtttgggaatctgttggaaagatatttctcaagacatcggttcaagattattcatccagtttgaagaacgaaacaacttccatcaatgatgccgtgaaggctctaaagaccaaagaaacatacttacaaactacattggaaaatacagtacaggcaattaataagtatgtgggaaaaccctcctcctaattaggtcaatctaaactgcactatatccacctctatttgagcttccaaagattttacctgccaactctctcaagaatccagggatccttgatacgacttcaacaacggcatcgacaaactcactgaaagcctcattagaagatccccggttgctgacattcaaccatgcagtgccaattatgtacgcagcaaagccgatcactccgagtataaaaaaccatgtaaaccatccccaagacccgtcagaatcagagtcatgttttccgtccttatccttgtccttgtttttgtcgtcttttctacctttgttatcagacctacatgcagctttggactttattcgtaactccaattgttgacggttccagccaactaattctaaaaggtctttgtcataatctccgtctttactacactcaaaaacgatgtcagcagcgatagactgttttccccaataagcgcctgttaattgtacagtaacattgttatcattggtttcaattgagggtttgaggtttctagagaatgcaaccacttcagagactactggctccttaccattgagtagcacctctgtgataccacatatctgggaatcatcggggcaattctccacgtccatcttatcctttccatctttatcttgagaatcatatatgttgagataccagactgacttggtgattgatggcggcgtttccaattcagtggtcacttcgtgaaggccagcaattttgttcaaatcatagggtctcaagtgtttattagatatgtctatggcacaaaccgaagcaataaatagaatcaacctgaaatagttcattgccggttgaattgattaccttgttatctttgactggtggaggtatgattaagccttgcgcgcattggtgatggcctgttacttggtagagagcctcctagaaattccgcgaggaaaaccttggagagcgttaaggggatgcggtagctaatagataaaagattatgtaatacaatctgcggaacatatattgaggaaattcactaaatatggagagtagtgaatatttagtagaagaaactcaaattcccagaattagaaacctattaagagtcgccactaactcaagagtctataaaatacttcgtaacagctctctctcctactagacatcatgaataacatttacatctttacatcaactattttagcacgtgatccattctagggttcttagacaacctatctatcgcgatctcatcaacaacttttttcactcttctgttttcttcttctacatcatccttaatgactcgttacagtgctgtcccagctaacccagatcgttctgcctctgctcgtggctcttacctgcgtgtttctttcaagaacaccagagagaccgctcaagccgtcaacggatggaacctgaagaaggctcaacagtacttggaccaagtccttgaccacaagagagccattcctttccgtcgtttcaactcttccatcggaagaactggacaaggtaaggagttcggtactgacaaggctagatggcctgctaagtctgtcaagtttatccaagacttattgaagaacgctgaatccaacgctgaggtatgtattttttttcacaaaaagtcttctggaaaaaaaaccatgaagagatcaagacagatgtttctaggttgagatattatggcaatatctttcttgggttcacttgtcctctgttccatgtttttttggtcttttaaagtcttaaaggattttttttcagtttttgattactaacatatatttagagcaagggtttggacattgacagtttgatcatctcccacatccaagttaaccaagctccaaagttgagaagaagaactttcagagcccatggtagaattaacgcttacaactcttctccatgtcacattgagttgatcttgtccgagccagatgaagccattgagaaggccaaggaagagccagcccagttgactgaagcttagattttgacgggtaacatatattaatacatgtaattgattgactgttctcttactttcctaactatgaattcttttagttgaatgatcaggaagtggtgtgatggatcgtttgtgatctgtctccacatcttccgtctcaacttcttctacctcaaactccgtatctgatgccacctcgagtggccgtgattgctgaccaatatccgcgtccgtcgtttttccctgggtagttggctcatctggttcaagctctgattcatactccagatagtctccctcttcaacttctgttacattgctcggagctgccagcagcccgacattttcaagccctttacgtttaccactgtctgccatgtccttcaaatgctcatacacactaagcaaagttggaactaaagtaacctttatcaagatcatattgtaggctgttttgtcagtattttccttcagcctacttaaaagttcaataaaatctcttggagtcacatctttggtgtgaacatcatcctcaagaattttaatatcaagctcgatcatttccaaacagtactgtttctctggtgaataatccaaactatttgagttgcaaaaactgcgtaagtgactgaaaaatttattgaaaggttggttcaaaatagtaatatctgagaacattacagctaaatctgaatagtcctcatcctcctctagtgcaaatggtacaagtttaaacgtatcattggaggggagttggatgtataccggaataggcacttggtatgatgactcgtttgcagttgaagagttcggattttcttcttttcctttttctatttctccttctacttcttctcctgctgcttcttctctttcttcttctctctcttcttctctttctttttcctctccatcatcttcctcatattccaattcctcctggtaccccggctgtgaagagtaatccgagcccaggtcaattaactcaatctctgcggttttgacatgtggctggaccctttctaccgaattagactccacatcgtctttcaattccttcccttctttttctacgtccatattcaccattgaatcattgacgtcttccaatgatccgtttgccgttcctgatcctgtaccagcatcaatgttgtgccccaatttagtttcgttatcggttaaaatgctgattgaatcatcactggccacctcttttattgcatcatcaccgctataatcatcagatagcaattcttgctgctcaacatggggatctgtggacatgatttaatgtgtcacgattatattcaaaagtaattatcagaggttcatgtacttgacgtgagatctgagatgtcagatgtcgtataataaaaatcagacctcaattgtttcatcaaattcaattataagtaggccattcggcaatattagaaaagtgtccatcgcaatacagtagtgtataatatatatattaattcttctacaaaagaatatctgatatcctttttgtgaaagaattttgggtgagctggaaaaatttgataaactcaatcgtggaaattgtacttttcagttatgattatgattatctataaatatttttccagaatatcccggaagaactcatcagagattgccatgtgcctatcattgatttcaagaaagtcaattctactgttttcgtagagatcttttaatccgatcaagttttgagagtaggaagctgtgtcagtaaagccgatcaattcaccttccttactgaaatctagaaaccatgcactttcttttggcactaaagtatcgtcctgatcaaatttgaccaatactaagcgttcaagctttttcatgttctcaatatatgtatagttcacctttagttcgttattgatatccctaatgaatcccgaatgagcaatgtagtcatcccaatgactaggatctctaaagtattgtgccggcacaacactttcttgcactgaaggagaccaaattctactcttcaaaacctgattctttcgtttacatagccaatcattttcctcacaggtgggcaaatcgtaaattccattgtgaggggaaccaaatgtaatcaaagtagtaacattcaaatccgatgccgtctccactaaacttcgcagaaacaatcctccctgggagaacccaattgcaacgaatccttggtccaattccggtatttccagcaactgttcatggaccaatttcaactgatcgttcaggttaccaacaaaagaagatctctggtcacttgcactgtcttcagagatacggatggaatggataaaggcattggggtacagactagtgatctgttcttctacttttgaaatagatggggaattgtaaaaatcccccaatccatgccacagaacaacctttgggtcacttctcagcttacactcatttaggtgtccaaatggaatgatccattgcagaattgaaaagctttgaatgagactaatgggtttatcaaaccacataagctaatagtaactgataaccactaaaaccatcttgaattgacaggcccatcgcgtctgctgatgtaatcataacagagaaaaaaaagtttagctcaacttgatacaatatcaggcgtctcaagatcaaccaccgatgagctttgagttatcagcttccgatattaaacagactcagaagtcaatagctgcactgatagcccacaccaa

SEQ ID NO: 99 - DNA, 213505 bp, Pichia pastoris
taatctggttattggcctggaagaggaccagactttaccagaaaatgacaatactccaagaatagtccctgtcaggaatcgactagaaagagtactgaaaaatcaatcctgttgatcacaaaagactcttctgagccatatgtccatgcgcttaaagaaaagggagcacctacagaggatacgttcgcaagaataatttcctatcacaagctcaaatccctatcaggcaaaccacaggaaatgaagaaattataccacgaatacgatcttattctagccgactataggatttatccctttctcagaagaacactagggtccaaattttatagctcgaaggagaagattcccttcatgattcaaatggccaaaccttccaagaaaatcgattattcaagaaccgagggggagccaccagaagacaaacgatgcgatcctatatatgtcaagaaacaggtcatttcaatcgttaagaacacttttttcatcccttcaaacaaatctcatttcatcagtgtagttgttggagacactgacaaggatccaaaaaaactcgctgaaaatgtatcagacatactgtctttcttgaccgatattaagcgcaaaccaatcggaggcttgctagctgctgacggaatcaaatcacttcacgtgaggacgtctgaaagcattcccttaccagtgagagaaaatgatgaaatatagaactcagaaaccatgtattatgtaatcatatattagattgtccaaggcttatcacgctaagttatttcgttgcacctatcgatggcgactacttatgaaagttgtctggttagcatgtttcataatactggcagctatatggtataaagactaccaaagtttaagaggattcatggacgacagagtgtcgaagaccttgccaattaattttaacgcactaaagttatctaccaattcttatatacccgtggatgagcaccttataaagcctaacagagaaccgaacccaaaatttgttaaagaaaatgctactttgctgatgttatgccgaaattgggaactagaagaagtactgcaatcaatgagatcactcgaagataggttcaatggtaggtatcagtatacttggacattcttgaatgatgtgccctttgagaaacagttcatacaggaaacaactttgatggcctcggggaaaactcaatatgcgttaatttctagcacagattggaatagaccttcttttataaacgaaacgaggttcgaacagaatttaatccaatctgagaaggatgatatcatctacggtggaagtccatcttatcgaaatatgtgccgtttcaattcaggattcttttacaaacaaaagatactcgaccaatatgattattattttagagtggaacccggagtggagtacttttgtgatttagaagaggatccattcagatatatgagacttcacgataaaaagtatgggtttgtcatttcactttacgagtatgaaaacaccattccaacgttatggcagaccgttgaaaaattcatagaaaatcatccagagtacatccacccaaacaactcctacgaatttttaactgacaaggaagttgttggccctttaggcttagttgcattaactgaacagacttataatctgtgccatttttggtctaattttgaaattggagatttgaacttttttagaagtgaaaagtacgaggcttttttccagtttctggatcaggctggaggattttattatgaaagatggggagatgccccagtgcattcgatagcagttggcattttgttagataagagacagatacaccattttgagaatattggttattaccatcttccattcagcacatgtccccagtcatattggtcatacaagtgcaatagatgcatttgcaagcggaatgaatccatcgatttagttccacatagttgtcttagcaaatggtggaaatatggaggtaaaacattcctccaatagaaaaatgatcatacatagtatatagtacagggtctacttttatttatagggatcttctaacctgttcagttcatctaaaatcctttgtaagtttacctcttttttcgcagccaaacttggaattaatgttatagcttcgtcaacatcttcacaccccagagaacttaattgggcaatttcaaaaggatgtaacacagagcaatctgaagaattatgcaatagctgatcaacggcagtacaagtctcttcatctttgaatcttgcaaacgtgttcagatagtctaatgttttcttcactactccgttggctacagcacctgaagtcacttttgcaagctcgtcatcgtcgatttccccattgctggactcaatatcaactccgccattacgtgcccgtgatctagctttcagagcttccctaattaacaaccttgattctgataaactaagagctattaagtcatgttcattaccatcatgatcatactgtttcaaggcaaactctggccctagccttaataatgtagcgttctcctcatcgtctacctgctgctttgctctcctacgacgagctcccaccgtggatgttgaaacattcatagtgacgtacgagtgtttagcaagggctaggaagaaactgaaaaagtactcaaacaaactgttttttgtcgatttccgcagtaacagctagaaggaatagcgaactccctctggcccacgaactctctgggcaaagtttgattattaaccaaaagcttcactaatgtagcgaattgctttcccaaaaccttccttctaccacagattgccgtttccttccagaaatccgcctagcatgagccgcccgcggatagttacctttcgtgttccgtgccatatcacctccccacgcttatttacagcaaacacacgaatatttagctcacacatttccatataccatcatgagttttaatgacaggcaaggatggaagcaaagggcgcagagtagcaatcaaggagatcctgcgttcaaaaacgtcttctctgtatgctcaacaggatcctacaatatcccaaacaatgggtctcagattcctgttcgtggatttcaagaactggatctttctccaagcttcaaacgaaacgatcaatggtttgattcgccatcacgcagagagtctaatattgcgcagcaaaatctgtctcttcttcaaaatggttctagaccgtcgttcagtcagcagctgcccacaacgtatgaacatgaaggaatgggcccaccagcagaagaagtagttttgccaccaccaagggccgctgcaccaggacctatgcaatcccacctcaacatgcaggaggaacagttcaaagagtaccaaagaagacaatcggtggctgtttcaggatcccattatcaaacacctcctggagcggtaacgaagacaaccaagttgcccgttcccagaatgcgccgaataagagcactttcagactttcatccagtaagaaatgccaagcctaaatacagaagagcttcatcagcatctcaatatatttctcccctaatagcgttgtccatttcacttagttccacttatcgtatatgccgaccagagttcagttacaatattgcaaagaaccctcgaagagtgttaaccaaaccaagtgagcctaagctcaacaatggctacgacaatattgacagtgactacattcaatacgtccacgatgttttgggtattgaggagaataagaaatatatggttctcgacattttaggccagggaacttttggacaagtggtaaagtgtcagaacttgaaaacacaagaaatcgtagcagtcaaagttatcaagtcaaaggctgcttttttaaaccagtcaatgattgaggctgaaatactagaccatttgaacaaaaatattgacccacaggatgttcaccactttttaaggttaaaagataagttcattcatcgcaaccatttgtgtttggtatttgaacttctttcttcgaacctttacgaattaataaagcaaaacaagttccaaggtctttctattaaactggtcaggaagtttgcaattcaattgttggattcactttgtgtgttgaagaatgcgaaattggttcattgtgacctgaagccagagaatatcttattggtctacccagacaaacctcaattgaagattattgatttcggaacagcatgctacgaaggtcagcctgtatacacatatattcaatctcgattctatcgatctccagaagttgttttgggtttatcatattcaacatctattgacatgtggtcgtttggatgcattgtggctgagctgtttttgggattgcctctttttccaggaacttcagaatacaacttattggccagagtaattgacatgttaggaatgcctccacatttcatgatagaaatgggtaagaattcacctaattactttacgaggataaattccactcagtacaagttcaagaatgtggaacaattttctcaagatccagatgtttggaagagagaaagagaaagtaaatcatactttacacacagatatttaaatgagataatacttaattatgaattgccaaagaaaaatatgacatatagcatgattgacaaagagatgcgtcagcgagaatgtttggtgcattttttgatgggagtcttgaacctgaatccgttgaaaagatggtctccccagcaagcaagtgcacacccattcatcacaggtcaaccgtttaattccaattggacacctcctggatttagtgttcacaattctggcggatcggaaacggagttacactcctcagagaagacgcaggaaacacaacctgaacccagcacatactcaaatacaccagtcagtcaagcatatcgttcgtcattcaccaagcaagagcggcctcctcaacagcatcaatactcgtatggatatgcttcatcccaagctattccaccaaaggaagtccccaaatctaaattacaacagtacacaagcaattatagtgtatcaagcggatcttcaagctcaaagtcctcgtctatggcgggttccatcacgggcgaagatatcgagactgatactggccaaacaatgttcaagcaaggatactcgatccaaaaggcaagtgataaaaagtagactaccaattatgtctccagaggtattgatcgtaataaaagcatctgtttaggtcaactatctactagttatatttacatgtaccctaaatcataatatacaaaataagagagaagacagatcaatgtgtcatgtctaagctcctaatggagcaggggcggcgggagcttcaccgaaatcgggggccataggcttgttttgaacagccatgaatctttggaacatcataccaacaccttcaaagacacccaagacacaagcacacgtaatggcagaatttcgtgtttgtttccaaccacctctcatagctagagcaccaccggtgaaaaatccggcaataatggcattccagtgatcttctctctttctaattgccttgacggtacagtcaaaggtggagaacaaaccaccccatacaccaaagttaccaccaacgacaggtgctcttgctttaatggcagaaatagctccaatacgacgttctccgatgggagagtttcggaaacccttaataccgtgccagacagtaccaccgagagccttgggtttgttagtaaatctttccgtacctttttctccgtcgaatcaactttcttgggagtaacaaattacacttacacccatagcaaaggcaccaccaaaatcgttaactataatcaacggacatggatctcttgaatgatcggcagacattgtgtgcgtgtgttaagttacgataaaacttgactttgtaagctcgatgtgttcgaaaatttttgaatggcaatgaaatggtcgtggaataacaaataaatacttagaagtcagcctgaaccacctttgaagaccctgttgagtttcgtaggtctgacatcatctagtaggtcccaacccaatatgctgttttctggattgccgtcatcctcatcttgtaaaacatccaaatcagcttcgtctgggaaagaggaattgggtgatgaaaccttggacgtagacatcgcaaacgaggtggaaccttcattcgaatcaatattggaggcctcgtatattgtttcatccttgtgttcactgaaatcatctaaatctttagtattatcatttgaaagactgtgcatttgaatgttttgctctgcagagtgatgatggtccagttgaggtccttggaaatgatcctttccgtaaaatatccaactgacagcagcaaatacagtgaatgacaaaaataccacaaacgcataattcatgcttatgattgtaatcggtatttgtactggcatacacaaaatcaccacagtcaatacaatccaaaacaagcttatgatgttcaaaacatagccgattctctttaatttgaaggcggtacctttcactttttttctcttacccaaaaccgaactcagaattgggattccattcgcaatagataaggatatcacagcggagcccataaaagcactaaatgcagatgtagagaaaagtgacagtactcctaggaaacatgccacacccatcgaaagaaacagagcatttgctggtacagtagtttcatcaattattttaacctggacccaaatccagttgcatggtagggcattatctctggcaaaagcataagtagcacgggatgatgtagtcagtgatccaattcctgcaaagcaaactgctccaactagcaataatactagcaaaaacgaaatcaagtatgactctgtagccagtttgaataccagatcaatgggcataatatcaggattcttatctagtaaaagattcagttctggtagaatagttagaatagggatgatgaatatcactccagtgataccagcaaccaacacagcaaggaccattcctttggggatatttttctctggctttttcacttcatcagtcatagctggaatcattccgaaaccttgcaaggtaaacgcagcaggttgaaggccaacgaaaaatgcaataacaggaggccatcctgatcttgaagcatcaaaattggacaaaacgaagttgatgtcattacgagatcttgccttgatcagcaaaatgatatctatgataaggactgttccaatggtccatatgacacacaaattgtttatcgtatctaaccgatttgcaaatttcagattgaccaatcctgataacaggaccatgataaagaataatagtaacactaggaaggaatcctgtctatagcccgaatcctttaatccaaaaatactcaaaataaattgggctccaccataaacgatactagtaaacattgaccagttaccaataattaaaaaccaacccgtaaaccacgagcagattaacgaatacttctcacttgctagaatagcagcctggtgatagataccgcctgaggaaggatattttgaacaaatttctgctaatgataaagcagtgcacaaagataagatagccaccacaacccatccccaaagaagcgtaacacttccaccgtcaatcagtccaatgtaaagagtagttgacatcccgaaaggaacacccattagggagaaccccaaaccaataatggatgttactgtaagtttccgttgaagctcttgtttataattaaaacgttcaatatcctcggtatcatcttcttgatcttcccccgtgatcatatctagtatatggcctggagtctgatgggctacatccattagattagtagggtttaaggtttcctgtgcccgttctaacagatgagaactggctgcagcatcttgaagtctatggaattgtgtttggaccccaccagtggtcaaaaatctcaatgggttccttgattgttcagacataaaatacgcagaccggcactggaggaccttgacggttggtagttcaggttcagaagagttggctggttgatatcactatcatcgcgaagagcattttttttatctcttcgcacttgaaactaaggtcaagcgaacttttcagcagtgacctgacttatagtaaatcatccgttcttagtatggatgaggaaatttacgatgaatttggtaacctcataggaggcgagaatgactcacttgctagttcttctgagagtgaaatcgaaaatatctccggagaaaaatctgaggaagagtcagacgttgcatcccacaatgagaacgaatcgccacaacaaaacaaccagcaattggtgcccacttttgagaaggtatatggaaacgaagtggaagtgttgattgagcaagaagacgcgcaggatatcaacgttcccctagtacaacctgaaattgtaaaatctgtcaaaattgaagaaactgaccttccctcaactacttactccaaggactatttagcccaattaagccagataccagagcgagtgattaatttggcctttgtgggaaatttgcattcagggaagacaagctgcattgatatgttcgttgaagatactcatgactatgtcaaccaagaagcacactcttcgaagaactacaaaccccaaagatatactgacacttataaactagagattgagaggcaaacctccatcaaatcaactcccattacaattctgggtaccaacttagcaggccagtcctctgtcctgaatattatagatactccaggccacattgatttccttgatgaactagccgtgagccttagagcagttgacaatgctgtaatcgtgctggactgtttggaaggactaactattggaaccgagcttgtgatagagaattgtttaaaaacaggaaccaatatgattcttatggttaacaagtttgaccgattgattttggaactcaaactacctattcaagatgcttatttcaagcttcgtcatgttatcgaacaagtcaacctttttatcaaagaatctccgtatctgaccaaaaattataagagcaagagactttctccggagttgggcaatgtatgcttttcatcgactactttcaatacgtgtttcacgttgtacagctttgccgagttatacgtccaaactagacagttaacagtacaccctgctgaactttcgaaaaggttatggggcgatgttttctacgatccggaaacacgtaaattcagcaagaaggggaaagatcgttcatttatcaagtttatcttagaaccaatatataaactggtttccatcacaataaccaagacaccagaagatttatccctttcgttagctaagttgaatattactgacatctccaaaaaatctctccaactagattctcagattttgttaaagatcattttcaaaagattttttggaaaaccattgcaggcttttacttcattattaaacaaatctgctgtttcaccagtggaatctacagaaacaaagttttcgtcaatctatcatggtcctcacatttcttgtgatagcgcaaggccattagtagcagtcatcactaaattattagacgcatcacaaggcaccagctttctcggtctttgccgagtagtttcaggaacacttgagaggggctctcaaatcactgtgattggagagggattttctgagtcttatgatgaggactctgtaactgttccagtgagtgctttgttcatcccaggagggagatatcagattccagtctctaaggtctcagcgggcaatatatgccttctatcatccaatgaaaatttcgataactttatctctaggcaagtagtcatttacgattcatccaacccagaaaagttcaatgtggaacctatcgattacatattgaccccagtgctgaaagttgctcttcaacccatgaatctctcagagactcctaagtttttaacaggattacgcaaaatcaagaaatcatttcctggatcgcagattaaagtggaagagagtggggagcatgttgtgattggatctggagaattttacatggattgtttgctacatgacctgagatatctttacacagatattgaaataaaggtcagcgacccagtaacgaagtttatggaatcatgcattgaaagctccaaggtaaggatacctgtggaatcatcaaatggcaaaaattctatttctataatagcggagcctttggaaccggaaattgcaaaagatatggagagcggtcgaatagatgtccagtatcgccaaagcaatttgaagtatgaaaggtttatttctcggtggttcaaggaatatggatgggattcgttagctgccaattcgatatggagtttgggacctgagagtcatgacacaaatattcttatcgatgatacactacctgacgaggttgataaaaaagctttgaaaggacttcaagattcagttgttcagggattcaagtgggctgctagagaagggccattgtgtgatgaaccaattagcaataccaaattcaagataattgaagcttccctagcttcaagtcctttggacgctaatggagggcaaattatcccaatggtaagaaaagcatgttacctagccctgatgattgcaacacctaaattgatggagccagtatatcagattgatatcctttgtcgaagtgatgtcgttggtaaacttgagaagctactggataaaagaagaggcacgatactgcatgatactccaattggtggcactccattgtacagagttgtgggaatggtacccgttattgattcttttggactagaaacggatataagagtcatgacccaaggactagctacatgtctgctacatttcgccagatgggacgcagttcctggggatccactggacgaacatgcttttataccacagttaaagccggcgcccttcaactcgttggcccgtgattttgttaccaaaactagaaagagaaaaggaataggacaggatccgtcgttaacaaaataccttgacgagtccgtagttatggagttaaaagaaagtggtgttatctaagaaaaaaaggttagtttttaccttttaattaatatacattaatggtttatatatgcctaaaactctaatgacgattattctgccttctcttgcttttgccgggtctaggttttgcgtagttactcttaccaggtccaccgcccttacgtctgtcatactcagagagatcagcgctactttcagcgtcattctttctcttgaatctcttcatacctccttgaccgtacttgctgttctttgccaatctcttaccgttaggcttatgtctatcgtgtctttcttcattagtagcagcagcttcttccagggcaatggcaaaatcatcatctccaagttcttggtcttttcttttacgtttgagggacttgattttgtccaaagtttctttcttttccttttgacgactttgtaaagtctcattttgcacctgtttaccaaacttcttgagttgtctttgctttcttgcgtcctctcgggccttcttttcagaagcctcttccaccagcttcgatttcaatttgtccatgtgttcatccgatttgatcatttcggcaaagtaatctagaggtcttgagaaaggaattttcagctttaaaatcttgcttctaccttccagaactgcgttgattgcctgtttataaaatgcaagctctctttcagtgtcatcgtaaatgtcagtcacttgagaggcagttggctcgtctgacgttatagattgatgttcgtcaaacttgcaggtatcccatggcaattggattctggccaaggattccttgagtgcagcttggttattaatagtcactttagtgtagggaacaatgtcagcatcagagtcaaactcaacgtcagacaatggaacatctttttcctcttcttcgtcctctccagtcccagcttcagcctcttcatcgtcgtctaaatgttcagtggcatcgtcaaagacatcgtcatcatcatcatcggaggataattcagcttcactagctgattgggccaatctgtctagatccaatctggcttcgatgtcctcgatgtcactgctgttactactgacctctgactctccttcctcgtattcttgctgtttcttcagttttctttgttccttttttgaaagaacgctgctttcagctttttcagtccttttggccatattgaaagattgaaaggagggttaggttgattccgtgaaagtaagctgagatgagtttgaaatttttttttttgtcgctgatccgggtaagcacagaaaagacttgaaagtcagtttttccttcctcaagggttgggcttaggtaggcagccgaggtaggtcgccagctattccctcgctcgtccgttccccaccagtttaccctttacacattacgtagggtcccctcctaactatacgagacaccacttgaacccctcccaaatctagaaggagaaaaatagttgcacggatatagcaagatactaggggacaaatgggcaaagttcaaattgattatgactacacgagacacaagaagcctaatgcaattgtttcattcaccaatttaggtattaaaatgttttcacctattcagtgatccaaatatccgtcatttcttctagataattttgtaagtcttcctgaaaaaatgcgcgtttcaagtgactctggcataaaccgcagtgtagacctggaaaacatcaagtaaaaggtcttctgatgaccggcaaaggcccaacttggatactctaatcgtaaataagctagtaagaaagtgccgaaaaaattccttgaccaaaacatgatttatatggatggtattaatttatcgaaagtattaggcgagcggtgggtggaattgggattaggtgcggtgcagtgcggttgcgcatgtgttatttacattttactgccagaaagaaaagatatcaggggtcgtctgcacgcaacactgcagcgactcagctgtgcacttacacttacagctaacaaatctagagttcaacggtaggaagcctttctccgcccgcactcaagggggacaagtttcaggatcctggtgttttttctcccgttagcagggtagtaagataagtcaattcggtaacggcaggagaggtggtaggtagggtaggttaggtataattatttggtcgtcagcaacgtttcaatccattagagtttgaagccctggggtgatttcaggcctgtatcttcagttatctgatattcgcatacgaccttgggagcaggttacgagaatctggtcaagataagatgtggtcgtgttcacgttcacactaattaattgccgtactcagtggatccagatcaactggggatcttctctacggaagaataattatgtaaggtaggtaagtaaaggcatggatggcagaagagaagagaagcgctgcatttattagttgattgggtgggacaaaataaaacagacagggacggaacggaacgaacggcacgtggaactgaactctgggcatgcagtcccatcccatcgcgttggcattggctcgatcgacaactattcaaaaaatattaaccataactgcttacctcatcaatcaagttctcattcgcgtctgatagtcgatggcatgaagtaaatacctactcaccaaagtctagctagtataagaaaagtcgcaaatacagccccactagaaatgacttatgggcttgaggattcagaaaaatggaactcaacggcccttttgttagataaaaaccccctagacagcgtacgaaagagacgtattgaagcgcacattacagactcttcaaagttgaggacatatcatggaacactcaactccactatcagtttccgcaacttacaaaactttcgtgacatacagaaagatcctgcaccggaaaagagtaacacagacacatttcaaacgtaccagaacaagcaagtttcatactcatcgaatagtccaaagccctctggaatcacagatccagtatctaccaaagaccagtttcgtcaaaatttacaagacggtcaagccctattcaataagtttttgaacacgtctaaagcagataatcctcaaaatgctggctcaaaacaaatatcaacaccaatctccatggaaagtattcagtataaaacattgtccctaaaactattacgaatgatattgtccatgactgtggtcatttgcctgtttataattaagttattgacactgatggtgggttttttgaaaagcaaaacggagacccgatttgctcaaccatcgagctttgacgacttacagaaagaaagtgcacaaaatgtggcagcggataacactcatattcaatttcatcaagactcaaatatcaacgcctcgactcccataaatccaaacttaaatgtgttcaagaaggccccagctagcattcatcccagaaatcaagttcaagcgaaattgctgaatgctcaatttggaacaccttcaggtatttcgtcacccattatatcagatttcatatcaccaaacgacatgggtactcccatagaccatcaaaattttgaaaagaaaacggacgcctcgactttcaactggcaatatgatgctcccattaatcatgcttctcaaacttttagtgatggcggatatggaacccatttctatacctcaaagaagtcaagcaatcaaaagaacacagagacaagctttttaaagaaactatttgccaaagacacaacagttttagatttggcccccattgatactaatgcagacagtatggaaatctggcaaccatcaattaataaaagccacgataagaagatcaacgatatgtttgaacttacccaacgacttcgggcttccttaatggctgaggaacaacaaaagaaaccacccactcaagacctgcttttagattcttttttcaaaagaaacgaattacttataacgaagagaaataattggacggaagacaataagtatgaaaagctggagaatgattatgaaacttatcaggcgattatgcaagaaaagaagaagagagaagagcttatacagttggaaaagtcatctcttcttcccttggtacaacctctcaaacttgaatacttgaacttggtgcagaaatactggaattccaaagatttgacaaagaaaatcgttacaggcataagcgctgaggtgtttgtgagagatttaaaaactttgataaattcaagatggatcaatgacagtgttattgatttttatctatctttagtctctcatagatcaactcaaagctcctttttgccatctgtttttgcattcaccacacacttttatacaacatttacaagtcgaggatatgagagtgttaagagatgggccaaaagaagaaaagttgacatcaccaagcttgactatgtttttgttcctatcaatattttgaattcccattgggcattgggagttatcgataataagcgtaagcggtttcaatactatgactccttgaaaggggaaggacaaactccagttttaaaccacttaagaacttttgccctgaaggaggctgaaaggatctacggtgataaagtacccattaatttccatgaatacctattagattataacacgaattctcctcagcaaaagaatggatcagattgtggtgtttttacatgtgccacagttgagtttctttccagagagaaagcattgaaattttcacaaaccgatatgccactcatacgtcaaagaatggcctacgaaataatcacaggaaaattgttagagtgataatatatatactattaataaactacgttgtcaaatctttaatcttcttttcgtaatcaataatcaaattattgctcgtagtgatcttttcatccagatacttgaatctggtcttgaagtaggagctgttctctggaaacttggaaagctcgtcttcccacttggaaatcttacctgtttctaaggtgatcagagacttcaaataattactttccagttctctaaacgagtccttgttggcgaccaaatgcttaaagacttcttcatacaacggcttaccagccctaatttctgttattaaacctgtcgttttggtcaagcaaactaactctgatttctccatttctgtgaggatctgcttcccatttgacttgaacagtggattcaaaagcaagtctttgtattttactgacccttgatcatttaacattttgataagagcccatacttctgctggcccaaaagtattatgacctttattcaaaaatacttgcatcaattgctccgcagtttgatcgaccatctcttcaagagcaccggtgggtgtttcaccgctgttcagtcgtctcatataagcttggaggtccgacatccttcctccaagaggccggattgtctcttggacttcttcaacgaacttttcagtcactttggattcttcgaactgactgagaacgtatgacttggaggactcaaaggaagcgtcagagataggaataactttaaacacgttatcaggtaaaacgtcagacaaaacttgtaaacttcccacatcgtcggtaagatatatcacatgtgcgatattcaacgtgacaagcttcccagcccagtctgcaagttctttatagatgaaagcatttgtttcgttagcttttttggaagcctgaaatctgtctataacaatcacaggcttgacgtcaggatattgctgaagaaaatcttcctcctttaagggcagggtgtcaccttcacaagacaactcattcaagtaattcgagtagcaagctaagcagatacccctgatggtgctggcggtaagaaacagcatattcttgatctgtttctctttggattcattcaatccggttttttgaccagtgagaccttgagttaccagatccacataagtaaaaagcgagttgaaccaagggaatgagggataatagcccacttgatgagcaacagctttcaaaaaactggcttcacttcttgcctttatcagctcatcacaatccaaatgcaggacatttgccctatcactaaggacatgcgaaaaaacaatctctctctttcctgtgcccttaggaccaacaactacgataaaactattgatgttctctttcaggaggagttttagttcttcaacacgagccaacctttcaccccaagcgctttggttgagggcaaatgaaccagtggtatggtattcatttgttgtaattaattttcttaaagaatctttagtgatactgaaaaagccaatgatagatttgaagagggacgagcgccacaatttattcaaggaatacctttgagtgatcttttctttgatgaaaaaagaccttattgggtcaaatatcagaacagcgagggaagccaatatagcgattatgattgggaatgctatccgagggtgattggcaatagaatctttaataacgttgtgacgaacaattggaatatactgtatgtgcagatatgttccacctaaattcagccccgtaatacaatgtctcgcattgatagcagaagatgttgacttgaatgacacttgggctttcttgttggcgtcagtcgcaggcttgatgtctatcaattcgccataccttctgaatagcagatacatatcctcttgagtgagcggtggaccctcaaattccacctctatttggttggaaggataacgtcttaagtcttcaatccaaggaatacccttgactgggtgaactgtaggagacatgatgcgattcagaatacctcgtttgctattctttgccacatgcttggttacatttttattaaattcagcaactgtggtagtttccggtacaacaaatttgacaaacactcctccatctcgtggtatggtgataatatcttctatgtcaaaagtgcacgacgttggagtgtttgagcacaaatctgttatcctttttcttagggctacttcactggtaccccaaaagcgcgttaaatactgcttgatatcccatctatttgatttaaaaggtataaccgttccaaaataaagaagagtttcttgactgcccttttgaattaccccagtcctagtggcgtcgtcttcctcaccaatattctggctgtctaaaatggcttcattggaaacaaaccgtttgctcaaagaaaaggcttgaatccattgtctctggtagggtttggttaacttagtagcaactaggcccagctggcttctggttccaagcattaagagagagcaaagtgttgaaagagatggagttagattaagattgcggccgcgattactacagataacaacatatattatatgattatctaatacgagatgagatgagccttctctggtggggttcgagagatgggatagatcagatctcttccgtctcttcaaacacatcatcgtaattgttgatcaagtcctcacaaatgaagttcatgataccaaaatagtctctcgtgatagctggagaaacagtttcggtgaaggtagcccccaaaattgtcgcaaggttggaagcactcattttgttgaactctttataatcatccacaatctttaaatggcgaatcaatcgtttcagtagttgatagttgtaaaatggaacagctgactggatgtgggagtataattcacatttttgctcttctgatgagttgctagtaatttctctggccttggcaaactctggaatcaaatggcttggtattaatggatcaggtaattctctgaggaacgattttatgcacccggtgacgttattaatgtcaaatataaggttgcttttccattgttgatatctaccattttcatcgatctcttgtttaagggcgttcaaaacagataatgacgcactttttctgtagataccaacctcttccagtccacggacttcaatttcagccatcatcttttcaatgacgatggggacaaggctgttctctcgaagacagatgtagtctaacggaacgccaaataccagtgtagatgatgagctcttattggttagtttggaaaaaaaccagtgtctctttgcaaaattgatcctgtgaatccaatcttccttctcagaatcaccggttgcctggaacatgtattcgttgtcattgacagtcgatgcgatcttaaatgcggcagaaagcctataaacagaaaaggcactagcagttcgaaggttgataacgattgaaggcttgactttttgttccataaacagactggcgtctggaatttgatgtaaaccaacaatcttcactggtgctggttgggaacccaaagaaaaaggtttcgaagccttgttcagaatatctgaaatcttaaaacgagacgatgctgtgaccttcttgctatttgttggcacgttatgattattgctgctactgcttggtctcctcaaattcttagcatgtgatgctttatcagtattaatagtcattgacgtagatacttgtgaagacgaatcgccacctactgccctgttcatatctgtacgacgatagttcaaatgctgcctgcctgggggtacagcactggaaagacgcttacttcgttcttgttttgacaaaaaggtaagtttatcatgctctcttcgtaatatagtcatttgtatggaaatcagtgtagaaaacaaactgggctgtttagttgcgccttctttcatatattcttttgactctctggatgcgcaatctttaacgcttttgaaatcagggttctccaaattgagttcaaataaccagttgctattctcttctatgtctgcgtttcctggtgcatcgttcaaatccaaaatgttgctgatacaattgtaagcataccgtctcttatcaaaattaatgagttttgtattctccacgctcatgttaggaatgtaacaagctatttcaatcagcctctccacaatccaaccagggcaagctgtaagtgatccgcctttaatatcttcttgtggcaatgacggcagcaaagacatgaggctttttacaggtgctttagtcggttgattgttcatgtaggctttgagttccgctgatgctttcagtaaactatgagcgaatattctgacttcaggagaaacaatagcattactcagacatgattccaataagctaggaacatgaggagaaacatcaaactgctcgccttccagaggatcgaacaagttaagtggggacattcgatccctagctaaagctaagattaataaaactgaagccatccttttggtacgctcttcctttgtaatggttaaatcagtcaactggcatacaacataggatttcaatttaaagtagaacaaaaacaatgtccttatggtgaccgggaacttatctagcactgaaactctgttatcgccgcaagtatcgtcgtacaaagattcgatccaatagaacacatttgaaatgataaggttctcttcaggtgtgtttagtggttgaaggtgataatcaaataatcctgtgaaagactttgacgactgaatttcgatagcttcaaacacacttagccaatcttcaagagaaaccccttttgagatatcagataaagatgcctcaatattggttataaaagaatcaattgccggtctgtcagtatatgcaggaaaagttgaatggtgtaaagaatcggatgaaaattctggtcttgtgacgaggtttgagggagaaacatttggtctatagcttcttttgatataagcttttctagtcttcttgtagagtagtagaatctgttgatgacaggcttgtagctctgaagtatcctcgtttttggattcaagcgagtttagcacttttgaccactgtattatagtttcgtgatcaattattctcaagaattcagagaagaggttcttgcagttcaggtcgtctataaaatgatcaaagtagttcttcaccagtactagcaacgcctcaagcacgccaatttgaatttgagcgacatacttccaaacaatattgtcgtatgattcatgaccttcatcaattataacatcccaatttggataggctttgaagtcaaagttcttggagtttggattctcccgccgtttagcgatagatagagcagcagattttgagccaacaaaacgtctgaccaatcctttcaataatgtcgatgtcatgcaaaacgacctataggtggcaaaaaaggtaagcgtaaatataccattgtccatctttaacgaaattggtctcggatattcatcacccaaaaatgctcgtacatcttcagttgaaatctcagaaccaaatatagacgatgtcaggaccagtaaatcgataattctatccagagttgcagcttttgctaaaatttccactgatagcggttgagtcgagttattagttttggagtattgatcagattttcttccatccagaattccaggaatgctctctaaatttaaaccactaagagaataattactgtatcgcttcgtgttagcggattcagtaaacagaatgcttgaaggccttgaccgttttaccgaaccaggggtaccggtaacatcagcatagtttgaatctctctctgaaatatcattgtgcttatctgatcggtgtacaaatggaagtggaacctcaggttcttcaagacctaaatcactacctggtttcaacatagtcttgaaaattatgctatcatacaccctaaattccgatgactcgatgttgaatatgtcacgcaacgtcttcaaaaattgatttcttccaagtcttcctttctcagcacttttctcacctattgcttcagactcattaggttgttctctggtgattacgttcagattctgagtagatccagaattcaaaattccagattggttagagaacttgtagacctcattcaaaagtgtagatccatcatttccagtagcaccaatgagtgcacgttgatcataaacactatacttaggaagaagggtaggaaaaatgacagatatgtaggaccctaaaaacagcggcgatcttgaactattatgatacctgctaaaatgtcccttgaaactaggctctacctccaaagataaattcataatatcttcttgagctagaggggaagcattcacatggtactccaaaagtgcttttagcttatctctaatagagggatcagatgttatgttttcgttctgcaaattctcttcatctgtaacctgaaccaaatattcattccacctggcaaatgagagctgggccctttgacagattttttcacattgcttgaatgttgggacttttgttttcttaacaaaaagatccccaaagtacggtataactctatccttcgagtaacatttaccgattccttgaggagcgattacatgataagaagatcgatggctggactcacttatcattgaccgtctgtctagttcgaaaacgacaggagcccagttctttgatattatttcgatatcgtcttcgctgacctcggaccacgtctcctttagtcgaaggatagggatggagcatatacaggtcgcaattgccaaccagccaaccatatcgccaatggcatcaaaatgagaaccaagagcaatccatttcgaaattaaagctgcccttaccttagggtttttagttgccatgggatcttgaagtaaatggtatgttaataatcttgcaaggtagtgaacattatttacagaattgaaaataagaggattttttcttggataagagtaagtgtccaatactgattcaaataagagagacatatcagactcagcatcccaccttctattgaaggccaaattgatttcattgatttcatgagcaaaaactttcagatccagattcataaaaacttgagcattgagttctgacaacgggtcattggatgaaggagaaatggtactgaaatttgttaactccaagagagattgttgtttcaaatgaatagatcttttcaactcattcgtattttcatgcgaatctatactcagtaaaaggtcccagagattcttgaatatttcttcttcaagtaacatcccaggaaagctatctcggatgtatgtaaccacgtaaatcaatctttcagccataaatttctcggttgttggttgaatgggaatcaagttgctcatatccatctcagatttcgcaatgtgggtcgtaaacatatcagaatatttagtgaaaattaacagggccttatgaatgtctccgaataatggcagaatggaaatcaggtgagcactcagcttggagtcgtcaccactgccgtcagtatatgtattgaataatatcgtatgacagatgctttctaatgatccatttaaaatagtatcagtatttgattctaaaatcaattcaggatggggatatttcggcgaagcataggtgattctaagtggttcctggcttttatgaacgcttgcactaacacatgtcccactaatagattctgaaatatcactttctttcgatatgtgtgatgctgaggatttacttcttgctgtagagctgttttcatttatcaaagtaccttgagaattgacggttgacatggacgaactttgcaacttgtaaaatgaaccagaagactgtagactggaagagccaatagtctgagaagcagagtcagattcttggttggaaggctcgttttcagtttgaccgatctgctttgaatctatatctaaaaatttcacctcactaagctctggcggagctttgtaaatatacaggtgagaacccttcagctcagctctatacaatctcagatcttcctttttgggttcgttcttttctgtgtttaactggattctattaacccaccccgtcttggcgatggtagtatcccaatcaggctgcatcaaagattgaatgttagcgttgggtttcaatgtggatgactgaagaggtttctgaggagcttgaactttccttggggatttactttggggctctgaattcttcaagggtgtctgattagtggctacaaagctttcactttgataagtagcagggtcaaaatccagagattttagagactccataggcacggcaccagggtggtggaaatcatcttcgagatcgtcctcttcttcaaaatcagaaccaaatcgttcctcttcaaaattcaaattcgaaacctttttcttcagaagattcacgcctttatggctggaagcatgatctaaggggtctaaactggaagaataagcaatcgttttggtagattgagacgtgggaaacttatcggtgtcagggctggcaactaggcccgagcttcccaatggagtcacagatggaaggacacttttccgtttgtccttcctattttgccaaatcttcttcatttgatcaacaattggtgtgggatctaccgagtttgcttgcggatcaaatggaagggtattacagtaatgggaagtggaaagctagatttcgagacgtaaacgcacttacaccaggctcaagtcaggagtaggaattctcaagaggaactgaactggtatctagcctttagcgaataccagtttatttgacgtctacgatgaattaggtcccatattccctttcatatctagtttaccctcatatgctctattaagggcgactacttatcattaaatgggctcagagccaggagattgatatttttgttcgaatcgcttatagctccacctgttttttgcttggacgataacgcggagccatttatgcgccaagtaacaaatactacctatccctctgaataccgccagggcaaacacagaccaaagtatgaaggccaagtagttgttcttgtgaaatgatcctggttcgtaaatttgcgtcacagtcatgactagcaccaaattagctattagccagaacaagaccactctggttctaacatctctgtaataatctttatcagatggtttggacacagtttcttcgtatctggcctttttaggaatttgcctacgagatttcaatttgaacaagacttcgtcgtaggaattgttgatgtcagatacaacttcaaactcgaagaactcctggccgtcatcgtcgactttcatgacagctgttccaagatctagctccaagttgttatctccctttgttccccaagtaacatcgtgtgtgttacagaaagcatatatttgaagcatgcaagtgtatgctggaagcatgatgaagtactgtaaagctgatgtcaatatatgccatggttccaagtatagaagagacattaccgtgtatagtccataagttgatgccaaactgatcacaatactgacaaatgtaccgtccgaggaatctaaatttcccatgcttttctggttgatggtatccacaaggtaaacaaatccacaaatcaacgccacaactccacaaactactaaaatcaacaatgatatcatgtagagatgaggagccccctgtggtctgttacccatcgatatcatgaaaattgccgtcaaattacacaagcaaatgtaattgagtacctgaaagatccagaatccccctctgcctggaattgacttgttggatgctagtgatcccacaaggtaataaaaagcaatataaaagttggccagggagaacatactaaaaaacagctgaataaactgatagaaaaactccaagtggaagaagagtttacggcttaacgaatgatctgtgttccaaattgccctaaaatgtgtctgagcgtacaacgcagcaaaaaatgcaccattaagccatcttcttcgttgtgaaataaactctggtaaggcttctggcacatctgtttcacctgtggcagagctaacgtatttaagcacccatttctcatctcttttggccacaagttcccagcagaggattctgtcctcggccaggtacatgtttgcattgaaaacatttgttagaacattgcctttcttgtctttctcattggtctcacctttgaaataggaattaagtgggcctgtaccgtcttcatgattttgtaaagccgaatatctgtaggccgaaagtgctcccggaagaacactaatgtagccaaacacagattcaaatggtttatctaagatgtttgacattttgtattcaaagttctgagaggccaccaacgggttgagcagtttgctccagtatttacctttcatactgacaatttcacctgcagcacctgcaacattggaatcttggtcaaaagccttccatagattgtagattgttttggtgtcgggtcttgttccaacatccagcaatacacaaacgtttggtctcaaagattgacacattgcgttaaacaaccaacgatgagagttgattttcttggtgttattttctttcaaacagagaacgacctgaactggaactacgcccttttcacaaccggtgaattttagatcctcattgatagaaacttgtgtggtatactcaaacaaatgggcctggacaggcttattattaactaaggactttgcaattccctgttgataaacaccaatacctgctaagacattgagagctccaacattcattttctggcgtccatctgcaatgacaacgaccacaactttcttccagctgtcgtgaccccattttttggagttatttctcttacaaagatatgcaatatttttcatgacggcatgcatcgttctagtgaaagcatcttcgttttcgttatacattgtaatgcaaatgaccaactctgtttcacgaccgtattcagatgacgctctcagggagaaaccttcgttgataaagttgtcagcatcagcagtgactgcggagtatctcataaattggaactcttcttcctccttcaagggttgaaactgaagtagcttgtcgggtattgggttattgagaattaagtttccattctttgaggcatatttgacctgtgtggccagatgattttttcttctaggttggtagtttgcgggtaaagtagcaaaaacttggccatcaagatttgatccaaaattgctccactcttcaagatcatcaacatcaactggatactgttcattatacatggactgattatcaccataaagggttgattccgtgtctcttttgagatcctgtgcttccttttccaaatatttttctgaaaggtccatttcatcaactgcagtttcattggagtcgtaagatgatcgtggttgcaaatcgggtaccttgccgatatgatgagcctcggagtattcagactgatctgagttggcagctgcaaaggtagatgcagagaaaattggcttaggtggtgacaacattctctgactcttggagctcgtgattgatcttcccaaggaaacccgagtaggcgatcttttgaatcgactaggactgccaatagactctttatctgcttcgcttgcaaaagagttcaatgactgatcatcatattcatctttttctgtttgcaaaggcacaattggaacatgctgagctctggttggtgattccctagctgtgaatctagctctgggagtttctctgtcaggagatcctggaccaagatctcttctttttccaaaagagaccatgggtgaatatttcatagcagccttagaaggagatggagaagaaaattccctatcaaatttaccagcaacgtctacttcttgctcttcatcatcaaatgggtcatgcttagatcttctgggagactgtcttacctcttttggtcgaataataaagtcgtaactgctgtcatcaccatcttggtccaatgcattgtacttgttattgaacggatcagacatttttggtgatgctagtaatggaagaagctaacattatttctgcaaattacaatactaaagagagactaggaaaagggaatgtttatcaattacccaattgggatgtaattataatgttgacaaaataaaggtacatattattatgacggtgatcgcgcgtgttagctaagcgtctgtctcagccaaatcctgcccattcaaaggagaatgttttgacagggcttgcttccaacgatgttatgaactcctttggatcaagttccagctggggttcaacaccgtcaacgtctatcttgttggtcagacccgcaatcacatagacctttttgacggctgtagccaatctaccaccgttaaccaatttcttcaattctatcttctcaccgttgtaaacaggtttgactatgagatgtgagtggtaccttagaggatcgccaggataagcaacaaattttcctccaaatcttaatcctgcagtgatgaagtacccgttctttctaagatggctgaagattaggtaatcagccaaagaatgagagaggtttggtcgactttgtaggagctggaacaacaatttagtttgaacttcgggctggttgaaatgatcgttccaggtgttaacattaggaagatgactggatgtatttttgatctcgtgaaagactggctccttttctgtgttgtagatcatggctgaatcagggatttttttcccattagttctcagctgagacatcttggcttgaaattctttttttttcgtttctagtctctgattgtgttctttttccgcaaactgacgaatctgttgcaaatcgttgtttgtgagtgaagcatataaaccttgaaacattacatcatccggaacaatgtaatactctgagtgatggaccacaacatataaaagttcctcaaacagcaatcgaagggggacacccaagaaattgttctgctgagtggatagtggcaacgttccgctcagatatcccactatccccaacagacgaaggttcttgatggtctgaatatcaaatatcaggccctcattcctgctgatgggtagtttattcatgaataagaaaagcttatgtaatgatatcttgacttcgagattatatgcatgttaagagattacagataattacagattagtacgctataatgaataaataaattagttgtccactgcgagagcagcaagcttcaaaacaccttccttagaattggcgcccccaatgaaaccagctgcatggatgaaaacgcaaccttcgacgttggcagcttccgacagtttttcatctctcaatcctctccagggctcaggcaatgcctttctgctttcaaaagaagaagaacttacagggacagcagcaattctccagttgttacctgaatctgggaataaaacgtaaaggatttctccgtgacatttgttggcaatttccacaccataaagatgctccttccaaggaacaaatctatcaaagactaatactttaccacttgggtgagcttgaaatctctcgtcaaaagctttttcaacgaattgtttggcaggcaaccaagaacgcccataactcaataacaaattgtcaaatacttggcccataatctcagaagctttttcaaattgcttatcgaaatcagcatcagttggttcatcaacccacaacgggttgagattggagacaacagaggcaagggtgaagtttttgtcattgaactttctttcattagtattttcataatttgagacaccattgtcgttagcatcaacagattcaatgaaatccttgtacagcttttcatataaaatgttgatgttcgtggattcctcattcaagtcccagttgagtttttcagcaataacttctttaccaaacttcttgaaaaccagaccagcagagctcagctttgtttgatacttatccgagaacgtggtgctgaattctctctggtggtggtcgaaaaacttgacatcatcatattttccaccaacgtctaccacaatgtcagcttcttcccactttgcaggatctctggatctaaggagagtggagttggtccattttttcagactcctcaacaagtagacagccaaggcttcatcggcatggaaacttccagaatgggtacaaattttcaacatatctagcttccgttttttgctctctgtttgtgtctccatgtggtataattttttttgcaaaaggtttgcttaggaagtcttcgcgaaggaagacttaaagagtaggttgaatagatctagctagtgtgacattgtgcacaactgaacgcatagggagatgagaaaacaggaaagattgttgtagcaatattcaaatgtctgcttggattttgctttgaacgtggatccttttctttgctttttcaatggttagcaccaaattagctcagaagtttcctccagaacgtgtactgctcaaacaacaatctcgtgagaaatccaatcctatggatctctctctaactgttcgttgaacttccatctacacccccaaggtcaccatgtttaacaggtttaggatgagtaggtcgacttttgagttggccaagttctctttttatttgctaacccccatttctatcatgtactacgttggtattgacacagacaagaaattcaatgttcctgggttttggccggatccaaacaccttgaataagattcccaaagaaccttatgaaattcaagctgagttggttagaatgcgaaaggcaaatttggaaaagaggaagaggttagaggagagagctaaagagcttggaattgaaccagatgaggaagagaagtaaatactataaagccgaggaggatggaaagcataagtaaatcactttacctcatattgattcaagaatcactaggtcggatcgttttagtcaagatttctcatttcaatctgtaaataatgcaaataagttaaatacttgaaattgttgattatgtaacccttttgacagcccctatatctctctatcgctcaattcatcgattctctgcctgtccaccaaatacaaatgtcaacggtaagcttcccagttttgaagtctctgcttgctatttaattactaacttggaagaattcacaaccacctctatctgattatattgagcctgacattccaatagttccggatgtagctgaacctattctcccaaccacaacagagccaaggcgttctcagccgggctctactgaaccaggcttctttcaaaatttgtaccatacggtgattcaatcgtcacatccttttgcattgctgacttatgtcttttttcgggtgagccccattatcatttatatgattggatatacgctgttcgggcataatttcatttttcagttcattgttacaattctgcttttgagcgctgatttttggaatgtaaagaatttaagtggacgcttgatggttggtttaaggtggtggagtgagacaaatgagctaggagagtcaatttggacgttcgaatccgctgatgctgaaagatatgttaatccaattgattacaaggtgttttggatgatgttatatgcaacaccagcattttggatttttctggcactattggcatttttgaaacttcaatttttgtacctaactcttgtcatcctagctgttacccttagtgcgaccaatgctctagcttacaccaaatgcgataagttttttaaggcagagacctccagtttaggtttttttggcacgatgttgcaaaaaatcaatccttttgatatctaacgaaggttgttaactggaacaatacagaatccgatcagattgtcgtcggtacagtttgtcatgcttattgatccctcggagatggtcttgataagttgtttcttgacttctgaggtatcatgaattttcatatctctcttactttgattaagacccatataacttctccattttcttaagctgttttttttgctttttccgtcattttgcagaaactttctcggtacggttaagcttattatttgtgttggggatagatctcttgaaataagtacaggttctcttttcttgaacattccttgcattgaagaaattacttttacaatggatttattcctatgaatggaggcaatcgagttgtttggaggatcatgctcttccttgctatctaattcatttgctgaaggattttccagtaaactatctctatgtggccaattttcaggctgccttgaactttccagttgatgacctttttgtgattttctttctacatctgaactcatggacattttgctagtaagcaacgaaataactttttcagagtactgaaattccgatacttcatcggaggatttagttggggcctttgcagtgtttaccacttctaagtttctaaattgagacattccaaggctttccaacgctgtctccgtttcacgagctgtcacagtaacatcctgaaccacgttactactattacctgatgagaattgtgggtaaccttcacagctcatctgctgactttcgatatcaaaaattagttccttcaatcggctgttggatcttaacacatcgtcggaatcccacagttcaaggtctcttacctttgcatctgataggttcgtctcaagtctaccttcactgagttcatcggcgctgaaatactccgagagtggcatattgctaacaagattcacagcatcactgaaaacgtcacttccgctgtcaaaggggtccttgttaggcatattctcagtcattacgcccacaactcagctcactaaattaatttgacactagagtataaagtatttttgtgaacactgcgacaagtaatcacgcccacgccgcacaccctatttgtcatgacgagaccaaagcgcactctggtataaatatatatatatatatatataattagaagtatacaggaaaatagtacagtaataatatacacagcagattcaagactaaaatcatggtttcgggtaaacagcgttacccctctgagctagatgtgattgttgttgctgttgtggcagcattggttgcctagggccgtggtgaaactgttgagccatcacaggaaactggttgttacttggaggtactccgtttacttgtatccttgccattatacgtttaccatgaggagtattgcgtacagtgggtaataaaggcttcaacagttccgataatctctcaaattcttcaggtgtagaaacgtccaaagctgtctgaagcacataatttccataaggatcatttaacaactctgatattttggtagcatgagtctccagtaactggtcaatgactagcttgcttacgcggggaatcttcaagcacttttcgatgacgttcgatccaaatttatggagagataatgtaataatgctatctttgatagcagcaacgatattggccacaggtttactgtcatttatgttcttgatcatctcattttgagacaaaacatactggacaacatagttaccaaaaggatcaaaagaaagaggaatacagtttctactgacttccaaactcaacgcatagcattgttcttttgacccatggtccaaacatctttgtaaaacacaacatccatgcctatgggttgcaatctcgacacaatggtcacaagtagcatcaaaaatgaactgacaatccttgctacttagcttttgaagacatttttgaacgacgtggttaccgttcaaatctctgctcaaagaaaccacatgagatgagagagcatcaatgattatctccgactcctcttcggtatcaatgcattcaaccaacttctggagggcacgagttccatgtggatccaacgcaattctaacaaactttgaagaagcatttttaacgagagtaattctctgatcaacgctaaccttatccaaaagcttctgaatcagataatttccaaacggatcagacatcaactcgattacggaaagataggtttcgttaaaaatcatagtggcggcattcttgccaccaatgtccaactgcttctgcaaaaatctacacccatgctggtctttgcaaagagagtaaatctcaccttgaaagtcctcaagtttggcatcagcaaatttggaaggatcctcacctcttttcctcatgttcttgcggtgagtattcattccattgttcaaccttccaatgctagaattgttcaaagcagactgaccatgcccaccacttccacctaaatgttgctgagatggatgatgagctccaggattgcgattaccttgtccatttctggacttgtggggaaaagtttgcagcctgtggtttgcaaattcatcttcaagaccagtttcagagtggggaggccaaataccttgcgagtgcaccatcataggcatgccgttattaaatccgacattcatgttcatgtccaagttcatctccataccatgggacattggatgagggtagccgctacccatgttgctgaagcctaggggaagctgattttcgtatccattgggagtagcagaagtcaagttttctttatcgaccaatgattgggtagaaggatcattaactggggaattaacagtggagggagagctttggaccaaagcagggccgaaagagccggagccagagaccctaggttcagttccagaaagttccttaccaggtagttcgaagggcttgatttgatttaatccatcaagatgaagtccatgttggagaatacttagccttggagttgccgaagccatggaaggattatcaatggaccaattagaagagtttggggtcaacgacgaatggcggttattagaattggccaaaaagttggactggttcttgttgggcaaaatatcaaaatccagactcaacccacctagagctagatccaagtctagatcattaggttcatttctcaacatggatgaattttccatggactcacgaggggcataattaacaccagcagaattggaaccagagaaccgatgatccgatgaaatggtgggggtctcaaaggaaggccgttgaacaccaaatgaagaaaaagaatgaatagaattttgggtcctcctatccgaatcttttgggggagtgattggagggcatccgccgccacctgtagggctattggatgacatttctgggatgggaataattgatttttatgatgcgataaatctctctgaatactggttgatgagagagtataataatgagatttgaatgctgtttttgtctttttgatctcttcaaatgggcgataatggatgacacagggaataatatacagaagaagtcacaataatgtacaacaatgcaagtgaagatgtttcacaaaggggctcaaacagtcagatcttggtagagcttggaattttcgttatatacgacttgttgggtgaaaggctatcagttccagtctaccttttttttagttttccttcttagagacaggaatcagatccattcgactcaaaaaaaaatgatctagggaaggagcgattttttacgatcgtgtgatactcatttgtttgaaacctagattgtcatacccctagcgcccagcgtcctgtggaagttgaatggatgaaaaagtaacccttaaacgcagtcgtgtgcctttaccaagaaagtgtcagctcctgatctgtgtatccctccacattttgggttggcaggactagttcattcctttcttgttttaaccagcttgtgtgcatcacatgttactagcatggattgaggaattttcaaacatagattattcatggttgatttttcaagtataagttggttgcttgtgatatccgatatatctgacaattcgtaaggttgaaaatccgttaattctgactgattgacattgtgaaaattcagttacactttgacttaagttaaagctatgcattgaacaaatgtaatcctgctaccaaatctacgatcttctcattgctgaattcctgaatctcactcatggcttgactatagagcagttgctgaaatcattgctattcaatttccctcttgcaacattgagctacctagtttccagaaccacggtaggtggcatgaggcagtatttaactatacgagacgatgaacattgcccacagataagcaaacgtttccaattaatgcaatcccaaaaggtgctactcttttctcagactgtgcaacgagctgtattggctgaaaactgtgaaaacatctagatcagaactctacaatgatattttcagttgatcgctgggacctctgtcagtctaaaactgggtaagattattaaaagcttcatgggtggccaattgacaggcaaataaatattagcacgactttagctcatcagggactatttagaactacgaaatcttcgtgtcaattttgacaactgcctgttagatctattgttttaaggttccccatgactagctttttgctgcattcaccattttactatatccgcatcgcgaatcatgttatcaacttaacctcttccaaggcacatgtcatcagtaggctcttttgaaagcttagacgaattaccgaagaaaagtgctagcaccagtgttctggatgacgatctctacatttcagattcagagtccataaattcattgcgctcccgttcccattccttcaatatgggatatgagaacctctctgtttttgatttgtttgacccatacgctctgaccacagacttttcaagaaaggtcaaattgaacacggcaaatctaaaaaaatttacaaagaagcaaagagataagttgaaagcaagagatgaggactttaatcgcttgaaagggcaattgttgaagagactggacaaatttaatgatagggtaactcatataacaactacatccaagactgagaagttattctattcttttgccctcctgcaaatctttgtatgcggggttcttgttggagaataccaagaatggtttcatgtttactacagtgtacttttcctatgtttgatgcctgttcgatttagtacttactataagcggggctatcagtattttctcgcagatttatgctattatgtgaacatcttatgcttgctctttatttgggtatttccggaatcacaaatgctatttatttcttgcttttcatttgcctttggaacgttgtcttttgctgtgattacttggagaaactcactagtcttacattcgatagagaagactacttcgtccatgatccatatcaccccacccctaactatgtacgtgattgttcaccaaattgatcctgaatatcaattggtccgttttcccggagctgcaaagactgctagttggaatttttacaaagggattctttatacatcactgttttacttggtctggcaatcaatgtaccattactttatcactataaagcgagctgagaaaataaagcaagggagagctacttcttttgaatacttgaggaaagcttacagcggcaatgctttgggcaaggcggtaaattctttaccggaacccttaccggtagtggcgttcactttaattcagtttgggtaccagcttctgacaatgtcactatgccctctgtggttccgttacaaattactctgtacattgtttctggcgtttatcttcatagcggcgtcgtataacggtgctacatactacgttgactactacggcaagaaatttgagaaggaagtcatcacgttgcgacaggagctcacgcaattgcaagcaaagaaagaagattgaagagtttcctattttttgtaatatgtaggtaaattggggagcgtgtgctataaagagggaggaattatagcatatgtctcactcagataatcaaatcacacacacacgcaaaaattcaactcgtgtagtaactaaaaaaacccgacattacacaacttatgaggaatgcttcagctggttgactaaccagtccaaaccttcgtacaaaccatcaccggtggtggcacaagcggcttgcatgtaccatggacggttcttcactgagtgaaggccaagtttctcggtgacttcagcagcattcaaagagtgaggcaagtcttgtttgttagcaaagaccagtaacaaagcatctctcagctcgtcctcgttcaacattctctgcaattcttctcttgcctcgctgatacggtttctatcgttggaatcgatgacaaatatgacggcttgagtgttgaggaagtagtgtctccacaacggtctgattctgtcttgtccaccaatatcccaaacggtgaacgagatgttcttgtattccacagtctccacgttgaatcccaaggttggaatggtagcaaccacctctcccagcttcagcttgtagagaatggtactcttaccggcgttgtccaaaccgaccatgagaatacggacttctttggcgccaagaaggtcgttaaatatctttgagaaaaagttacccatcttgtttttgtgtttaaatctatcaactggtcaagggataaaaagagttttgttgtcacgtactgaagttatcgattgatcaatcgacgttgagtggtacacgtcgaaagctgggtaagggaacgtttcggatcttttgggggagatagcgagactgcgcagggcttacaaacaccggtggtggggcatgaacgttcatggaaggctacaatacggttacactcgtcgttactgtaggtggttggtccaggacgaggaaggaggaatacgacgcgtatggtagatcagaagcttttactgatctagaaggatcgaattttactcgcaatggcgggtttatcttgaatagagatttcattcgcgcgtgtttttaatgcgcctgtatgatctttgaaaaatcagagaaacacccgtaatcgaacattattggttagtttagtggaatgaatatgggatacgcgtattcgtgtgcgtagtatacgcagttactcaagtttagattaatctcatcaaactagaagcttttttgatctttccttcttctttgaactccctaagtccacctctaatttggtactcgcgaccgggtaaccaacacaatctttttcttcaagttttcaacatcaactaccacttaaaccccaatataatagtcatgaatgctgtaaggggcttttcaagagtccgcaatttctcccagttgagaccacttctcaacgcagagtcccatgttaaatttctatcaaactattattccaaagatattcttgaaagtatcaaactagctgaatctgtggttgaaccagagcattataagggcaagaagcttcccaacattgaatttgctcctcactatttagacgattactcgtcatatgatccgttctgggattacagtaccactaaacaaactgattttgaacaagcacaacaaccaattcctagagatatcccagaaggttattcactgcctacaggttctaacagtaaccctacacagcttttggcaaagggattggctaaactgactggtttggaccctgaatacatcaccaaattgactgtaagacctcttgtactgaaaacagtcaccaatcaaacagcaaagggtaagattagatctttctactctttagtcgttgtcggtgataagaatggtatggtaggaataggtgaaggaaaagattctgcagaaatgtctaaatccattagaaaggcacattggaacgccgtcaagaacttaacacatatccctcgttttgaagacagaaccatctacaacgatgtggaacacaagtacggtgcaaccttggtgaagctaagagccgccccatcaggttcagggctaagggttaaccacaacatctttgaaatttgtgagtgtgctggtattaaagatttggctggaaaagtatacagatcaagaaatagcatgaacgttgccaaatgtgccattgaagccctacaaaggcaagtaactttggaagagcttgctgctcagagaggtaaaaagattgtcgatttgagaaagatatattactccagttaaagctgtcgtttcacacatgttcgatcttgtatatataaataggtctatatatcaactatggcaatcacaaatttctcatcatcatttagatttatgtttcttctgggtggcttcagctaccaatcgctcaaaaattcttgcttcttcagtttctccttcagatcgtttggcattgctgaagatttcgcccataataatcatggcctgagctctctgcagacgtttctccaatgtgatgttttcgtcataaagtactaaatcacagacacttcttattgtactggaaatttcaaactgcgaacctttccaagcagctgctaagatcttccctattagcagctgttccatttctgccaattcttcgtcggtaggtacgggtatgtcatcaaatttacccttcttagaagtctctttcttttctttcgaactatccccgtcttgagcttcatcgtctacagaggtaccggtggcattctcattattagcattatcaccatagttaggcttagtagtttcggattcctcttcactttcttcatcttgccattcttcacctcgagataaagcctcagctttccgcctctctctttccacctttctctccttctttctatcagcagcttcttcatctctccgtgcttgctctttcttttcttgcatctttgtgaccagttccatatgagcttgagcttccatagcggtagaaacagttctaaacgtgtccatcacaacctcacctttttctttcatggatgaccaaaaacctgaaatacctagaaacttctgtttcttcagtagagtcttggccttgctaaggtatatgtttcctattgtatgcaaaatctccaatccaaaagattctacagttaatagttcaacctcgtattgtaacttatgcttgaaagatttggtaatatcctcagctttgtctgtctctgtccataaagatagcttttgtaccagcttctcagccagttgcttttgcattgcttctctcttcaccctggcttcttcctccagtttctccatttcctctttcttcttcttctccagttctttctctcttttcttaagctcaatcctcttatcctcgtcagacaaaccaagaaaatcagcatcatttatggtcaaggtgactccttcttccttatgttcttccatttcttgggccttggttagatcctgtaacagagagagttctccaatataatcagagaatgcagagcctccaaatataccagcaaaaaattcacttggatcatcaaaaccttctttgggaatcgcatcctcctttccatacctgtcgtatcgctctctcaggctcttgtcacttagcacttggtatgcttctccaatctctttaaactgttcggcagccttaggatttcctggattcttgtcaggatggtgttggatagctttcttcctgtaagctttcttaatctctaactcagttgaggtaacagagatgcccaggacatcgtaataagtactgtctacaaccatgatagtgaatgtgaagggattggtgcctgtacaattttattttaacccaaagaggcgcgaacgcttaagcgtatcgatagacttcttttcgagcggttgcttagtaggaatatactcacgagactaattgacagtaggctagggatcataatgtagctccttcttgatctacttacaaacaatcatattgccagtctgagtttcaagcagatagttttggatcctgaaggtcgtggatttcaagaagggatggatcagttgtttcatcgccttgctatatagactatttaccccagatttgccaaccaatctcatgcccaaatttcaactggaagagtctctcaatgctcttgtagtgttcacagctattcttttttgcttttcttattcaaaaccgtttttcaaattaaagaaaaggagcctctgggctaccatttcttgaccaaagacttcaggaaggatgcaatatcaattgactactcatcattcttaacttaactttgtaaaagaacaaatagtagctagcaatgcgacttgaccggcgttaggtctaatccatcagtccacaatacaaatacgcattactatcaaagtttacatttgacatgcaattgacatgctcaaagacacctaagttcgatcaactatagtaataatatacaccttgcgaggagctttaaacgcacttgtttgttttgccagtagtttggtaaaagctctcctaaatagaagaaagaggtatagtagagtaaggaaaaaatgacaatgaaagctcaaaaatgtcttttcaaactgtttgtggttgataaatttcaagaccatgacaatcaaccaatccttttcctgcatcacataattcaatatttcgaacccatccacttctccaaatattttcaatttttattctcgtctttgggtctggattgagaatattgtacaaaacatactttctgttgttgaaagaggtactctttttggcaaactcctcaatttgaggaaaagtaccatttcttatcttctttggtaaagttggattggtttcggatctctttgtgtaatcataaattgctctattctttaaatagtcagcgtatctttcgtctgattctttggcaattccccagcagtagccaccagtggccattgctagatatattattcccagggaccagatatcacaatatctggggtcatattcttgatcagtatattcttcaggtgcgacatacggctcagaaccacaggccccatgagataattgtacctcatcattccactcagcttttaccaccgtcgcagtaccaaaatcaataatttttaactgtccgtaagctgttagcaatagattctccactttaagatcgttgtgagcaattccaacagagtgtatataagtgagagcattgagtatctgtttgaaaaaacaatctgcttctattattggaagaccctcaccattggtagataaaatatatgagtagagatcaccacaaggaatgaactccatgacttgagagtaggtcagtgactgaggatcaaccattagatcataggtatttataatagcttcatgggttagagacgaagagatcatgaactcagaggtaactcttttaccaaaatgctcatctgtttcatctggcctcttctttagttgtttaacagcaaaaattagattgggcttcttagggtcagcagaggagcgcatacacagtttaactgtaccgtaggaacctttaccaatcagtccttgaatccgaccatacttttcgtacagtttctgctttccatcggattgttcaatcagattcgcttgtagtgaagcaggatgagatatcctttccacaagtttttgaatggtgtttgataatgcagttgtaataatagggtcgatttcctcgtcctcggatgaagacgacgaaggggctgcgctggatgaatcagattcattttcgtcatcctctatcaactcctcgtaattccaaatatagttttcgggaattgacttgagttcaatcaaccgcttggaatattcgtctggtagaagacttattgaattctctacacatgcatcggtagacgatgcttcacctttcttagcgccccctagcatggtaaaaaatccgacattcaacgatttggtgggaagtttctttaatttaatgaaatcatgcttatgtttggacccatctagaaaggtgatcagcgaaccctccttcttgaaattcttattgcccacatttactggcttatgatctagagcagccagacttacacttagagacgatcttcgtgaagtggatggcgaatgaattagggaaggcgacctagaccttacagctgagtgatcccagtcagagtcgctctcccttgaaaaaatacgtgataaacgtctgcggccacggtgctgaggctggctggttgttgaggagttggattcactacgaatcataggtggtgttttgcggcctggatccaacttcaactcttcaacagtgtccattatttcatctaagtcattttcaacaatcgtttgaggtacgggaagttttaacttagtacgagggtcagtttcaggtgaatgcactttcaagtctggggagcccaaaggtgagacttggtcatctgatttcgtctctaaagtggaaagactatgcctaccaccattcactgaaccaactgatgaattccttttcagtgaggcggggacccttgatgtaacagatgtgtgatatgatgcaggtggagatgcagataaaggagctaattggggggttgatttatctgcagctggtaaggaatgaactgacgaagtggaagagctgcgaaacagccctttaagctttgaggtgacggaggttgaatgttttcttgtgataggggggaccactgttagcggatcaactgaagagttagacaccactgaattgagagaggcaacatcatcaggttcaggacttggcagaggtgacttagcggacagaaagttcgaagaatcagctggtgcttcagaagaccgaaaaatgaaaggcatcttagagcagtatctgcgctatattattgaaattaaggtaaagaaaagggaatgtgaccccaaaattggtatttagtcggaggacgagaagatttggaatgctataagagaaaatacaactggtgtagcttgtaatcatagagaccgcatttcgcgaagatacaaaaaaaaaaaacttatgtgccctccctaaagagggtgctgctctaccccgaacgagctataatgactgccctccccaacagatagaccctctagttgtgctgtcacctcatcgaggtctacacgcaaccagctttccataaattttccaatatcagtattatcatggtttccgcgcaggtatttgtcgattcttttttgtaaggcgggggtgtttccatgtgcatagatgttcacgtctacggctgaatggccatgggtcgaaaaccccacttgtgcccttttcgaaattatttttgacagaacatccagagatttatggcgagcctttttaatagcttggatctcttcaggagtggcgtcatagattcccattccatcttggaggatgtcctcttcgataaatgagagaagatcagtttctttgtaattgctcaattttgcggcaaggtactcactagaatgtgtcacatttagcagtacttccggaaaccacgcataatcaggataattcggggtgacttgtttggctgcggatagaccccctgtctcatgatccgacacggagataatcaatgtctccaccgatgaatcgtcagcaaattctacggctgcttggaatgcttcatcgaatgctaatacttcttgcacttgcgcagcggcatcattgtaatgacccgcgtggtcaattctagatccttcaatcaaaacaaaaaaaccttgatcatcctttttagtggctttgtcgagaatatccaggactttatgtgtttgttctccgattgacggatgttcagatgcattacggtcgatctcaaacggaaagtttccttcggccaacaataccatcagtggtagatctacgggtgcattgttctctcccagggcatcaaatgcggttttgttctcgagtaggttccaaccgctgtgtttagcagttttcaataggttctcaccatcgtatctgcagcccccatctttcctaccataaaagaaacaacggccaccaccaaccataagatccaatgacctccccaagggatagtctcccaataggtgctttgtaatcaagtcagcattccaacgagtaaccgaatgcgaggcaaatgcagctggtgtagcgtccgaaacgtaagtagtaacgctaataccagtcttgaacccttgtagtttagcggcttccagcactgttcccagaggcttcgaatcgtagtccacggctaccatgttatttccagtcttacttctgcagctaaaggctgttgcgccggcggcactgtctgtaacccaggaatcaaaggagcgcgttctggaagagcccacgagatacgtgtcaatgaatagttgttcgtcccatgaaagatcatacttgaactgtttaaagtcacgggctacagtaacagatgctggacccattccatcagtgaccataaagattacattcttttttgtgggggttaattttgacgccgtgccatggtagatgtaaacgtaagaaaagataccaatccaagctaatgttaatgagatatactttataattctcctccaattggctggctttctgctatcattgggatttggcagtagaggctcagagtccattgctttgaaattgaaggggagaggacgctaaaacaaatatcacatatcaatgcagattgcgcgagatcctgaaaggggcatagatttgtgcgtagttccgtgaagaatgtccacttagcgagatgtgagccagaaggagaacatctccttccagactctaccatcgcgattgaattttttttttcacttggtttaatctttcctacaactattagggtgtctctgaaatgaaaagaatatccaaggagtttatatcagagtccgatattagctccgacaactctgaaagcagtgattcagaggatttcacttttgaaccacctgctaatttcaaacagcgcacagacctcaaagaaatatctccgttcaaggatttgggaaagaaagaagtatggctgttgaaaactcccaaagatttggatttaagcacattgaaaactcttcccatgcccattaaggacaaaacggctcatagttttaagcacgaaggtaagaaataccaagtcagggaagactctctcgatcaggacaccaagaacgacataagcaagtataagatcctagacgtcaagtctcttgacgagttaaaacctgccaaagtgaagatttccaaatttttaacggttggagagaaagtatctattcctaaaattgatctcgataaggtatgtataccccgtcaaaacgttcctcaggaagagaacctggaacaaaagcattttgcgactggttatggtaagtcatgacctttcaaatacacattccttagagagaacattgcatgcaagctacagaccatctgaagaggaacttcttttgtacagtaccatatagtccagtgaataaaacctatccactacttatcaaaagacacccgtacatcacctagaatgggtgcgttccttcaaaaatttcatgagttcctcttctcctttctaaataaaccgcacacttttttgggatgattatatcagcgtcaacatgtgctatacttatacctggagaagtgtgctagaataatatccagctttaaaaccatcgctgttggaggtcccgctgtttaggcaggcccggtgacccatgaaatagtgatgacctaaagtttggtacatttatgtatttgtagtgaacttctaggaaacggcacgcttactagctgctgcatattccacctatttcgtcctaccttctaatttagtccttagttcactgttccacagggttaagttggcacagctcttaattggttggtgcagttcctccctggttcaaagatgatctaaaactctcactatcttgcatcgtaactaattaaccatcatgactaaagagattaagacggagattctcataaatgcgtcacccgaaaaagtatggggggtattaacagactttgaggcatacccaagttggaacccctttatcaaatcgttgacaggtgacgtagcggtgggaaataccattagcgtgagaatccagccccctaacggtagcggaatgacattctctcccaaagtcttacactttgaaaagaacaagaagttccagtggaaaggcaaattgctgtttgaaggcctttttgatggggagcacgtttttgagctgatagacaacggtgatggcaccacattattcaagcaatcggaaactttcaacggtatttttgtttatctattcaacactaaaaacacaacatccggttttgagaaaatgaaccaaaaactcaaggagttagccgagaaaccataatcaaattgtcatctgcaaatgtacgatttaggcgaaagagttcatatactgacggcattaattccgttacgctccgcctgttggtagaggattgaatttatagcaccctattggattagatgttttcgttaaacgttttaaatacattacctgagttttatggcaggattttgaagagttgaaggtgaaagagagtaggaggttgtgaatttattctggaagcctgacatcctaatttgtgtttgactttctcgggatacaagttgcatctttggagctgtatattaagcattcatgtaagacaattttgttcccttattccccttaattttttcctttttgttgtagactcaagttttgcattgtttgacatagctatgcgaattgcacagtaaagttataaaatactgatgatggcgtcctttaagcgatgatagttgtatcttgaaccaacagtaacgaaaggatatagtcgactcattccatgagttcttaatccttcaccatcaagtatcttatcagatcaaaaagattgttatttcaacctttttcccgtaagatactctctttcatcaaattgttgagtcaaaaagattccaaaagtgcccactaagaagtttattggagctgcaggaaaactcacagccttttatatcaggccaatcaaccatcttatccattacacgtccatatccggcataaactagccttcgcttccctaagctgactcttcgttacatgcttcttacctgttcctaaatgattatgtaatctttgtagacgatcagaaaaaaaaaacacacctaacgtctcactccaccaccttaggactactgcaatgttctctcttagaagaaatatttcaaatctaataaaggtctctggaagacaaacagctttgattagaccagcaaagtttgctcttttgaagcctttgccagtagcattcagaaattatgcgactgaaaaaaaagacgaaaagtttcagtccattttgaacgatgatttgttagctcaagcaggggtggacttggatgctgaaaactccaagtctcaagaaaaaaagccaagctctgactcggaaattcattactctaaacctaagggcagaaagaacatttcatctattgaccaaaggagagaacaaagagcaaagtacgcctattttgcaacttatctagctttgttgggaggagtcgtctacatggctagagactgggatgaaaccgagcctcagtacaaggctgaggagaatggatacactcccctattaatgtggaaccgtttttacgctcgtttcaacgaattgtcgaactttttcaccgagcctgcctttgacgatcttcttcccccacctcctcctgagccttacagaagacctctaactttagtattgactttggacgatttgttgattcattcagactggaacccaaagactggttggaaaacggccaagagaccaggtttggactactttttgtgctacttgtcccaatactacgaaattgtttgttttagttcaacttctaacagcaatctgattattgagaaaatcgacccttacagagcatacttctcctatgatcttcccagagaggctggtcgtataaaggatggaaaattgatcaaagatctctctttgttaaacagagacttgggaaagactgtcattattgatgtcgatccagactgctattctctgcaacccgagaacgccatccctatggaaaaatgggatggtaagcgtgatgacaagttggttcgccttatcccattcttggagtatctggctactcaaccaattaaagatgtcagaccagttctgagctcatatggtgacaagaaagatattcccgaagagtttgcccgtagagaagccgttttgaggaaaaaatgggacgaagattgggagcaaaagaacaaacatttaaatgctaacaacctagctgctaaactattgggcgctccctctgtaaacgccaaaccaaaaatgcctttagatattatcagagaggctgggcaacaacaatatcttcaaactgtgaaattcatcaaggaacacggtgaaaaggctttagaagagaacaacaagttgatggctcaacagaagtttaccttggagaaaattgttactgagggtttacctaagccggaagacattgctaggcaacaacaggaattacaacaacaacaacaacaacaacagtaattctaccgccttcaatagattatttgtaaataggagttcgattttctttttgtctattgcttatattattggcgtaatagctccagctagtgataccatttagtacttccattagtaatatgggtggaatttcagcctcatgcggcgtatctagagtaccatgcaagcgaaaaagtgagacaagatttgtatatataaacatccaccatacgctgtccaaacttatcttggagcaattggttcactgacagagaaattctttgagatggcacacattgtagttataggcggaggcccgtatggaggcactgtggccaacaggttacagaaaactggtgcaaaaattactctcatttccagatctgaaaaggctttattgttaccagccatgataaggctgccatttcacaaagacccatcaagggtttcagttgaactaaaggatattctgaacccaaacattgaattgatgattgaccaagtcgttaatgttgatgaaagccaagtcgacctgggagctcatgatccagtttcatttgatcgtctggtaattgcaactggtgccgtttgggatgacccaatcgctcctcacaagtaccaacagaatgggatccaggaatatgccaaagaggtcgctggccttggggaaaaagctaacaatattgtactcgtaggtggtggtgctttgggcgtggaacttgccggagagtatgcttatcactttccaaaaaagtctataactctgatccattccgagaaaaaactacttgatgcatctgccattgataaagttcgtgatagcgttgagtcgcaacttcgtggcctcaaagtgaagttgattttgggaaagaaagccgaaatacgggggcaatctgtctttgtagatggcgaagaagttccatgcgattacttgatcaagacaacaggccctaaggcaaatcctccagtatcttctattaaaggtttggttaatgaaaagaatgaaatcatcatcagctcaaagtttcaggctgaatgcaaccctaagatttatgcaattggcgatgtcacaaactatcctaaaagaggactagtttcacgtgaaaattggctatcgatcataactcacaatttgaacgaagatataaaaggcacatcgaactaccgcactgttgattggcccaagcagggagtcaagtccaagtcgacatttgctgttagtgttggaccagaaggtggagccggacagtatattcttccgtttggatgtgctttcagtcttccacgatttgcggtcgtaaaagcaaagtcctcaacactcttttactctaaattgaattcaatgtttatttgaaaaggaagaatagctgttattgttatctatttaatgtatctaacatgctttggacctcccgaaatgcaaaagctagctattctagtcgtcggtatttctctactggaattctggcgatagtttctttaatgaacaaaactgaaaagagtggaatattattcgggcttgagttcaacccatccctagccccttaactccctagttcttactcaaccccttcggctttatgctcgggtttcactcgggatccagaaaaacgaaaccaatggtcttatttataaattacagtggacacatttgagacctttcttgcggtttaggataaaccccttagggcataccatactgtatagttgatgtttcaaattgttatcgtgggaagcggtttttacggcatcgcgttggccaatcgactgcaaaagctcaatgccaacataacgcttattgccaattcggaacgtactatattcttgccttcaactattcgattgcccttcaacaaagatgcttccagagttgaggtgcttgtcaaagacgtgctaaattccaatgtagagttgattgttgaccaggtcctcaatattgatgaggagaggatcgagttaaaatccaatcattcaattgcatacgaccggctggtaattgcaacaggcgctgaatgggatgacccaatttgtcccgacaagttccttcaatacggtattgaaacttacgctaacgaactatctgcaaagattgaaaaagctcgaaacatagtaattgtcggtggtggcatcgttggagtcgaagtggcaggagaaattgcttaccactgtccaaagaaaacggtaacgctgatccactctagggacaaaatcttaaacggagaagtgattgaaaaagcccgtgacagtgtccagtctcaacttctcaacctcggtgtcaaactaatcctgggaaaaaaggcagaaatcaaaggtgattctgtctctattgatggttcacagataccctgtgatcatttgattaaagctacgggtccaagggcaaatccgccaccctcctctatcaagggtttgctcaacgaacaaagggaaatcgtcatcagtgcgacattccaaacagtttcaacccccaaaatctatgctattggggatgtcacaaattaccccgagagaggattggtttcccgtcactcctggttggcaactatttgccacaacttgcaggaagacgtaaatggcacatcgaactaccgctctatcaagtggcataaacgtaatttcaaagcaaatgtagggataagtgttggacctgaaggaggagcaggtcaaatcgttttgccatttggaatctgcatcaacgctcctaaattcctgatcgtcaaaagcaaatcagctactcttttctgtggcaggttcaagtcattgtactcttattactaggattgaactcttgataattaatctagtatgaagtattaaaaaataaaacctcgaaaactactacatcgaaccttcacctgttctcttcccaatcgtatgttccatttggccaaaggattatatcaaaattggaatagaaaagagcgtaagtaaatctgcattttgcatcacaatcagtactatattaacacgtctagaatattctgttcttattctaggtttggataatgccgggaagaccacattcttggaacgtgtcaagtccatctacatgcccaatgcgaaaataacaccaccagaacgaatactgcctaccgtgggacagaatgtaggcatcatcaactttagctccaaagtgaatctcaaattctgggacgttggcggacaagaatctttgagagaaatgtggtccgagtattacacaaattctcatgcgattatttttgtgattgattctacagataaagacaggctgctggactgccagaaagctctaagcagtattgttacagatgacctaattgagggcataccgattcttatgcttgccaataaacaggacgttgaaggtgccccaggaaagttggaagttgaggatattaaagagatattcaacgttatcgcggaacatctagatgccagagatagcagggtgctcccaataagtgccaagacaggagatggggttcaacaatctatagaatggttgactttaagattggaaaggaacaagagtaataagcctcccatctataggtagtatacgtcatttggtgtacgttcgcttcttctgccgccccagttaccatatttagcagttcctctgctccatatatccaaatcattttcaccaggattacaactcacctccctaatgacccttactacgaaacacataattgaaacgttgcagaaatttactccatgcgacgtcagtgatgccctagtcaagtttggatacaagaatggtggatattttcccaacttagttaggcaatctcagggcaagtcatcgagcccaaacaccgtagtgggaaaagcgtacacagtgctttttgccccttacgacgaccctaatcctcaaattggcggaggatacattgactccttgcctgaagattctgtgctggtaattgccaccaccccagcattacagcttcctcaagccccttacaccaaagtgaataatgcattatatggtggattgatgtctactagagcccagtacttgaagagcaaagggactgtggtatttggaagaattcgtgatctggctgaacatcgtcaattggaacatccggtattttcctatggtgttggctcgactgctcataagccagttgttaagattattggaattaacataccagtggatgtgctagtggaaggttaccccgaggcggagtttcagacaatcaatcctggtgatatagtggttgcagatgaaaacggagttgttcgaattccgcaggaagaaaagttattggcaaaagtccttgattttatccctagaagggtttccgccgacgagttagtagctcaagacattaaggagggaaaacctgccgctgaaagccagaaacttcgtagaagtgcagtctaaaatgactatttacggtaagtaatatcaagtaataattactaagagaatgacatgattatctgacgccagtattatcctttctggaagacctatatggactcatcgccccttatcatttgaaatcttctcataatttttacatcaacgtcaaacggccgataattcgctgccacctaccttgctcagccatacattgtatttatatttttcttctggttgaacccttaccttctcctgcattcgttaagtcatgtcaactcctgaagagcaagaaaaattggtgagccagttcgtagagcaactttctgaaatcgttgaagaggccgaatatgatgaactatggggtaatcagttagaccccaaaggctcattttacaaagagagcattgctaagaaactagcaactaaatttctcagggctaatagatgggacttggagttggctaaaaagcaactgacaaacactctgatttggaggaaagagtttaatccgttgagtgccgggttccgtgaaaaacatgatgaaaaatttgacatcctcggagtaatcacttatcattcggagcaacctgttcccaacattaagctgatcaattggaacttgtatgggaatgtgaaggatcctaagagcattttcgaagatctgccaactttcatgagatggagagtgggattgatggagcaggcacttcagatgcttagtttcgacgacgatactaatgagtatatggttcaaattcatgattacaaaaacgttgcatttcttaagttggatccttctgtcaagaaaggctctaaatctgtcattgagatattcaccagttactatcctgaagtaatgtctagaaaatattttgtcaatgtgccccttatactgtcttgggtatatacattggtgaagacatttgtccctaaagagaccagcagaaagtttcaagttctttccaatagcaaagatattgcgtcttcactgggtgatctggttccaacagagtatggaggaaaggggaataaactagaggatcaaagattcaacttcaacaaatcaggtcgggaagctgtcctcagtgagtatgctgcttacttattacagaagcagttcaccgaggaactagattagaaagtactcacgattacactgtacctagtagttagataatggtctacttatagtaataattaatctggtttgatggtatctgccatcctcatatcccaatcttaatttcgtaaaaacccaaacattaaaaataaacactcgctcatctcagtagttctttttccttcctccacagcctaatgtgaataagcccgatatagagattcaaagaagatgtcaacacactaccagttgctaggcgtcccaatggatgcgaatctggctcagatcaagaaggcctatcggaagttggcacttgaacttcatccagataaaaataatagtgatgaggctttagagatgttcaagcgggttagcgatggttaccaggttctatccgatgcagaattgagacgggaatatgataaaagcttacaaaagacaacagttaatgtcaatccattcaatagcacttcgatgttttatcataattttacccaggccagaaatcaacggcagaacggtaatcctgcttccacctattacgatccgtatgaacgatattttcaaagaaacaacccaactccagattttccttttgccagaaagacgaggagtagcactcacgctgataacgataatccatcgtcaaataaggagaacattaggaaagcgaaacactccgaacaagctaaatcttttagccacaggacaccaccaagagaggagcctgagattatcgatctatcggtagatgaagatgcctataatataaacacagaacaaccagaacgtagaagcgaaacaccggaaagtaacaaaccaaaagtgtcaaataatgtcaaacaggaattctttgccaagcccaacaatactaataacgaatcaacagaggattctgaatttacgaggaggtccaaagaagagcctgaagatactactccacgaagaaagtcgacgcatgacttctaccagggaactaaagatgatcctatatacgtagaaactaaacaacagcagccgcaagaattcactttttcagacatcctcaatgttttcaaatcttcactacataatgacaattccagctctacaaagactccgtcatcatcaccaatgggcaaaaactatagtaaaaggccgactaggggtcactatgaaaaggctaaaactcctggtagtaagatatcgaggactcaacttgaagaagaaatttcatttgagcatccccatccttcaaaaacttccaaatttgacaaatttaatatgcataccttgaatgctgagctgaatagtaatgatacttcaatgcggtcagattttgagtcgaatgaagatttctcacatatgcaaatggatgatttagatgagaaacttgaagaaatccaagtcccatcccctaaaagaaaggctaaaaatcccaaacaatttggaaatctagatctcttagatttacatgcatcaccccgtatttttgattttcagtgccctagtcctgttcagatacccaagaggcctcagaacatatactcaattgatgagtggacgcttgtagagaaacaaattcaagattatctacaaaaatttgcctcgtggacatctataatgcttcaatataagcatgagagaacgatagcaaacttagagcactttgataagattgttggtaatgcacataatagcgccgttttccaggatgcgatgcaacgtgatttagaaatggagaaaatctggcttaaaggtcaagctgaaaacacaaagtttgtcagagaatacaaccagatcaagagtgatctaaagattcgtcatatataaaattcttatttacttctaatttttataaacctatctagtatatttaatgtcttttcgagttgatcttcttaccctcgcagcaatgggggagtcatcagcactcaatactgaagactcctttaaaatgtcgtcatagccttcaaattgaagactctcaataactttcagggtctttttgatgtcgggtacctccacgccacttaaaaggatgttacttactaattcaagaattaacatgaacaaactggacaaaattgctaggcaataattggaaattgtcaccccaatgtccaaccaacttccctctgttttgactaagaagaagaaattcagagacaaaatatcacttatggaaatgattagagtcgagatagcaaatggtgctacctccagtttatgtgtcataattcctagaccggttgagagcaaaacgtaaggaataattagctttaccatcaataaagctcccatagggaatgggtcaaatattggtaaaagtcgatacaccgagtcaagagaaaaggatgaaattgaaaccacatttccggtaccaaagaacgcaacttgaaggaagaagaaaccaatgactgcaagccgtagaagttgaatccactggttgtgagactcattatgatctgcaccatgcttggaatagatctcttctttcaaaaatcctgcctcaatttcgatccattgaactatagtaagggagaaaagagcataaaagaaagactcaaacgaaatcgtcaggatgataaaagttggtgcaaacactagaaaaataatcaaacaacgcagtctgtaatctttatttggtcttagatgatgtaacagaggaaatccaatcagagtgaaaattaagttagcccatccaattacttggcaatctcttgggagtccttctctggattgtaatgataagacagctttttgagttgtatacaacgccaacactaccgatcctatttgcaatagaacaatagccttggtgaacgtatcctttaacgctgttgaagttttcaaaatgtaaacgaatccactaattgatagaaccaaaataaggattccaccagacaaaatttgcctcaaactttcaactttgaccgcatcaaatagggtaaacgatgacatgcaaatgcaggttatggtccatgctaacaaacgtccaacagatattgggccaactatagccggataaagtcccagaacgacaaagatcactgaaaatatttgtctgttgaagtatccatatgtaatacattcgaaaacgacaacaataaagccaatgatgagtgttactttataggctgggattcccttaaagaatctcaataatccatgaaacagaacagtgtgccgagcataaatttcataccagaaaaaaatggggaagccaccatatagataatacatgagaggagacttctggtagaataataagtagttaagagatacagtaatacctccaaaaaatgctatgcttaaaaagttgtgctccacggtatgatccctcttaacaacaaacaaactcaagaacacaataaatgagtaagcaatccatccgatgaagcccaaagtcacaatggatcgaagtaacaaccaattgtatttctgtaagtatgaaagcccctccaaggccaacgatgaaagattcttgataagatcaattgcaattttttcccctttttcgtcataatcttttgctagttgtgagagaagatcctcaattcgtctcttgtgatcttcaattgagacctgttgaaatgactcaaacggcttaaatgtaaactgactttgagagacttccaattgtttaacgagatactgttcaactattgtcaaagaattagcatatagcccctttaatttattcaagggatcatcatcaataaactccaacggcaattcacctacagagtttgctgcataaggagatcctatcaaatagctcattaatgtcgaaatatcagcttggttaacatcgtgtctcttcacatacggaagatcccattcattcatgtatccttctggatcttcattgggtgtatcaagaaattcaggtttcttgataccagcgccccaacaaattaaaggagttctagtgttatcaggatgtccatcaccatgtgaaccaaaatcagacatcccatggtctgcagtaaagatgaaagcagtatcattatctccaaaaaacttgtttattttaggtaccagtttctcgagttgtttgtcagtgtttataatgttatcataatattccgcagagtaaggtctataggcatggccggcagtatcggttcctaataagtgcagaaaaaaaatgtttccatcttgacgtatctgtttgtccaacgccgaatctaaggttgaattatgaaataactgatacacatgattgaaaacaaaagtatccaattcgatagaactttgagtaaaatcttcaaactcatggccatacatccaagtgtcaactttgtctcgttccgaagccccatctgcaaacattggcaaaatatcaggagatccaaaactataagtgtgcacagattgattgaaagcggaatcaaaatcaacaggattttctttccatccttttgtaacggcagagacatcttcatagaaccctgcaatcagagccacatggcctggtcgtgactcagtaggcattctggtatgcgaaattccgtacgttccttcatttaatacaattgatcgcaaatatggagatagatagtcatattcttcagtagctgggtgtttgatcttgccgaatgtcttatcagcacgctgcccatcccccactatcagcaccaaccgttttgcgggggggtgatcacaggacttgtgagtgctcattccatgaaccagaggacttacaaagtaaatgtcaaaaatggaccataagtataccaggtggaatagcactcctacaattaggagagcaaatctggtacggttcattcttggttggttcgaagaacacgtagtatttgcaaacgtaatgatgttttgacaaacgcgagatttatgaatatttagattaagtaagcaataacgagcgtgagatctctgtctagtaataatgtatgtacaagaaaaatgattaagccctgaaagatggaggggggagcgctgaggaggaagggatggcattctaagcagaaatgtgctgtttggaagtcttgtttactcaaatgcttgaagtgccctttccaatttgacagccatttcctcatattcaccatctgcagtactgagaacagtgatagcacctccagctccaattctccagcaattagtggattcagtgtttttgttgtcatttggataatgaaaggtcgacctgatcaccacagaccagtcactgtggttatttacagaccaataaccacagactccggagtataaaccacgtggctggttattttccaatcgttgtagtagttcaacagaccgtttcttgggagcaccagtcattgaaccaggtggtaaagattgtgaaaggatatcaattccagaatatgtagaccccttgaaggatcctcggatcacgctaacgagctgaagaatgttttcgtactgctcaattaccatcaattcaggaactgcaacttccgatagaaagttgtaaagatcatgtctgatgaggtcaacaatcatcaggttctcagctttctccttgctagatttcaaaatctcacatccctgtttatatgttagagagtctgaaagctttacggttcccttgattgggcgtagctcaactttctcgttatcccactccaaaaatctttcaggtgaggaagaaatcaatacgcaatcatcaaacttcagataagcagaatatggagcaggatttctcttagtaagaaccttataaacctgccagggtgtaatctccctatcaaggtgaataaaggtctgatctgtgagacacaactcgtatgaatcaccttgctttaagtaagtctggcattgatcaaacttggaatcatagctctcttgtgttggtttgacaatcgttagattattcgtcagatctttcaaagaatttgggacattgctcattgcatcgtggctcacatgtaatcgatctaacgattcattgagccagttatcatcgccagctttaatggaacaaatgaaatatgtaccggaattattctgtttcaaaataaatctttcaataaaacataacttggaagtcgggatatcctttccaatggattccaaagtctggaagttaataaattcaccttcctcatatgaaagaacgcccaacattccgcctacaaatgggacttcgatgccatcaatagtattttgcgggaagtatctctctttcataaatgcagccaattctttccagaaagagtcgatactttccttttctttcttttcctctttccaattgtgcgtgtaaagaacgttttgatcttcagttcggacatgggtaaatactttagactcgtaattaattggaagaccaataattgaccatgttcccggagaggatacactgttgagtaaaagagagtcttggttatagcgttgaaaaatctctacaatatctatcgggtttaaggcagattcaagtcgcttaaattgaagttcagtggatttggaaatgttcaacctgttaaatagtggttcatgcaaaattgtgtgtggatcatgaagctcaacatccgttgtcggtctcatacttttgacaattcgataaaagtttttgattagagtagagcccatttcagaacagatagattcaggatggtactgtacaccatagaagggaaatttatggtgttttgcagccattattacctttgagtctacctcatcttcgtccacagtaaatgccaatggtatcagtttgtctgtaaagtttctaacatggatggagtggtaacgaacgcctgcaaaattatcgcaaccttcaaacaaaccaaaatcatcattttccttgttgacctggattttgtatacttggccatgtttgacgtctttcagatactcaacatcagcgccgaattggtagcatagcacctgaaatcccaagcaaatgcccagaatggggatatgagccgagttggcaaaaacaaatggaattatcccaacgtcctcactatacgtggggtttcctgggcctgggcctataaatatgcaagagaattgattcagaaaaggcacaagtctagattcgtattcgtcgggcttgaatgaatcattgtgtatggcgacgcatttctcttctgttgcttgctcaatcagacttttcaaattgaaagtgaacgagtcataacaatctattaagagtatagtcatgggattcaaccgaccaattacttctctagagaaagttgccttgcttagggtgcaaggaaaaaaatgaaagtggcaggaaatgggtaagtgagggattcgttagatcagacatccaatccgcaaatcaggaattcaagatacaagttttaatattaaaatgctttataacactagaaataaaataatattccaaatccgtttgatctatatacaatcactgtgctcaaaacttttcagccaagagtttagtcacagcttccacatggttacctttgattatcaccttctgactttgaatcacacacttgtagtcattcttattagtctggcctttcagagcctcctgcaagtcgtttcgtaaagacgtcaggtctccgcttaccctgcgaatctctgtgtaagggacctttctcttgtaatccttgtatacaggcaaatttcctttagacgtccttgggacgaaatatgtcttgctcagccctcctacttggtgatatcctaaaaggtctttgtagttaatagttttgatgtctccaaacaccgatgatttgaatcgtcggaatgacagcatgttgaggaatgagggagatgtatattttgtggttcggttggtgacgaataaatgttcaagtttttcatatcagggactttcgagaggagaatctctcccgcgaccgcctggtaacgtttgtcgctacctcctactaagaacaagcaagcaggtactaaatacaccccttcgcaggaaggaaaacaaactgggaaaaaaaagataaaaccttatctttacaaacggtttcttcccgttctttgacgtctgcatttacactatctgcgggacatatggaaccagaagcgcttgtgggtgatttacaaggccacttgcttgaagactttcttaatgagaggtttcctgaaagaaacgacatagaaccatttgttcacgatgttgagatccagggatctttaatagctcaggcgaaagatctctaccgaggcaaattctcttcggttggttaccacgagtatttaagctatatgtcagacactgaaaaggatccgttgagatctgcttcactacgattccattatatgaatttattccactgggatgagaataatcttttaaattcactacggttattgtgccatcgattgtacttcaggggagagtctcagaagattgacacactgattgacgattttgcatactcctggtcaatgaatagcggcggaaagaacgtgtttggcacctctagtggcgtttatctcgtggcctattcgttagtgttacttaataccgatctccatgagactgaccagtcgcaaagttctgcttcaaaaatatctagagccaattatgtcaaaaatacaacggaggcattaatctcaaacaacgtgcctattagttctttcccaaagttggaactagagttaaaaaggatgtatctagaactttcaagttttgctcttcagttgaatggcggtagtgataacagttttgacgactctgattttcttcagcagcttcagctaaaagccctgaatgcttccaagagaaattccataatgtcattcagtttcaaagataaatcactcacaaatgcaacttcacagtcaaatttttctactatgtcatctttttcctccagtatagtaccaaatggtaacagacacagcaccccgataggatttaccaacgctctaagaactgaaaagcagattagacgagtaaactcgcgggcttccaacttatcgaatcaaactaatagtacttcaagaactgcgagttccgtacgatcttcgatgacgtttttcaataaccccagacatcaactcttcaagtttgaatcaaatgctttatcacaagacgatgactcttcaattttaaatgatagatattacgaatctagtgccgagttagaattacagggaccaccgtggtgcaaagaaggtaacatctacggaataaagtttgccccaaacgcttcagcccaaagattttctaacactaccagtaggttattttctaacagaagagagcaatcaattgagtcatctatttatcacaatcatcgtttgaatttgacaagatggaataggttttttgttgtcgttgccaaaggtgaacttaatcttttcactttttctcccaagtatacgcaagcatccaagcagaagggagaaactgttggttcggggaactcatggacagataacgctacattaattgccacgttcaacctttgctcatgccttgctatgagactgcaaaaaggatcgaaaactcttgaacaacttctggaaaagaatccagttccttcaaccaataagaagctggaccaggtttattgggcattagctttgccttccgttaacaatgttgaatcctcttcaagaagtcttatcaatcaagaggcccagtgtttagtcttcatgtgcaactctaaagagacctccagagaatttgttgacacttgtaattattggagcggaagattatcttcagttcctacgcaacaatctatttcttccattgaatatggatggagtgagaagttgttgaacctaatcaaaaaggctgaaacaaattctaagaatgattcacccgatgaattacttcgataccttggtaagttgaatattgctttttggaaacccatggttcatggagtgatacccactgaacaggacattgatgaacagataaaagctttagaaaaacacattgaagaacttctaaaagattacgaaagtcacaaggcgatagaaaaagaactcgcaaaacttgatcaacacttgagaacttattcttctaaaggcaacaattttttacacttttggagccaatcacgaaaatcatcatcgaatgacctagtacagaaaaattatcgtgtttctttgcttaattggaagaatagaaaaatattcttggagaatgaaatgatgcgtattagaacctacctcacggtactgcacaattccatcaagttagaaaacgatttcatcgccaaaaataagattgaatcaaatcacagcaatacgattgacaggctgcgagataaacttgttgactctgacatggaaacagagctggaaaacaagatcatcgttctgtaactaatgccaacttccatcctgcagtatgattcatgcttatgtaataatacatcttccgcgatagtcgccatcgatttagtgagcgaacgggaggcgaaatagacttgacttactttaccctctatacaataagaatgtcgaatcctgcgtccattaacggtggttcagcggtggccatggtaggaaaggactgtgtagccattgcctgtgatttaaggctgggtaaccaatcattgggggtagctaataattttgaaaaagtatttcaattcggacatgtgtttctagggttgacagggttggccacggatgttatcactttaaatgagacttttagattcaagacaaacctttataaaatgcgagaggaaagggacatcgagccagagacttttgctaacctagtgtcaaccagtttgtatgagaagcgatttgggccttacttcgtcggaccaattgttgcaggtatcaactcaaagacaaaccaaccatttatatgttcatttgattcaatcggatgtattgactattccaaggactttgcagtggtgggcacggcatcggatcagttgtatggtatgtgcgaggggctttacgaaccaaatttgtcgccagatgacctttttgaaaccatcagccaggcgctgttaaatgccaacgatagagatgctttatcaggatggggtgctgccgtctacataattacaaaagataagatcagcaaaagatatcttaaatctcgtcaagattagcatacatatttacaagagaattcacccattatttttgcccattattagcttcaagctccaattccttttcgatgaccttcttgaggtaaccatccttgccgtatttctcttcttcgagctgttttctgcgcagctcgaacttcttggtcttttcttttctttccagaattttttctctttcctgggccaatctggtgtcgtgaagacatttcgtaagcaaggttttcggttcgttgcaaagaccgaagatctgtttcataaattcgtttctatggcattcctggagagcctttataagatcctcgcatggatgaaatctctctgagtctaactgtgggtgcatgagctatgaggacgtggcaacggtcagcaaaaatgattggagatagtgctaagattaatgagagggacagtagttgaaaagggacgggcgcgaaacttggttcacttcaatagtgagtgactggggatttcaaaccaaataacaacccacgacggagaaatgtcgaatacggaaactgaagacgacgtctttgagtttctaaactctctccctgatgatgaaaagaatctttctgctgatcagttgaaaggcaagtcagatcaggatattttggagtttctagatcaattgacggagaaggagaaggagtcggatacactaaacaagcctaaagaagccaatgcagagtcagatttgaagccactgccaaaaggggaagtgggtatcaaaacagattcagaaattgaatctgctcctcgtgagggtacggcaccagccgattctcaagcaagtaggtcatggtggggggtaaattctcttctacaaaccgcagcccaattcaccaacactgctcaagaaaaggctgaggagacaatccgcaaggcaagagaatccaatgagaaacttgacttaacatctgtcaaacaatttatagagaaaaacaatcttaccacagaacagaaagatgagctcttaagcctgactgaccccaataaggcaattgattccttgggcaagggattcgggtttttttccagcaagttatcttcagtattggataaaatcactgaagaatttgtcaacactgatgaaattctggatatcaagttcattcacgatatgattaattacgaacaactaaatgaattggttcgatacaattttgaaagggtaatgaggtctcaagttgacggagaaattaagattttggtcactcaaacgaacccgttgcataaagaatcaggaaaaaacttaagtctcttgtatggaaagaactcagagggagaaaaattggccactgccaacatagaagaggctattaaaaaggatcaatcccaggatcacagtgacgaaactgaacccaaggttcgcagatcaaagatatatgtggctatccaaggagtatcgttaaacagagaagctgaggattcaggtgtcattgatacgttcacacctgggtctttcagcttcgtaattgtgctgcaagacaccactcataacatttccataacagctaagtcgcagccttttcccttaaaatgggcacattggcttgacggcgaaaagtcgctagacactgaggtagatccaagcgaatgggtgaaaacgtgggtgatcaacggtattgatcttgccatcggtgtagttgctcaaagttatattatcaagcgtatgggattctagttaagtttacttatttcgtatatgtaaggcacctgagtctctaactaagtattaaatttctgtcgattttgagtgattttgtagcattttctgtaatgacgactcgtcggcggcaatcaggctgttgtcccaatcgacaagcaatggcggtacaaacaaaccttcatctataagctgggtcactgacttcttgccaaaaacagatttgtaatcaggtagccgattgatatcactgacatgatttattgcagacccccatttgggaaatgcagacttgaacgcttgcttgcacattggatgaatagaaagtgctgtctttatgaaggcgaattgatcaggcgtgggtgccccttcggatatatctaccttataacgttccaagtggtcattctgtggtccttttgtgattgtattccattgcttggaggctctgtcaaccagagacttaggttgtgcaggtcccaatttgatcgccttctcgtttagcgtctttaatagcgattgcgacagagctgattgaggattgtgaaatatggtgatgattccaggaagttgctggagtgatttaaacattgacattattatgcgggaagtgtgttagatacttgagataaagtgttggtaagagaacaagattgacgggagttcacggtaagggatagggaattaggggaggggaaaagcgcgcacatatcagtaagtaatctgatatcttgcagggctgccaggctaagactttcttttctggagccactcctcagtaattcaaaggcccacagcccattgctcccatccgttacttctgtctaattgagggtttgaagataaattcctattttgctcatttccctccttttgattgtcctcttcgacatcttccatctcgtcacttccctgtgattcctagcaattgccaaagacatcagatctccgttgttcccacaaaggcatatcccgtctaaccgtgtccagtctatccaaatcaatatctgctatacaaatatcctctgttccacggcctacgtcagaacactgggcaagaattgatccccacggatcaacaatcattgcatgaccatacgattcacgaggtaaggcaggagcctcgcctgtgagtcctacactctctccagtgccatgacgcccagcttgagcagccattaccacataacattgtgtgtcaacagctctagctcttcccaacaattcccagtgtgcggcaccagtacgcatggtaaaggctgaagggaacgctagcagttgagccccaagggcacgaagtctcaaggacaactcaggaaacctaatatcataacaaatagccaagccaactttgcccactggggaattgaaaggtggaatcaggttggcacctggttgtaccgaatcactttcacgtaaggaacgtccatcttctaaagccacatcaaacaaatgcaacttttgatacctttgtgcaatatccccatgactattgagccacagtaacgtatttttgactcttcctctggcatcattagctggttcgtgaacccccacacacacgcacaaaggtctccctaaagccttcagttctcttatcttactctgtaaagtcaaaacaaatggcgatgattccgagggcatacaaagtgacttggagtgtgttgcattacgtgcaacgtagtcagcagcctccggaagaaacaacgctttacatcccatatgagcagccttttcggccagcctagcagcagctctaccattaatggctaaatctgcgccagaacacatctgtccggctgcaatcaaaaccattgcaaggacggtgatcaagcaaaaaaaataagtaaaacggaaagaaacagacaaatggagaagaggagaaaatcgataggaactcacacccaaagtttcattttatggggtcgcatggggttaagaataacaaaaagaggggtgtacgctcgaccaaacccgacatctgccatttaccctaaaattaggttttacgtacatacatacaagctacaacttcacacaccccatcgcgttctccttaatgtagtccacccccatctcgaggtattcaccccgagttaaatatgacgtttgggcaccctgacttgatgaccatttagccattcctttccaagcatcattgaaggggtccgagactctgcgtataacaacatttctctccacgggtaagaagctctgaaattctctgcgcaatctctcttcaaagttttcaaaataggaaagtcctcctgaaataaaaacgttttgcagtaactcttgctgctgatctcccgaaaatccagtcatactgggcagtctacgtagtactgtatcttcacaaagctcagcaacacctgcctggtcaacacctgcaatagaaggttggaataacacttccggaactctaatccgttccacattcaaatgaatttgatgtgcctgatgctgttcttcgggatcatatggtcttggaccacgtaagaatctgtgtactatactacttctccagtcatattgacgcttataggtgtcttcaattgtaaatgttggatcgaactccaaaagagcttcctctatttccaagagttcttgctcttcttcttcctcagcttcttcatcgtcaccggctgaaattgccctgtaaattgcccaatcatcatcattagcaccaaatgtatcgttagggtcattatcaatggtcacagcacctccacgcctttttcggttgctatcacctttaccgttgttgtctgctgctagcgatgctatcttcttcatcctttgctgggcagtacgagactttctgtttgaaagttcttctttccgcttctttctttctttcttggattgtaaaatagctgtcagacgatctctacgggctttgatccatccgtttaaatcagtctctctccattttttgtcctcctcttgcttacggagttcttcaagtttggcagcctctttctcttgcttcaatttcaaacgagcatccatattagccttcaaaagcttctgacgtctcttttcttttatttgatcctcgtcaagctgctcgtcggggatatcgattagtgggaagcttggaggttcctcaatttcttcttcccctccgtcaccagtcaaagcgttctgtcgtctcgcttttttaagactcttctccaaacctgataaatacttcgtaaagtcttcaacgtcttcaaatccttcagaaactaaactattcaatacatctcgccttggacctgcttccaggtttgctcgaagtgcagaatagtattcgtattctttttctttctgcaaaagcttttcttctctttgtttacgagcctgctcttgaagtctacgaccgctctcttttctcttttccgcctctatttgcaactcttcctcagtcttttgtggttttataacttccacgaaggaagcttcaataactcgatctttctcttctaaggtttctaacgtcaaataatctgagatttctttctgataatcagtagacacataacaatgatctttcactagatactcggcattttgaggggaaattttgcttggaaaatagggatatttcaacgatatgttgctattcaaccattgggctgccgtatttcctccccaatctaatcttctggcgtaagttaaaacagcacttccatcgactataggtataacatttgtagactcatgacccgttccaataacaagaccatttggagaatcggtattgtaatggtaggcaaataccgcatctacaccgctaacaactttgggaacattgtaagcttcaaacaagagctgatacattccagctctttgcatgtacggtgttgcaagaagttcattgatgataatcggattctcaactccatgtggagatgacactccaatatgagaaaaaccgtaatccaatagtgtttccacagaatcccaattggtgattaattgtccatcaaatggagactttacgttcgacttgttgttgcttgcctccatgtaaacatcattgcctgccaatataagcatcttgttcctctttctgtcacgactcttggataccacagtagggaaaacggatgttggagaatccttgttcaccagccctatcctcatactagtttttccaaagtctatagctattggaactcctggggtgtaatctgaatgaaaaggcgccacatgtgaggaaaccggaatatcccttagaggatagaccttctgaggaggcaactccttctctgaaccaggcatttacgtgatacggcaggaaataggatggtgggaagctgaagatcgagcgagggcacaggagcagataataagggtgacattctggaaaggaaagctcgaaggcccgcctagaaacactgcgaggtaagtgggatcgaagcgcatcaaaaagaaaaaacggtagcaggagtgggattgccttcttaccgggcacgtcgcggcacgcttaatacaacacattctaagccgttaactgcccctttcactccacgcaaagttactcatgacagacgctttacaaggtcttaaccttgtgactttattgaaaaggtaagtctaacggaccctatgaattacctaaaattcaactaacaattaggcttgatgctgctaccacccgtttggaagatattaccatctttcaggagagtatcattcaaagagaacaaccatttccatctgaaattctgaataactctgaatcccaatcggttcagcaaggaagctctcgacttgatagttctgcctctgactttacggaaactaagatcgaagcagagaaaccatcaattacagcctacgagaaattatataatgaccatgtggccccattcttagctttatcaaaggagcttgatgaaacattaggtaaacaggtccagttttttgccaatgctttccaggagcagttgaaacttcttaaagcagttgttagatctcgtaaggtggagataactgatagcacttttttggaagctgtcaagccaactaatactttgctccgagaagtattcgccataaaggatgacaaccgtcgctctgaattctttgataatcttaattccgttgctgagggagctcctgttttaggatggctgtatgtcaatactccggtatcgtatattccagaatataaagatgcagcttccttctggactaacaaggttttgaagaaatttcgtgacacagacagtcgccaagtagaatgggtcaaacaatttctgggtatttttgatgctttgagagattatgctaaagagtaccacacaactggtgcctcatgggatgctaacggaactgagttcaaggaagctttgaaaagttctggatcacccacaaatgctcccttagctagtgcttctgctcctgttgctggaggtcccccgccaccccctccacctcctcctgctgatgtttttcagactgatgattcgaaagggaagaaaccacaaggaatgggagccgtgtttgctgacttaaacaaaggagaagctattacatcaggtctgcgtaaagtagacaaatcagaaatggttcataagaatcctgaactgcgccaatctaatgttgttccagctaataaggaaaaaccaggaaagcctcaacctccaaagaaaccgtctggtttgtctacaaagaaacctgcgcgtaaggaattgcaagacaacaaatggctggtcgaaaattacgatggtgaacaagagattgtcattgaaggagagatgcagcagagtgtattcatcagcaagtgtgacaactcgacaatcacaattcgtggcaaagttgctgctgtctcattgactcaatgctccaaggttggtctagtagtagactccttggtgtctggaattgatgttatcaaaagtcgtggattcggcgttcaggtactagggaatgtccccaccatcaccattgaccaatctgataacggtcaaatatatttgggagcagaaagcctgggaaccgagatttacgcatcatctaccacatcgttgaacataaatgtcccagatgaagacggagatttccgagagatggcagcccctgaacagttcaaacatacggtggctggaggcaatctacaaaccacagttgtagagcacgtcggttagcaaaagacaccaacctaccttgactctggaactgatctgtttataacatttaagtgtatttacgtatttactaagagatcagatcgcgaatgaaaataggttttccagaaacttctctcactggtacacgactgtttttcttgagaaaaaaaaaactttagaggcaaaacttccttactggacatacacctagagatatatcaatcgtgagatggttagagaaacaaagttatatgacatcttaggcgtgtctccagacgctaccgatgcacaacttaaaaaagcatacagagtcggagcactgaagaatcatcctgacaagaatccatctccagaggcagctgaaacgttcaagggaatgtctcacgcatacgaggttctttccgatcctcaaaagagagaaatatatgaccaatacggagaagaaggcttgaacggtggtggtgctggaccaggtggcatgggtgaggacatcttttcacaattcttcggaggaatgttcccaggaggtggccaacctacaggaccacagagaggtaaagatatcaagcactccatctcttgtacattagaggaactgtacaagggccgtacagctaagcttgctctcaataagactgtcctatgtaaggagtgtgacggtaagggtggtaagaatgtcaagaaatgttccgcctgtaacggtcaaggtttgagattcgtaacaagacaaattggccccatgatccaaagagcccaagtgagatgtgatgtttgtaacggagaaggtgatataatcagcggagctgacagatgtaaggcatgttctggtaaaaagattaccaacgaacgtaaaattttggaggtcaacattgaacgtggtatgcgtcatgggcaaaaagttgttttcagtggtgaatcggaccaggcgcccgatgttattcctggagatgttatctttgttgttgatgagaaacctcacaaagacttttctcgtaagggcgatgacctttactacgaagccaaaattgatctcttaactgccttggctggaggagagcttgctatcaaacacatcagtggtgaatatcttaagatcactatcattccaggtgaagttatttctccaggttccgtcaaggttattgttggtaagggaatgcctgtacgcaaatcatccagctacggtaacctttatgtcaagtttgaaattgacttcccacctaaaaactttacaactgctgagaacctgcaactattagaacaagtccttccggctagaactccagtttctatcccagccgatgcagaagttgatgaggtggtcttagcggatgttgaccctacccagcaacaacgccaaggaggacgtggtggccagtcgtatgattcagatgatgaagagcaaggtggccaaggtgtccaatgtgcttctcagtaattgtatttgatagtgaacataatgtaaatctgattatctgcgttcgtgtctatgaattatttatggtagtttattttctatctacagtttgtattttgttcccctcctagccacatagagaacagggatcatggcaaccaatgagatacctgcaaagaaagtgtagcaaccaccgatggtcattgctgcaatcatcttggttagcactcctacgaatagggcgctcattaggcatcttgtgatgttcacgcaagaagtggcggtggatgactgtcctgggaacatgtctatcaaaagagtggtcgacatagtcattgttcccagacatgcccatgtaaagaaaaatattgtgatgatgatgggggctggatgagtccttttatctaaagtccacccaaatgttaactgggaagccacacagatgagggtgtagacccagtaaattgagagccttgccttgtaaatggaaaactctgacttcaatttctggcaacgataagatctgtcaaggatttttccagttgcaaaagatcctaaaacacatcccactcctgatgatatgaatactaatccgatttttaaagtcgaataatggtaatgattctcaagctcagtagcaagagtagttaaacaacaagtccaacttgcaaaaagaattgagcacggtatcagcgttaagtatactggtggcgcaatcaagatcctaaaggtgtccagcagattgtaatgagggtgtgggtctgtctgggcagagtcatccagtcgtctctggtacgatggtaggagcaagataggacaataattccaaagtctgcgtggttccttggacatgtttccaacgatagaacgattcgtctctggtaagaaagagaaatccagcgtgaataccaacatacccaggactgctaagaaccaaaagacagctctccatgattggaatccttcatcgacggcacctcctaagagcggaccaatggcctggcccattaaaagacagccagacaccattccaacgtatgatcccctgctctcacggtcaactaagtctcctaccactcctgatgctatggaaactgctggtgcaattgagaaagcctggaggcatctgagtactagaagtaaccaaaactttctagtcaaagccaaggctatgttggcaactgtgtatagtaataaaagcatcaaaattagaggccttctaccgattacatcggctattggggatagtagagccggtcctataccttgaaagataagataacagacaacagctaaattattgacagattctgagatcggaaaatattctcgaacttggttcaagatcgggaaatagatcggcatcgacaccgaggaacagaaaccagtgaaggcacataagaaacatattatgagtttttctggcctggttgatatagagtaaacttgagaagtctcaacggttgcctcctctggcttgtccctcttctccaaatccaatttttcatttgtcattagggggtttaacaaggggtggcagacgatgagtaatatatatgccaaaaaaaaaaaaacgcaccggaataatatgctccttcctgtgtcacccgttattttttcatgcgtaaagatattccagacatgcgcaatcagacagtctggcgggaacggacgtcgtgcggccagtgaggcgattaagcaaacggatgaatacggaataattattgtatgaatagtcggcttatttatcttatctacttcttggcgggtttaggagtgttcatcataaatcccacagcgtgcttttgactgggtgatgctatgagtggccgagtgggcgttctgccggattgggatgcggtacttggactcgttggacgagatagcaatgattcttcttgaacagaactcagctccctactcgtcttactaggggtccttctgtctctaacgctcagggattcgtctgtttcctttcttctagtagaccttcggggtctagctgcatcgaatggattggatatttgcgatctcgaacttgatggtgactctaacaaatcataaacggtgtttgcgcttccagattgtcgcttcctttccaattcgactttactgtctggaggtaatgtttttcgcttctgtgactcagttcgttctaagtctggaacactatagttgtggaaatgaaattttgactcatttgatgccgggttcacccgaaatacagaagttgttcctccaggtactgcagactctttactcgcaccaacatcctcatgcaatggcgcggataaaccaaatgagtcagaagactcgttaggtactagtaatctggaaatcatattcccaggtatacctactctggaagccgattcgattatattcaatgtcagttccaagttcctctgcctcaaggattcctgtttcgtcttctcctgcaaaagtcgcaacgaaaacgcctgcgtaatcgtattgggcgaatgtgttccttgtagtcccaacagcttggccagcaagtctgtgtctgcttgctcctcccctctcggtttggattcttccaacggctctcgatgtggttcattgggcatgcttaatacatctttggagaaggagattatttgatggaaggttagtttttttgccgatcgagaaaaaaaagtttctagaacctaatcacgtcagaaaggctaacataagaaaaacatgtcttaatacaaatttataaaaggcgatacaccaagaaaggggtataaacagaaataaagaacttgcaaataatttaatacaacacaaacttggccttaccgctgttgacagcaacggtacaaccgtcggaaccgtttccattgtatgaaccattttcatacttgcactcgccgataacgacagaagaatcatcataagcaacaatcttgacattatagttcaaggagtccttgttgttagggttagggattaaagaaaggtatgaaatgccgttgtcgtaaccggcaccaaagttcaatggcgcccagttaccgtagtcggttccatagtctccccaggtacaaccggtggtccagtcaacaccagcatcgttcacgtagtattgggccgaagtcttcattcccctccacgtatagtaagaggattggtcaactgttgtcagagggagttctccacccggactcacaacagttggtataaccatgttttcagttcctggatagtcggttctacagatggcagcagttttaccaatttcactgacaacataggcgacatcaataccccattcacatagatagtcagtgtctttcttggaacggtaaaggtatccatcagaatcacaatacagaccaccaacggaaacaccattgtccggttgttcagatggccattgtgtcttcgacatacctgattggcaggcataagagcagtaggtgtctggttcacagatcccaccagtagaggtatcagatgggtggtataatcctgaccatcctccgaatccgagatggtccaaggcaacaacaccgttaccggatgggaactcggaacactttatagtaccatcctggaatttgtttccaggacctgagtaccagcttaggtctccatcgattccaccggaactggatcctgaactagagcctgagctcgaacttgaactggaactggaacttggacttgaacttgaacttgattgagtcgtttgctcaacagaagaagaggcttcttcggtagatgaagtgaattgcgctgaagtggactctgcaacagaagaggtggtcacttgtgcagaagttgtctctgggattgaagaagtggttgcaggagcagaagaagttgcaactgcggatgagcttgttgcaggcgtggaaaccgtctcaagttctgccacaacagttggagaaatggtttcaccttggccattgatagtcactgtgacataaacgtaatcgtatgcgacagcacgtttgtgttggtgacgtttctgcactgtagtagtacaatcttcaggctttggagctggtgctgcaattgcaagaccagctagagtaacagcgcaggctgtaagagcggatatcttcattgggataataatctacaagttgctgtgttagttagtggtttgaggaagaaaaatccacacggggttgtcttcatattattcttggtattttatctgttgatctccctactgaatctcagtttccctgcaaatagctcctggggaaacgcgaccgcgttcccaaatcgtcgtgtgtggatggaaaaaaatgcacttccaagatctctcaggccggtcgcgcctggcaaccagccattgagtaaacaaacactagtgaagggggctgttcaataggcaacagagaattggggccatggtgaccacttcctcacgattaataaaggaattttattgagtggcaacaagggatgtaggggacggcaaccagagaaaatccaaagcaaaaatgaacagagtaatacataccttggttaaattgtatcaataaacaacgaaaaacgggtcaaatttgctgctgaagttgttgtatagtaaaggaatgactaggaaatggaatatttcactggaatacaacaggataaaggagtgacaaagtttgggagttttcgtaaagctgaaacagaactaaagagaaggaaaagaaggaaacaagatgggttaagagtggttagatcgttgtcgtggaacacccaatttgggttccttggcaactcgtctaaatcaccgcaagtgatgcatcacatttttatgaaactagtggtgaaattgcagagtggtttatacacgactatttctttattgttggttgttatagagaagtaacaatacaacgcgagatatgcggtatgctctgattagataagcaaaaccgttgcgggtactaaagatggcttgggtatagatagaatacaaaaaaaataaaaaaaatggctgcttagtccaccttacgcttgctatatttttctcttaatgcatcaaaagctgggtttagcttgaatttgattcggaaagcatattcgataactcgagttgggacaaggtacatcacaattcccatgaatgtagccatcttgcctctgtaaacatggaccggatctctggaacttaggatgtcgttaactaccttcttggaataggtagctggagacattggtttatttttctcggccatcttttttcttagttcaaaggcctctagcatttcaggggatgcataaacagagtccttaggcaagtctctggtgtcagcaatattagtgtcgacacctccagtaactacgttcaaaactttgacacccaatggctctaactcgaggtgcaatactgatgcatattggtgaatagcagccttggaagctccataaaccgatccccagggaaaaggacagatacctgcaagcgatcccgtaaacacaacgatcccttgggcagcgatcaacaggggtgcaaattccctggtcatcctgattgggcctaaaacattcacttgaagacattgcaatgcccattcgtcagaaacatctagagcaggaacagtacatgattggccagcattattataaagcaaatctaactttccatcggtcaattcaatgactttctttttcaactccaatacgctgtccaggtcggatacatcagctttcaatggagttaccccatactctcgaagactttccattggctcaagtcttcttgcggctccgaagactctgaaccctctagctgagagctctttacacaactcgaatccgataccggaagaggctccagttacaagtgctgttttagttcgttgggcttgctctggcatgtttcgggcgagttttgaagacgtgccaaattgtgtgtgtggaggagggggaaaaagtagccaggagattttgggagggaaacgacacacgtagcgctccagttgagcatcgctggtagtttgcgaagaagcacgagcgtaaaaaaaaaaaaaaaaaaaaaaaaaacattcttcgcgcaaaggctatgaaatgcttctgacagctgcgaaacgcactcacccgtgaaacaagcccaaggcacaataaccatctgattttttttctgcttataagacgaaactcagagttgctacttatcaatgaagtttggtcttggatcattgggattggctgtggcgctaatacctattgcctcagcattatacagagttgacgactatgaaacatatgtaccaaccacggttggaccacacccgacaggcgctatagagcctgctgaagatcaagttgatatcaaggtggagccaacagtgtactcccaactgctggacgagtttgagaatgtgttgggagagtctgacggaatggtaaatcatgataatcttgcctcaatttggatgtcattttcaatgattgtcgtgtctgaaattggagataaaacctttttgatcgcagcgttgatggctatgagatctcccagatggttagtgtttgcaggagcatcgtcggccctagtggtaatgacagtcctgtcatgcattgtcggccatatccttccgaccttgttgactgaaaagactaccaagactttagccagtattttgttcgtagtatttggaataaagttggccaaggagggattcgaaacgccgaaagatgtcggagttgaagaagagctagctgaagttgaagaagaaattgcattgtcatccatcaacaataaattggatgacgccgaaactggatctgtatctggttctaacaagaagaaataccaaactacactctctcacctactcgaagagaccaaggagttgttatcgttcattctgtctcccactttcttacaggttttcacgatgactttccttggtgaatggggagacagatcgcaaatagccactatagctatggctgccagtgctcaattttactttgtgatagtgggtagtgtgctagggcacgcactctgcacaggcattgctgtactgggaggtaaacttcttgcgggacacatttctttacgggctgtcaaccttgggggttccttggccttcttcatctttgcattcatatacttatatgagatatatatgtagttgatcgaactatttctgttgactacggcttgcctggattcgctttcgtactagttcttgaatctttaaatccgttgcttcctgcagctgcgtctggtacttgtccaatttgattgatagatcatttctcggtttcttactgctattttcctgtgtattgctttgttgaatatgtgttaatcctctgactctctcttcaaatgagctcagaacggacctctcaaactgcccactgacagcctctatagtggttacaccgtcggtcaccaatggtggctcatccgtatcttcaccagcttggtcagctgccttcagtgtatcccttgtctcgggattgtagttacggaatttcatctgcttactcattatctccaaaaatattatacgattaagtaagttcattcaagttatatacacatacattacgtaagatccgcgcaaactgggctacttcagcgttttgataaacgagtccaggtcgtactcttcctcatactgagaagcatcccatagttcagccaactcgccaacagctgatcccgcctttcctccaaggccagcttcatctgggatctcaacttttttcctattggtctcatcagaaactgcagtaacagttgcagcagctggtacagttgaccctccattctcatcttcaacattgaaaagatccaataactgaccagtatccatggatgccaaaccagcattctgttggttgactactgaggatgctatattcattttgaatttttgtagtcccatgatgcgctcttctagcgtgttctgggtgatcaatctgtagacattgacgaccttcttttggcccagccggtgagctctgtccattgcctgaagatcattcattggattccagtcgtgctccacaaatatcacggtgtctgctccggtgaggttcaaacccagtccaccaactttagtggtcagtaacagcaaatcaatggagggatcttcattgaattttctgacaatagattgtctactgtgaggatcggtggaaccatccaatctcatataagttacactaggcatgtgtttgcgaagcaaatcattctccaccatatcaagcatatctttcaactggcagaagatcagagcacgatgttgactaattacaccttcagatccagtcaccaattgttgctgttgtcttcttagtgaagatccaagtccttcttcgctattttcatcacttgagcctattccgcattctagcaacaaagtctttaaggaaactagctttggagcatgtctaatgtctctaatatccatttttgaatctcttaaatacgcttgaacatctgcgtattgtgggtgcttcggagtcaccaccaatgctggatgattgcacaactttctcatgtactgcaaagcttggaaaatatgctgtttgctctctttcttttcgttagcatccttaacctcggcctcgacagttcccttttgttttttggcaaaatctctatacaattgacgttgcaaatcactaagttgacagtagtaatcttgaattatcttagggggtaagtcagataaaacatcctctttcagacgtcttagcatgaaaggtaaaacttgcttatgtaatgactctagagccagtgcaccagcctcctgttccttggaagatgtcttggagtttcgggatacggcaattggtttggcaaacttttcttgaaatatcttttcagtccccaaaaagcctggcatcaagaagtcaaatagagaccataactcaaggacattattttgaattggagttccagaaagaatcaaacgatgttctgctctgaattttttgacagatttagtcaacttggtatttgaattcttgataatgtggccctcgtctaggacacagtagttgaaatcatgcttcaccaaatgctccaagtcattccttgcaacatcataagaagtaatgatcacatcaacatcgcccaattttcccctcaagctggaacggtttgaagggctgccagtataaactaagatcgtcatgaaagctgcatattgtttgaattcctgctcccaatggccggttaacgagggtggacaaacgatcaaagatgggatctttctaaagttagcattttgagactttgcaaactcctcttgtctcaaataatggtcactggctacgatacagatggtctgtaaagtctttcctagacccatatcatcacataatatgccatgtaaatgatatttatttaggaaagctaaccagttaactccctcttgttgatacttcctcaaggtagcattaattgaaactggcaattcaaatggtttaatcttagtaggatccatcatttgttgaatgaattctctttctctgtctcttccttccagtaactctttgggcatatctggtgggtcttcaatgccggcctccaatggaactagcttgatgattgaggcaaaagttgtggttgccagaaatctaacatcgttgttagcatcgctcatacgccctagaaccggaacaattaaaaacaccacatatggtaagatgctaggtcccatagtaacagaaaggtggaagatgaactcaatgctaccctggcgtttcactagagatccggggtcatttatcattggcaaaatatctttgatgacaatgggaattagtttagtcggtacacatgaactcaataatgctagcaaccttgcagcacagtatcggaatactgaatattgtgatttcagtgctaacaagattagtggcactttctcaattaccaggtaccttaaatctggatgcaaattaacaaacaaggcacgaaggatgcccaaactgtctaccaatgactggccagtttcgtcatcatactccgctttgtcattaagcttctcaagtggcgaaaatattatagactttaaagttgggagttgctcaaaaagggaaactccgtacttgtccaagaatatattcaaagtgtaaagggcaccacgtcgttttatagctgcaaaatgggcttccctttccaacgctgctacctctaaagcatccagttttgattcttctctcttcaatgaaaggattgtatctttgaacgtagcatttggagtaaattcaggaacttcagatgtgtcaacacaaaggaaagctgataggttttttgtaattttgtcggcggcatttttcttgttttgttggttgagtatcgagactaagtgtgtaatagaagttgccgatctcaactgcaaagtttctagctcctctgatttcacgctgtccatcagagaacgaatgacagggttcaatttcttagggagaccatttaattgtagtgacagcgcagcaaacgctgataatacccttgtggttctctcgttcttggccctattcgtatcatgtatagccagttctattctctttttggcatcttcaagtgcattagaggcagacattctatacattggagataaactttttagtaacttgtcataagaggaatcaatgatttttcgacttgtatcaatgctgaatgcactggggcctgcttgaacttcaccctgaaccacaatcggaagttgcggaactttgcttgctggcagttttccaacgtcagtgaatgtggcaaatagatacaaacatgatgttcgcacgcccttaagtgttccagtaagctccctaaagaatggtaacgaatccggattctgtaggagctgtgaaagatgatcactaactatgtttctggcaatattaagaaatttctccttctcctcctgggatatgctagaagcattcaaagaaatactatattcttcaagaacgatggcaccaaacaatctagtagatgaataaggcgattgcatacatttgagtagtagtgtaaacacgtcacttaaaacattctcatcagaaatgttagtgagtgtacggccgtaagctttggaggcataggtcttagtgtccacgaatgtctccgtaggaactaaagaaagatcaccattgataataggtgcatctatatccactcttgactcataatgtgagggcataccggtatcatcatccctgaagtccggtttagacgatgaggacatctttctttttttaccattggtgtcattgttgattgagtctattccagctccaacaggatcatcaaatattgatctcacaaattctaaatcatactgcatgtttccccgcggcctaactaataaagatctaggcattgcgtaagttgaacgggacactccaattggaattgataataaagccagtaatggaagataattatctttgaaaacatccaaaatagtaacatatttagaattggttgcttcttgtaacagggtttcatatagttgatatgacagagccaaaacttcaggattctgttccaacagtatattctgaaatatcagtcggaaggttttggcgtctatccaatccttaacgaaaggatcgtcgatagtcaaaaacgcttgcagggttcgaagtactgactttctcacagatgttatggaatgtctaagaaacgggtataaccttggaataagagtcttgaattgtgcatccttcttaagtttttccaaaacttcggtatgagagcatagcttggctaataaatccattactgagccaattgcagcagataggtcgtcctttatatctgttaggcatccccacaacacatcaacaatattaaacaccagtcccagtttaagcttcacaaactccttcgtgataggtgtcaaggtagaggcagctacgctttgcacatcatcgtctgaactttggtttaagccaagaagcaccatatcaacgaccttggacaaaagttcatcgggatacttgaacaaaatgtctgttttaacacttacaaagtatcgaagccccaacataccgccatgtttcgcttcccaacatttgggttcgataccatcctgtgtgataagatcagctaatgtgtgaaaaacttttaataccaagtcttcatgcaaatgtaaaagaacggttgcaagtgtttgagcagcgttttctcttacaggggtaacaactgtgtcggaaacataatctccaaaacgatctaaagcaaaaagcgataatatacggaaagataaatcctctaaagtggcattatttctctgattgttttcttcgatcgttttacccttaactctccctgctcctaaagcatgtttctttagaagttcacgcagacccattgcagcaccatgtcggatttcccagataggatcaaataaatccaaaagcataagctcataaactccttggaagggccaaacataacctgatgcagcactggcattctggaggattggggatatagcagacactttgtgttcaacgactatcttgttaccattggcttgagaggtgatatccacatccataaggtcacttttctcatctactggggtagcggtgtcacctgtttgcttgagctcgggaattgacccatctttttcgagttgcctgctcactgaactttgagataggtcaacaggcttattcttggaaaaagcactattcttggcatttgcctttgctttccgtcttgccaatgctttcatgcgggcgcttgcctttttctctgttttgatagcctctgtttcagaaattcctggagaagcagaggagaggagcttttcatggtcagtgttgagttcattcttaacttcgatctttactgatgcttcaaggtcctcctttttgatgtctgaatctagttctgggctgtgtgaaccatattcgttgtcgtcctggggaaaccctggaagtcctaaattactattgatggatttcttttgtctcttaatgtcgtttttatagttcgctaagttttttggatgttcatgatccaaaacaccatctcctgaggccaatagtttgcggccatgcgtaattatttcatataagttccagtcatcgaatgtaattagggattcatcgagactcgaaatcttgtcatagtcagagggcaattccttttttatctgttctggggattcatcattatcatctgcattgggatcccagacgggagcatggctgacaatgcctccaaaagcctttgccgttgaaacacgagtctcccatcgcttggatcgtaagtagggatatacgcgtgataaaagattaagtatttcttctgggtgctgtttcgccagatccgtaagctgatcagcggccgtgttccttataaagggcgttgatcctgtatctagtagtagtactagtctttctaatcttgacattacggttggatgaaacttaacagccaggaaccatagcccaacagaaggtaaggaaaaatgaagctgtttacataatcgagaggaaaaaagggtttacttatagggtggaaatcggtagtgcacgagataaacggacgtgtcgatggccgagatgttagatgtacaacaactgggtatttattgcgtcccaagtcatcaagcaaatccacaacttacatctttcgttggaaattgattgttggtttatcatctgtacgaatcggaactagaaccaagatttccattggtactcgtggtcttttgctgctgtttcttgatctgggagcccacagtgacgggcaattaatatttaattgaacccaatgagcagcttacaattacgcattttattcgagaaggaaagttgcatacgcaatattatacagatcaatagctatatattaaatagcagacacgatttatttcctgaaaaattcataaccactcaacttttcctttgttaccccggttgattgctcccttgattgctgttgtctgctgtcattgctcaccctctcctttaccagttctctttcgtgtcacgttatctgatcaatccatcttgatagtgacagtgaattcgcgatctgtctttttcaaatccgcgacatgccatcccggagtagcctcgtgcatccaaagttagtttaagcaacaggcccctttcttctgaatatatcacctctttaattgacaacatgtacaggccaccagcttatttccaggagctttcagacatctctcctgcgacttcgttgaaggaaggtgaaagagaacctgaaatggaatcagaaccggaatcagaacatgtggaatcagttcctgcgaagcgtggagtatcgtttgatcatgaacaagccattgagtctgatagtggagaagaatcccttgatgaagagcacaggattaacgagtctgaccaattgctccccgaattcaataaaagaccgttgagtgacactccggtaatgtcgggcactgtttctccgtctgcacagggtattgctacgtctccgttgaacttgagtgacacggaagactcggatggggacgattatgagtctgaaagacggcagcgtgttcatgaggcagctgtaaacactctcaaaaatatcacaattcataaagactttcaaactactatcgatatcccgggtcagacaagttctaagagcaacccaaaaggtatagtggtaacacctgaaagagttgtcgtggtaatgattggtcttcccgctagagggaaatcatacttagccaacaaattgacccgttatctcaactggcttcaaataaattgccgtcttttcaatgtgggcagcaccagacgtaaagagagttccaagatgggacccgaaaattacccattacctgacaataatagtggtactacaactcctgagaaaccggaaacaagtagtggtacctctcatagggcatcttttttcagcccggacaataaagacagcattaaacttcgtgagaaatgggcgatggacactctggacgctcttttgcattatttattggaagaagatggttgtgtagggatattcgatgccacaaacactaccaaagcacgccgtcaaaaggtcttgaatacgatcgtagaaaagtcaaatggtcaactgaaagtgttgtttctggagagcatctgcactgataaacgaatagttgaccaaaatatacgtctcaagctttccggccctgattataaacgcatggatccagaaatagctctgcaagattttgttgcacgactaagtaattatgaaaaggcctacgagacaattgatgaagaagaggagaagctgcccaattttcaatacgtcaagatggtggatgttgggaaaaaggtaatcgctttcaatatccacggttttttggcttcgcaaataatatactatctgcttaacttcaatttatcggaacgacaaatctggatcacaaggcatggagagagtactgataatgtcaaaggtcgtatcggcggtgattcaagcttgacccctcgtggagataaatttagtaaagctttggcgaggtttattgactttaaaagaacagagttccgcaaaaagcaattacaagagtttcatgaacgactcgaaatcaagtatcgcaaaaaggagtcgcaggcgacttcagatgacctcaaagacgttgatgaggaggttcccgttgaaccatctttttgtgtttggtcctcaatgtccaaacggtctattgaaacaacccgttactttgatgataaggagttcctgataaaggaaatgaagatgttggacgaacttggtgcaggtaagatggatggaatgacatacgaagagattcagaagagctatccaaacgaattccaagccagattagtggacaagttaacatatcgctaccccggagttgggggtgagtcatatttggatgtgattaacaggcttagacctgttataacggagatcgaaaggactacaagtcacctccttctggtgacgcatcgtgttgtaacgagaattctgctgggctattttttgaatttggacaaggaagcaattggagatttggatgttccgttacacacagtataccttttggagcctaaaccctttggtgtagattggtcgttttatgattacgatgaagcctcagattggtttgttaaaattgatccagagacattagagaacaggaaaaaggttaagcaggtgggtatttctttcagagagcgtaagttctcagtggtaccaacggctccaagaatatcacgccctggatcatttgtgttttctgactctaatagtaataattctacggcggcttcaggtactcattctgttcaatctgccaactcttccacaaggttagcggactactatcgcaacagaacaaaccaggcagtggttgaagatttgagaagagcacgaggtcaggcacctaacggtagttcacaatttactcctcacgggatccctccacccaagaatgcgaatgctcaagccccagagggactactagaagtggaacaactgagtgccagattaaacaaccttcgcaccactcgaaaataaaagggaaacattccgtatttatattgaacaatactctatttaaatccgttatgtttattcgtagatccaagaggtcaaagttggcttgtagtcaacaagttcctcctttttgaaccacaaaccgatttccttctcggcagactcaacagagtcggaaccatggatgatgtttctacccatgtcaacggcgaagtcacctctgatggtacctggggcggaagccaaagggttagtagcacccaacaaagctctaccctgcttgacaacatccttaccctcccagacggtagccaagactggaccactcaacatgtaagacagcagagatgggaagaatggcttggaggtcaaatcagcatagtgctctctcaacaagtcttcgttagccaaagtcaacttgatagcaactaacttgtaacccttgttccagaatctggacaggatctctggtaccagacctctctggacaccatctggtttaacagcaatgaaggttctctcgttttgggacatttgatttggagttgtagagtggaaagaaagaaatttttgggtacgaacaacgaacgaatgagcgaacgatttcgttcgaataaggcacgggaaattgaaatttgtgttctgatgttggggtgtggtgattgaccaggtttgtcagcccggaagagatctttctaccaggcttacagtgtaatatagggtgggtaggcttgattctatcgtattgtgacgtcttgtcccatcatttttactgggatacttgaatagtcgctttctttatcatctacctactcactacctgcccactcagagtcaacactgtgtttctagaagacttggtaattggcaatcattagttctcctcttggtacagcaatgcatttctgactggtaactatccaattggctttttcagccagaaatggcaaggagatcagcccttggtgtaccctgccgtttctgattcactttggaatcataaccttgtatctaaaacagctccctatattcatgtatatatatgtccttcacttagaaaacctattcgtgtcctctccagcctttcatccactcaaactccccccttccctccaaaggtttacgtttccctgtaatttccttcatgttttgtccttaaacttcctcatcacgattacccgtctcgtatatttcatccttctcgacaaaaaaattgtgctctccttctcccaacacatgactgtcacccagttcttttgccgtcaagcaaaggccgtggaattgttccatggtcaaccagattacacagaagtccctgcttttgccagtccgaatcaagataccaaagtagctacgtattctcccgatggatctcgtttcgtgtatacccaggcaaactccgtgtttatcatagacgccaacgacggatcggtggcagtagagctaccagttaaagatgtgttcgatgttcacttttctcccttgggaacctttttgtgcgcttggtccagacctactgccgatcaggaagcttcaaacgttagtatttggaaaactgatttggcatctagatctggcgtcaaagttggagaatataaggcacgtaaccaaacaggctggaaaccacagttcactgctgatgagtctcttgtgtgtcggttgacaagtccttctgagttgcagttctacagtacggccaaggagccaatgttacagggcaaagcattgcacgttctcaatacaaaggcctctggaaaaattgctagctacgccgtcagtccaggaaagaacatgtctgtggctgttttcttacccgaacatagtggaaagcccgcctccatcagagtttacaacattccaaacttccaacagcctgtatcccaaaagcaatttttcaaggctgaaacatgtgagtttaaatggaatgggatcggtacctccttactggcccttgtttctactgatgttgactcgtcaaataagtcctactacggggaatctactctgtacttgatgggtatcatcggatcttttgaccaaagaattactctggacaaggaaggccctattcacgacttttcttggtctacgtcatctcgggaatttggtgttatatatggttatatgcctgctcagaccacctttttcgatgctaggggtaactcaatccattctctggcaccaagctctaagaacactttagcatattctccacacgctcgttacatccttgtagctgggtttggtaacttgcaaggaaccgtggaaatatatgatcgccaagacaaattcaaaaagatcgccacatttgaagcttccaacacgtctgtgtgtgaatggtctccagatggacagtatatcatgactgctacgactgttcctcgtttgcgagtagataactgttgcaagatctggcaccatacaggtgagctttgttacattaaggaatataaagagctatttagtgccaaatggaggccacaggacagctcactatttgatcctcgcgctttggactccattaaaccagctcaacacgaatctgcattgaattatctatccaagagaaagggtagaatgccaaactcgaaggaacccaagggcgtttatcgcccccctcacgccagaactgctggattcaaaagctcgttcgcgtctaattcgtctgatgagagtgataaatctagtgctagctcagccggaggctacaaacctcctggggctcgtactaaggtcattccaggagctgtgctgcgctccagtaatgatccagctagcgctgccaagaacaggaaacgcaagggtattccaggtgctgtgaagaaaactgaagacaagcctgcttctgcacctgtttcggcacctagtgaaaaacctcaagaaattcctagtgagtcttcttcacagagtttagcagaaggtaactctttagaagagaagaaaatcagagcacttttgaaaaaactgcgagccattgaaactctgaaacagaagagatctgctggtgatcatctcgaagagactcaaattttgaaaattcaaacggaagacaaagttcgctccgaactatccagtctaggatggaaggaatagaaataggtgtgcaaaacgtctatgtttattctcaattgacttcaccaaaatttgtgtggccagttttctttgcgtggctatttgcttctttttctccttgcaatgttgcgagacatatttgacattggagtatgaatgtggaagtattcgtataatagccctggttcttaagatggttggttaatttgagaacgttgtcttcaatcaaagtccccaactcactgaacttatcaaacacacaaatttgtgagtcctcctcatctaatgatgtgtccagcttgagagccatagcgtcgtaatgaataccactatacataataacgcaaaaccttgaagccatttcatcattaaatttgtagacttgaagagactcaatatccactgtccagatactgatatcaaggtattctgccaatatctgtgcttcgatggctcctccccaggaattactgctttggatccactgagaatactctgtgattgactttccacccaagatggcggagttataaataccttggttgttctctctgattacattagcgacggcctgtcttagttcttgttgagaatccggatacttgattgaatcaggaccaaatatacagtagccgacagagttgaagaaacaagaattatcatcgggaatcttccgcaagactaggaagatgtcgtctatttgaacgtagggcgcatcattctggtttgagacagtggcaattgcaacctcattcttgttgacaggcacttctgtttcaatggtatcagtgacaatgatcatttcaccattcttgattccactatcagtaagcaacttgctggtatctgagatatcaattgtctgaggaggaaacccaacctttatattgatagaagctgatccaatttcattaagtaaatccgatactgtagccccgtcaggcaatgttattagccgctgttcatttgaacgcttgatcttaagtctcattacgcttggtctgacagctttcctttttccttgataagcactattgatagcactattttgagattagggcgtggggtggcaaggttgcgggcgagaaacgttggtgggctaagtctgaaggggaacatgtgcgctaggcggagaactatcgaaaagtcatttggccgctacctattatccgcagcttaatccaccaagtttcccgagagtacatgaaatcctctaaagaactatacaaggaggctctcaactatgaatactcttccgcggtttctttcaaggcctgggttcgaagtgctcaaatcattttgcgacatgcccggcagtttgctgaacaaagatacatcagtgagtgctataagttgtctgttcgttttgtagacttgattgtgaacaagatggccacgcataaagagctcaagcaattgaagaaaataaatgcaccagtatatctcacctatttggatttggctacgaagaaagtcccagatgtcatcaaggaatgtgaggccttgaagacaattttggatgatgagtaccaaagctacctcaaactgcaacaattgaaacgacagaagcagaaagaccaattgatccatcatcagaatcaggctcaaacgcataaattacgtagatcttcatcaatattgaaagatcatatcaacgctgttgatgaaagagcgctgttgaaacaactacagcagttgacataccatgatcgtgaattcgcaaccgcaataacggagatgccaaattatccagagatcccccagctgagtatttcaacgaatcagaacactagatcagaggcacccccacttccaccaagagtatcgcaggaacagtcattagcaccagtatcactagattcatcacaggcagatttacaacacaaaactgttaacttcaccgaagctgggcaaccattacgaacagtatttatttcagatagactccaatctgagttccttagactagcggaaccaaacacgatacaaaagctagagacttgtggcatcctttgtggaaagctcgtcagaaatgcattcttcatcacccatttggttataccagatcaagagtcgacaccaaacacatgtaatacaagaaatgaggaaaagttattcgacactatagatcagcttgatttatttgtccttggatggatacatacccacccaacacaatcatgcttcctgtcttccatagacttacatacacagaattcgtaccagatcatgttaagcgaagcaattgccattgtgtgtgcaccagcacctcagttttctcatcattcttttggatgttttcggctaacccatcctccgggaattccaaccattacacaatgcactaggacgggatttcatcctcatgaggaacccaatctgtatgtgacttgtaatcgaaagaacatgggcgacgtgcaaggcggacacgttgtgatcaagaatcatttaccgtttgaaaagcttgatctaagataaaaaaaaagtcactatgtttccaattggcataatcagtctgccatcttaacttcctttacaggggcatccagattctctttcaccgtttgagcggcctcctcctgtggcgcttgaagttgagctgcaagtattttgtccttctcttcgttttctgccaaatgagtggctaacacagcatcttccatttgctttctggaaggttcagattgcttataatgttctactcgttccataaacttgagtaagttggttcctgctgctgcttcactctctaagttatcatatggtcttacactaaggtctttgacccttcttttatggatcttagacttcaaatgtgaggcaagtgccttattgtcctgaaaatatttggcacaatgaacacagtagtattgacccaatcccgctttgtattcatccataggttgatgctttaagctctgaatagactctggtgtcgatagatcaccatagataaggtccaaatctctggttcttcgcttggtcttgtatctccttacactgtatcttcccatttgcgtttaggtggttatcaaaaactaaaaggaaaaatttcagatgtttatctctaaggttttttctttttacagtataacacgtgatgcgtcacgtggtactagattacgtaagttattttggtccggtgggtaagtgggtaagaatagaaagcatgaaggtttacaaaaacgcagtcacgaattattgctacttcgagcttggaaccaccccaaagattatattgtactgatgcactaccttctcgattttgctcctccaagaacctacgaaaaacatttcttgagccttttcaacctagactacacatcaagttatttaaggtatgttccgttaacatgtaagaaaaggagaggatagatcgtttatggggtacgtcgcctgattcaagcgtgaccattcgaagaataggccttcgaaagctgaataaagcaaatgtcagttgcgattggtatgctgacaaattagtataaaaagcaatagactttctaaccacctgtttttttccttttactttatttatattttgccaccgtactaacaagttcagacaaaatggctagaagaccagctagatgttacagatactgcaagaacaagccgttcccaaagtccagatacaaccgtggtgtcccagatcctaagatcagaatttatgacttgggtagaaagaaggctgctgtcgatgacttcccattgtgtgttcacttggtttccaacgagattgagcaactgtcttccgaggctttggaagccgctcgtatctgtgctaacaagtacattaccacacaatctggtagagattcattccacttgagaatcagagtccacccataccatgtcttacgtatcaacaagatgttgtcttgtgccggtgccgatagattgcaacaaggtatgagaggtgcttggggtaagccacacggtttggccgctcgtgtcaccattggtcaaattctgatgtctatcagaaccaaggactctaacaaggccgtcgttattgagggtctcagaagatcccgttacaagttcccaggtcaacaaaagatcattatctccaagaagtggggtttcactccactggaccgtgaggactacattgtcaagagagctagtggtgagatcagagacgatggtgcttacgtcaagttcctgaccaagaagggtcctttgcaagagaacttggagcaattcccagactacaactacgccgaggctaattaggattgttaaatagtttaatatcttaatttgtactatgattgtttgtatggttcatgtagaatgcctccgtttcagctctcttttttcttcatcagtttctcgtagtgctctccttttgtggctacaaccagcaccttccagcgtccgcctaaacccagtactgttttcgccagccttcacgcattactgtctcccaacagcgcttggagattttttttctgccaacgaatttgcctcgcggtccctaggcataaaacacgtctttcagccacgtttcttcttccttaacccactattcagaatgtcgttttctaataaagaagatcctaagactttggtactattcgacgttgatggtactttaaccccagccagattgaccgtctctgacgaaatgagacaaaccttgaaagatttgagaaagaaagtcgtgattggcttcgttggtggctctgacctgtcaaaacaggttgagcaacttggagatacagtccttcaggacttcgactactgtttctcggaaaacggtttgactgcctacaaggaaggtaagaagttggcttctcagtcgtttatcaactggattggtgaagaaaagtacaaccaattagccaagttcatcttgcgctatctttctgagttggatctcccaatcagaagaggaacattcattgagttcagaaacggtatgatcaacgtttctcctgttggaagaaatgcttcgactcaagagagaaacgattacgaaaagttcgacaaggagcacaacatcagaactgatatggtagctgctttgaagaaggaattctctgacttagctctgacttattctatcggtggacagatctccttcgatgtctttccaaccggttgggacaaaacttactgtctacaacatgtccaggatgaaggttttgaaaccattcacttctttggtgataaggcctataaaggaggaaacgactgggagatttactctgatgagagaaccattggacactcagtttcctcccctgaagatactatccgtatcttaaaggagctcttttccctgtaatcaaggttaagcatatatagaattgtttaaatcatgatagtagtcttacgtaggccaaaaccaaagcaaacgtaccagtgcacacacctatcaaccactgtaggacttgtgtctttgtagagtcaatttgcaccttcatgttagctatttcttggtcaattctggtatccgtttctttgattttaaggtcgtgaattgagctttcttctcgtattcttcctctttcaagattcaagtcgagtctgacagaagacagactcttgttgacttcttctttcaatctttgtttaaccttttcaaggtcattacgtagtttctcatgttgagttcttatgttgttaaattctgacctatcgatcagttgtaattcacccttcagcttagcaaagtcaactttttgctggtatgactgacgcgagagtacttctttggtaattaaattggaagcgtataagtcaattccatcgttaatggccttgctgaagacgtttacagcggcttcactctgttctttgctgaacccattctcctgaagctgtgtaacaaactttagagagtcaaaatgagtgtggttgtttctaatataacttgtccgaccaacagcaccagaggcaaatggtcgcaatctcaaaccagttctggttaaaaacatgtaagcctttgagatagtactaaggagcaatcgaagtgaaccgagacgatccctatgtctggactaccatctattaacatcagcaatttggtcactcctaccgcgatttctcccttgtagctagaagggagaaatttattctttagtatcaattgtctctccacttggttccaaagacatcactcgtaacgacaaaagatgagccacctctgcagtgttggtgctcgctctttgttaagacaatcatccagaagtatccatcagagtcgtcttttattgaatgctctcccaggtaagaatgatccaactgccaacgataagccagcagggaggagatcacttaatgaccaattgtttcagggaaaggagaaaagcttcaactttgagggggataagatgccaaaggagagtcaatccgaaattgagaggaaatacgccttttatgaaagattgaaggcgattctgttagggctaggtgccgttggaggtctaatgggtggcttctacgtgtggtccaaatggaatatcatcaagtttaaaatatttaatgagcatgatctttccaagtttgatgaaatctacgaagatatactgaaaaagaaacagaagagagcagaagatgagaaattagaagtctctacggtgaccaatcctaatgatagctttgttcctggactttacgtatgtggtgacaacaaaggaggtacagtgtctgattctggtagaaagcagcaactggttttaaagcgtcttgcgttttttgatggaatgctacttcgtgatgttattttgaacggcccggttggtttagccattactgagaagggtgatgtttatgaatggggctctggatttaacggaaagcaaggaaagccagaacttgtgttaaaagatgaaaatgttgtcaaagttcaagttagtaagaacatggtgtacgcgttgaacggtcgaggtgaagtgttatatttccccgcctctgtagcggataagcgtagatttgtcggggataaaggaaggaagtatttgggtctaaaatcttatgacaagaaatatagaaaactgacagatttttcagtgaaagatatagcttgtggaatagatcatattgtgatcttgtctcaagatggtcaagttttcacaagtgcaaccggaacagtacgagatacgaacaaatcatacgggcaatacggtattcctacgctgacgcaatttgatgaacctccagctcctcatgagattcatgatgttgtcctactgaataagtataaaactgatgagagagacggaaatccagtcatcaaaaagagaaagataactaaaattgctgcaggagattatcacacattggcattggacgatcttggttacgtatggtcttttggtaagaacactcatggtgagctggctaaacatgtttcctatgaaacagagattgttccagtccctaagagaattgaattgatacaaaatcattttgccaagaacgagtttcctcaatgtattgacatagcagcaggaggtcaaacttcgtatgctacttttgttacaagtgacatgtacaaattgtttgaaaaaaccattcaagagggaaataatgtcgatttagctaaattgtctcaagatcagagagactcagtgtcatactttgcatggggtcatgggctgaaaggtcagttaggtactggaagatatgtacattctgaggcagagcctaggaagatcaaagctttggagggtttcacggagttcaacgaaaaaagtaacaagttggagactaccacggtgaaagactggagcattggtgagaatcatgtggttgcaactttaagcaacaacgatgttctcgcttggggtgataacgagtttggtcaattgggtaatggaaagaaagttaaatctagtaagcccctcaatattcccaagttattagagccactcaaaactgacagagctccattgactccaacccagaaattaattgatgctgcaaataatagacttcaactaaagaccagtgatacctccactttcaagacacctaacggaaagaaaatcaaaggaacaattgagcaagttataactgccaccggaaattccactgctattttctataggagattgtagagctcatatatttatttcctgtatatatttcaactctccctccgcaagtaagatctattgcacctcgcgacatgctccttccaggtctttagattcctaacagcacacacaattcgactaggagatggtaagtgacaccacattcgacgaaggacgttccactgatgtatattaacctttagaatactttgtataatcatgtcaacaagcaggcaatctcattgagaaaggatctggcctctttggaagaaaatgtcaagggcgctccattatcactggtaggacaaataactactaccatgacattactgactaagagtttagatgaatatgaggatctgatagaaaaggaaagaaattttgaaaagaaagccaaacacgatacgagattacgaagtttcaagcgagaattgcaagaatatagagatactttccagtctcttcgaaggaaaagagatgaagcgatcagtagcacgacaaagcaacaattgtttgaccgcagggtatcccatcatggtgctagtacagctgtttcagataatccgtacagcggagttgtttcaagaggagtctctcacgataatggacctcatgaagctgaagacatgtccatgagtgaaggcctgtacaaagagaaaaatacattttctaggggtaatcagcaattggatcatattttagaaatggctggagcttcattggatgagctgattgaacaaaatgagtatatcaaacgagctcagagaaagatgacagatacactggagactttaggtgtatccaaagttacgatacgaagaattgagaagaaggcatttgaagacaagtggattttttatggtggcgctataagtgtttttgttattttctatttggcggtcaaatatttaagatgaacgggtcggttactgtgtttctttgccattaatttcgactcagtagtcctgatttttagcggtggacaatcagtcttggaaaacgttaagttgacattttgagagaagattgagcgcatttctttggttattctgaaggtaaaactatgccctcagcgatttattggtttctgggacgttcggtaacagcttgcaatagcagttacaaaatttatcccgagtggccatataggaactgggagaagcttacgtattttacgcaatgaagtagctgcccacaagggagctggctactggataatctgatacatttcttgcgtttcaagggactatttatccaagcaacgactaccctagacaaacgaatccacttggaatcaccagtacatgtcaacagcattatcgattgctattataaaggacaattcttgcatgggttgattagaacccgggcgattgatcaggaacactaactagcctgctttaacctcagtctttgaagctggtaacgggttagaacctgaaatggttgatattatgtctggtgcttatgtttttctatccaacgatagtccagggcgcatatatatattcagtcatagactcatcgatgagattttagaatcatattcaccttgatgtcctttacctttgagtaatgttttacacattgaaaccagttttcggataatacccccaaattttagaagtttgcatcaacacccaagaaactagaacccaacatgaatcttttttgacctataatccctatcgcaacaatacgtataatccagaagagaaattcaattattcaagtcaatattatttccgtccttagtggatacaaaacgttattttattgttacaatatacaagaatcgacctatttagtaatccaatttccttttcttgacggcccaagcaagaaacttagaagagtggcccagtctgggaacactcctgattcctccacccggtgcttcgttgatctcgattaactctttaatctcagtctcgttacttatctcccctgcttccatctctggatggctcctggttcttctttcaaaggactttgcaaaataatcatcacctttgggtctgcaaggtacgatcttgttcaacgaatcatctatctgaaaaatctcattgttaatcaccctgttgggtacatacactggaggacctcttttccaaattagtggaagttcatcttgcttctgcttcagctcgtcaaaagaaatcttggcagcattttgtttcttgagccttcttatctcatttgaaatatcaacccttgtgaagccttgaagggcaaactggttaaaatctgcttccacatcagcaggcatcgtgaatgctgaactagtagaaattccggaatagggtcctgtggagaacgtcaactcattataaggtgtactgactactttggatggggcatatctggaacttacttgggacatgtttaatctctgcgtcatattgctgtagttattgacaggaggagtgtaagtattagggattggtctagtgttttgatcaccatatgctgcatcagcgtaggaaggcctataccctggatagctaggggtgcctaatccgtttggttggggagtgcccaagttaaccatcttaggtgtggtttgtaagttattatagttaggtgccatatcattaggagatggactataaccactcaaattaaccctgctactactaccactcaatggggggttcggggcattattggctgacttagggatcaatttcttagttaattgaattttaggacttgaagcgtattggcaaagatcatcatccagacttggtggacctgcatacacagcccctattaaagggggagcattcagattataaattgttggttcaggcttctcattcgtaatctttgcatcttgtggcaacagatatctaataggagaataatacttggggaaatgtctcagttcaggagaagggataattggatcctcaacatgacgtacttcatcagggagacaagccttccatgtcctaattttgttaaactgtttgtcaccatcattaaaacgaaactcgcatatgaatatcggtccctccacgtcgaaatcgggatcaccacgttggtatcgggtgtagtacgcaacataacaaggtcccacaatttccgaagctctgtggtctctgtattgaccagttttgaacacttcattcttataaaatagtcggtcttctttgtgaacggtttgctcagctctataataccagcaaacatttacaaagtctgcgtctttttctttttcgtgccatattctaaatatttggcccactataggtttccttgggtcatttgggttagcgatcaaaacccaatctccaaccctgtatcttctacctttgacaaggacagagtccatgggagtctttgtcatatctccagaagttaattccttctctggtctagcaagttcaatgtcgacaatttctttcaaaccattttccaagtcattgacatccatgatcatatgacggtcgctagcgtaatacaaacgattgttctccacgatcttgtaaacatcattcaaaaatgcctcaacatcattgtactttctttgtttgatgttttgtctaatatcattaaaacacataggatctgatatgagtgagaaatagtcagaatgttgttgttctgaaggaaggcgatcaaaaagattgtagacagagcgacgagggtcctgcgatgatttcaacttcttcaaacttctcataatattctttattcgcatttcgtgcggtttatcaataattggaggtctccctctcttgtgccatgcctcgactagtgccttcttctcctgtaatgatctcaacgctgcttgcggaggatagtaagactcttgtggttgcgggataggatactgtgaatcatcattctcaagtgcgccactttcaggaattctatgaccagtaatcgtagtaaccatcagtgcctcagatggaaattgtaaagcttgtggtgcctgctgtgaaaggttgtcatggggatttgaaatcgtagcctgtcctattgggggtgtcacagcagctgaatgggctcttgttgaaggttctgatttaacatgggaggtcggaatagaagggggtggtggctgggtgatcggagtagaataattaggtccatcaggcaagggtccaagattgggataaatcacttgctcaaaccctggaagtgacgaatctcgcctaatggcgggaatcatggtctcttttatataatcttccaaaatatccgcttgtttataaatgtctgaatccttctcgttatagaacttggcattccaggtgatctgggccatatcataaatcacttcattgacattggcatatttcttcttgttcaaattgattcttaccttctgtagggacatcggtcttttgatcactttgaaataatcaaggaacgaccgtggtaacaaagctttgaaagtgtcaccaagcttctgacctctgcaagcgaacagttagtactagttccaaaaaaaaaataaaacaacagtctcatcggcctgcagaaaacgacagaaaatacttacttggaatctgtgatcccgtagacattatctaccaaaggtcttaccctctgtatcatgctttctctttccaatgcactcattgggtcttgtttttcgactcagttattttcagagatcagcgtatttcgtgtttgggttccgctgtgttgaggaagtgagatagtgtcttttggaaacggtggaaatcgcggaaaatagtcgtgtggccgcaatatattaggattgcctcctactacatggtgattacataattgcaaggttcaaacctccagatgaaccagggaagcctagccagtttccatgaatacataaccacagataagtgccgtaccatattggccctttgtggtgctggactttcggcgagttcaggactaccaactttccgggggtcaggtgggttgtggaaaaattacagttcgatggatctggctaccccagatgctttcaacgttgatccagggctagtgtggcaattctactcttatagacgctacaaagcgatccaggcaaaaccgaataacggccattacgccttgagtcaactttccaaagtggcagcctcaaagggtaagaaattcttaacattgactcagaatgtggacggtctttctagaagggcccaccatgatccagaacagcttttggagttgcatggaagcttgttcacgctcaaatgcacaagttttgactgcacatacacagagaataataattttaagcaccccttgacccctcaattgcaaggttgtgaagaggagtggatcaatcctagaaaaagacagagacgaactgagaatgaaaatgagaacgagaatgagaatgaggatggtaaagacgctgtaatttcgacaactggatctccagaattcacgccagttaaggaaattcctagaagtgggcttcccacatgccctcaatgtaagactggattattacgtcctggggttgtctggtttggagaatccctaccctttaaggtgcttgatcaagcagatcaattcattatgtcacaaaaggtggacctcatactagttatcggcaccagtcaatctgtatggcccgccgcaggctatgtgaacagagtgaaactacagggtggtaaagttgccatttttaatactgatgaagaagatcttgaagggtgtgatgggtggaagttcctgggagatgcagcggagttgctcccacaggcattaaagccactaataggggatatcacagaagtagtagaaaatgacaaagagtaaatataggtttgaagacatttcattgtacattatttagaaaacttaaaagttgatagtcttgtcaaaggtacccagagctgcttccttgaaagcctccgacaaagtaggatgagcatggcagacacgagcgatatcttctgtagaagcaccgtattctaaagcaagcccagcctcagcaatcatctcaccagcgttgggaccgatgatgtgaacacccagaacacgttgagtttcggcatcagcaaggaacttaacaaatccttcagtgtccaagttggtcttagctctagagttagcaataaatgggaatttaccaactttgtatttgataccagcctccttaagttgttgttcgttctgaccaacccaagcgacttctgggtgagtgtacataacagatggaatgtttccgtaattgacgtgaccatggcccttctttataaactctgcggcggcaataccttcttcctcagccttgtgagccaacataggaccaaaagtaacatctccaattacacgaatatgagggtgcttggtacggtattcagagtcgatgaccaaagttcctctgttgtcaaagtccaatccaattgcctcggcgttcaagccttcagtgtaaggtctacggccaacggcaactaataggacatcagcctcaaattgctcagttttaccatcctttgttgtttcaatctcaatgttcacaacttcgcctacgcgttcacccttagtgaccttggcaccacacttgaacttcaagccttgcttggtcaagaacttttgcgtactctttgcaacttcggcatccataccagcaccaatactgtcacggtattcaatgatagtgacttcagagcctactctagaccaaacagaagccatttccaaaccaatgataccaccaccaataatagccatacgctttggaacctccttcaagtccaaagctccagttgaagtcacgatacgctcctcgtcgacagtaattcctgggaatggcgaaggttcagatccagtagcaataatcacattatcagctttgagttcaactttgtcgcctccctcaacaggatcaacgttgatagtgtgttcatcaacgaaagaaccagaacccttgtaatatttgacaccgtttttcttaaacagcatttcgatacctccagtcaattgcttcacagatttctccttggcattttgcaattggccaatgtcaatttgaacatcagcaacgttgattcctctctctttagtatcgtgcttgatggtgtgataaaggtgagagttgttcaacagagacttagaagggatacaaccaacattcaaacaggttcctccaagggcccctcttttctcaatgcaagcagtatctagacccaattgtgcagccttaatggcagcgacataaccaccaggtccaccaccaatcacgacgacatcgtgtttgatggcctgagcgaggattcttgaagtgctaagaaaacgtctttgtccgaatttgagcattatgtctctttggtggtactttatattccaaaaggtctactaaatctatgactggttggactaacaaagaaagaacgagctggaagttggcaggtcgagtccgggttctccgatatggtgtaatgatgttgtgacattggtcgatcgcagtattgttgtagacatcggacaccgggatctcccggggtagtgggggtatatgctttagtgggggcagggagaggagagttgacctttgggacgtttatccaaacttcatgcactatctcgacaattaagctttttggacatgcctatattaggccatccacagatgtcataattattccatctaaacttgaacttccacgaaattgggaacgaaagcccaattcaagtgtatctcatgtttgagtggatattcgttttgcccgaaatcaactctatttcttcggtaagtgcaagaaacaaaagccttcaggaacttatgcctagatggaattgagacattatagggccagatacagttcaagcgttaagggaggagattcggggtttgctgaagccatttttgaggcatcaaacaagatattgtgcctagactcagtatttttaagttagcaggagcccaatttcgccattgccgaaaaagcttaccacacattgcgtcacccgccactccacattgaaacgttttcaaatcccatgcctatggtaataacgggtaagatccaaacttttaaaacgaaatcctcaaaaattcgatccgatgacgcaaggtaccaccatttcagtggtcgcctgtcaactgtggagatgactatgaacaagcttttttcaagcttctcttatcacagggtataaaaataggtgaatgttctgccattcttttgaaggctctaactaaatggctgaaaaatctactgatatctccttgaataggagcataaaggataactcagttgatgagagtgttcactctctggccacatctgcagctagtcaggaaaccattactatcgtgaatagggagactggtgagtctacagtaatagtaaaagattggactgatgaagaagagcagaaacttgtttggaaagtggacttcattgttctaccaatactttattttgcctttttcattttgcagctggatagaggtaatattagtaacgtgtacactgatactcatttttacaacatgttggatttgaacaacaccaagatcaatattgccagtgctctgttttctataggtattgttgtctttgaaattcccttcaatgtggttctacaaagggtaagtccttcggttttcttgagtgctcagatttttctttggagtttggttgcaaccctccaaactaagataacaaacatccaaggattttatgctaccaggtttattttgggtgccatggaggctggatttattcctggaggattatactacctcagcacttggtacaagaaatctgaacttggtttcagacatacactgtatttctttggtaaccttactgctggtgcacttagtggtcttattgcagctgggatcctgaaagatctcccaggagttaatggcctttacggatggcaatggattttccttgttgaaggtgtcacaggtcttggttatgcggtaattttttttctggctctaccggagtcgacaacctatcctgcagctttctggaacaaaaaatggttctattttgacgaaagagaaagatccattttgcgacgaagaatacttttggatgatccttccaaaattgtttcaaccagaaagaccagtcacaaggatatttggagtactttcaagaatcctgttccgtggctacatgtacttatttctttgtccatcttgcaaaccatcactgctttgggcagttatcttccattgattataaaatcgatgggttttagtgtcttcgaagctaatgctagatcttcaattccacagtgggctacgatggtgactttggtcattctgacgtatactagcaaacgtttcaaggctagaggatttacgatcttactcgttgtggtttggcagctagctgctcagatagctttgagagagctgccggccagtgcctctgctactcaaagatttgcagcactatgtttcctttatgccccaggtatggtggtgcatgtcctcaacagtgcatggttaagcgcaaatgttcgcagtccaagagaaagaagtgttgcattggccatgttgattatggctgcaaatataggaggcgtttgtggtggacagattctacgagacaatgataaaccactgtatcgtaaggggtttctttctcttatcattgtggacgcatttgcattgctagtagtggcctacactatagggttttattactacaagaataagaaagccgataaactgtacggaaaactgaaatccaaatcgttggatgatgaagagcaaactaacgtggtaaattcccttgacagaggggttgtgtatgtaggttttggacttgacgagtctgagaaggagggtctagcagttaacattcttaaaagtaattttagatttattgtatagatctaatttagtgttttctgttgagcaatcactatccatgaggtcaggataactctaactgcctgttgacagacgcggaagagttaacgatccaggcattgtacgtctactgtagaccatcgtgaaagtttaaagaacataacagttaaaaaagttctgcccgtccaggcattcataaacgtcacctggaaaaagctgaaagtaatttgtttcagtttgcagcagtgagcacagaatgcatacagtgcatcaaaatgctttctttatttcagtacacagcagtgctgggtgtcaccagactcggaatctcgtaatgtcaagtttttatctgtaacgactcgactccacaatcatgcatacgtgcttcttgcatggttatcaaaagttttcaatgatagagacgtgaagcctgctacttcaacttatacgacattatgtttttaatgctaaacccaaaatgtgaattccaggtacgtgtgccacgtcagctgagagtcattgagacttggaggtgatgatgtgcattttccaacgttgaccgacacctttggaaaatgtgggcatcctgaccatttaaagcaagtctcaagtaaaatttgaatactttagtggctgtcagttgggaccccaaagaacgttgtggctaaaaccatcgtttcagagtgtcaactgtgggttcatcacggattccaagtgtgtagttattttcaaaggacatcagaaggacaaacatatcacctccgagccgggatctgaggtaagtttagctttctcaactgtctcctgaaagaagcatatctagatccttttgctgctcaaaaaagagtgattattttcaggtatcaaagttgcgacaaaattggcccttggaagagttgaaaggttagccagcgctttagtcctctttgtccatcaaatatctgtcccagagagatttcagaatttcatgtcctttacaagagaggacgtgtttccaaggcgttggtaaccataatcactacgcctctatggcactctgctactatatatgagctatagccaccagagacagctttctttaaatgcagtctgctcgtacgcagattctattaagaagatgatctaaccccggagaatatttcaatgcagtcataaaaagatgcagaaaggcctcaaatacgtttcataataaatcctccagacttccatcatccaggaggtttatccattcaatcaccaatctgacaaactcttggggtttctcactaattacccaatgtccagcatcgtggacgtccttgatctcaaagcgaggaaagaacgcagcacatgctagcaatttttcatcactgacaaatggcgatctatcgcctctaataaacaaagcagggcctgaccaagtactggcacgagggtcaaagggaaatgctgccaccgagtccagcgattttcctatgaaatctaatccgatcttgctgtacaagccaggttctgaatttgaacattttgatttccttcgtaaattggttaataggaattgtcgaacggcaatgtcaggctccacttgagaaagttttgcgtcagcttccttggttgtctttattgcattaagtccggtttgggaaacaatttgttgaaggcaattaacatacttgccaaactggctttgaccacctgaggcgtcaacaggggcgttatcaacagaaataatagcagatggagtcgtagggtttcgaagagcaaacgccatagcagctttggcccccatagagtgaccgatcaaaataggcttctccaacttatgatctttaacaaataactctagatcacttgataatgctggataatcatgtctttcgttgtggggagagtctccatggtttctgagatctacacaatacacatctcgcttcagcattgaagctaaagttttgctgacagttctattattcatcttacttccgaatagcccatgggcaaaaataatacttggtttatcgtgctggctaccaggcgaagaatgcttctcaaatgcaagctttaccggttcgatatctttgcggtatgattccgcaaactggcccgtataggcagttccatcatacgccgaatgaaacctttttccaaatctcagaagagttctgtgggttctaagcatagaatgatggggaaagtagagttggtctcttggtagatctagcgtatccgaagtgaaatctggcgcgattatacttttctgataaaattatgtaatcaatataggtctaatggttctcctaagacaccttcgatgactccaactaagttgcttctaaccaacatctcaacctcttcatcgtcgtcctccaatagctctgcaatgagaggaatcaactgtggtagcagacttaaccagttctcaccgaccttcttgtagatcagttgcacagcttgaatagtccagtacttttctcttgacttacattcactcttcaagtgtttcagtaacaggtcattcaattgcttgttgtgctcatcggttgaacagtcttgggccaggaatgcaagggccttgaccaattgtttgccaacatcttcttcaatgtttaccaactgatcagccaatgccttggaaacagaatcatatcttgtctgtgagtgccagtattcttgttggtcgtatttgaaagaggaaatcaaggaaactaaagttgagcggcgaagtgataaatcgaccaattctccgctagagaatctccttagtaaggcgataacgtcctccaagatgtagctgtagtaagacgtgatgataccctttaaactgtcctgcattttgttgaagaacctgaagaatgccttcaaacgatcaacttcagagagagtatgaggagcattctctcctgcaaacgcccatctacccatactagcaaatattggccggaaagttttatcgttgagtttcatcacatattggataccagaactaaagagggacgcctcaattctgtttacagtgttgatctcaaacttggatcttgtgcgatactcaaaggttgcaaacaaaaacttcataaatgaagttgcttggtttatagcagatcttttgtcaattttctcgatagtgctctccatgcagtacaggaaaagtccgattgatgtggggttcagtttggatacgttactccacaacgaagtcaatgattttagtacaatagacaactccacatgagcattgatggcgtccagcacggacactctggtagattctgggacagaatcagccctgaaaatcagttccaatatttcctgaatgttaggagttaagaatgcagggattctcctgatcatgcaggagaaaagtaccaaaatagccgtttcggttagctcctttgattctgaatccaaaagttcctcttgctcttcctcatcttcatcagaatctattgatttaaaatcttcattgtcagaactaggggtctcaatgcttctaaaagtttcaaatactggggcaataatcttagggaagaatccaatcattttgacgcccacaatgttgatgatggtggaaacgcagttaatggaagaaatcaacaattcaggtgcgggctgagttaatagcttcttttcggatgtgatgatttccaaggctcttgtaaacactgaactttccaaagattcattcattttcatgaaaacaatacttaatgtgtccaatgacgcttgcgtcaattctacattagtggaagtgactatgttatcaaacaaaattggaatgagatctcgaatggtttccttaaccttttcattatcagtgttttccagttcaagcttggagccagcaagtgtagtcaaatgtctcttgatgttcagagagacattagatgtatcacctctaccaaaaatgtcagcgatcgatataacgaattgatcaataggcagcaatccaagcagatcagtcaacagtttatagtatccctgcgagatttcagtttcaggttgtatcgaagaagaatctagcaaggacaaaacttgttctaataaagctccgaaactggaaagaatattatcaatttcttcctgcctgttttgagaacaaagaacagatgcaatcttcagacgtaaactagggactgaacttccagttaagctatcgtcgttggtcaaagccttgtcaatgaaggcgattaaacatgatctcaaattgaaaagttctcctgccgttgaggaaaccaactgtgttgtaaagataggcctagatccgagttctatggcaagaggactatccttatccaaaggttgaggtggaatctgcgtccaaagtccaatgtagcccttgaaggcatctaactggtcattaggggagaagtttttcaaaaacgatgacgcaaaatttaccagagcaacagtttctggaatcttgtgtttggcaaagaaataggcatattgttgaccacaaagaagtaatatgtaatggattgaaagattgcttccaagaatgttggccaatttggtgaacaatttaactcttctatgactaggaatatgctggaaggcactgacgaagcttgagagaagaaactcaacctcatcactttgcttgttgttgtccagtttggcaagagctgggataacacttgatatggcattctctaccacatagctggaaaattcgtcatcctggcgcaaggtttgagcccccataaaagtaaaaataggcatgacggagtgtagaacaatctcaggtgataatgaagccaaagctgcaacgactagcaagaacttattctggagctgaggtgagttcgaagatctaatggtagagacaatcatatcagcacgcaaggaagatgaatccacttttgacaaatctaatttcttggcatccaacaactttacaatgttgagcatagtagaagcaagagtttcttgagcgtaaaggattggaagcttaccatccgctccaagagtctccaattcattaagaacgttgaacaacagcttcaaaagattgagagaagattcaaaccgttttgaagcggacgctttctccaagcactctagcacaatcgtgagttttttcaaatgttcggaagccacgttgaaaatttctttatctttcatagcttgcctagtagatgcagaagatcttcttcttcgcttggctacaccaccattggcttccacattctctgtggaagttttggttaagtctttcaaaatggtggtaaaaatttcgccgtttaattccagagattgcaaaagttccagaggatcgtaataaatgctaacttcaccctcttctgtatctgaataaccatcttccaaaacgtgttgcacaatgaatagcttctggtcctccttgaaagactcgaatatttgctctaatcttaataccgcctccacagataaggattggaatttggaactcagtgcactaactaagaaattgacggccaaagcagatttatcctttggtgagactaatgctaacagttggtggtctaggctgcgcacattgaaattggtaatttcacatctttcttcccatttggtcctctcagagatatactctttcatggtatcctcaaacagctgggacagtgatgcatgtttgactgaactaactccagctattacaattgaaagtaacacatatgacacttgtggtatagttatcaccttagcattagttgccacatatgtcaaaaagattgggcccagtttcttttcttttaaaatactcttggttgtggctctaaatagctgctcattatcgatcttcaaggaatcggctagattagccaattgagcaataactttgtggccgtcttctgcgctcaacatagcaacctccctagatttagatggttcgtatatctcattaaccatgaagagctccttcgatgactttgactttctcgagttcaggaacaaaattatatcgacagcagctgatctaattacttcgctttgatcagataaaacgacgagtaaaaatggcaaaagagtgtgcagagcggtcttagcaggctgtttcttgagaattttttccaactgatgtaacgaaaatattctggactttaaagggtaactttgagatatggatactcttatcagaaatgagacagcagcttcagttgatacaaatgcatttgctaaaaagtggtcaaacttattggcttcaatggaaagaaaaaatggcttcaaagcagcttcaaattgcgaatcattgctattaatgaacagataggacttcaccttctgcttctggatagactcttcatcataagaggtattcttatcctccatcgtgacgtcttctttgtcagttgcaagactgagaaaatcctgttcggagaaaagtgtacattgtaacttcatctccaatgaagaagtatccaacccattttcggaaagaacttcaacaaaaagaggttcgttgaggaagagaagaaatttgaccaaactagtgattgaaaccaggttttcaattgcagaatctgatatcaacagattggacaactcctgagagatcctttttaattgagctttactaaaacaaactgcttgaaaaactcggaactgaaatctttgacctttctataagatatcagagagcacaggtatgcggtcaaaaatcggttattgctgggattactcaaaaatagttgagacgtttcagactcactgttgaatgagtagtacttttccaacttttcgaacacatgttctgggaggatatccaaaggacgttcttgtaaagtttcataaatctttatcacagatgccagtgcttgagaagcaatatatttgttggaattgaataatatactgtcgatactggcaagaataacatctctggaaagaggggtcgcaacagacagaacagaaagcaaagcgtaagcagtcaatctcgcatcattgtttgtgctattcaataaagaaccagctgtctccaatacaataggagaaaggataacaaatctgttttgttctggggccaatgctcctatggctgaaacggacatggagagaaaaaacaccaattgtctgtcgtattcattctgtctagaaacttgcgttagcacgaattgtgcatatagcttgtagaaatctgtgtcagcaaaaaatttgatcatggatctcctgggaggattagtaccaagtttcttgaaactagccagccattcaaagaaatgtgggaagcttggaagaacatggaggatacgcttaaagactggctgatcgtagtacggcaacactgaaagcaaaagtacttctgcgttgtgaatatggatggaaaaacgacgcaacggccattcagcagcttggagagcgatattgagattccagtaaggagacaatagcgccaaaaatgcagctaccgttcggtccaaatctttattttgttcttttgattgcactaatctgtcgatagtgaccgatgtatcactgaatatcgaagctctgaacttggagaatcttgaatccaaagactccagatcatctaaggcttctacagcagtcgtgaatatagaatcataatcttgtgaggcggcatacttggggtcgtggatcaacgacacggagtgaagtttgactctgctctttctgtctacagcaagtgtctgagtcgccttggcgatcacggacagttggtcagaaagagacatggtatagacttgaaatattaagaaagaaatatttcagaaaaaaaaaattatcctagaaaaacaaaatcgcggctagaggtgttacgtaagatggatttttcactaatcatgaaatgataatacacaatgttgtttactttgtacaaatgactgaggcttgcccagctcctggtgaataattgatagggagatcgttggttgttgttattgttgctgctactgcccttttcaaactttcgcagaacaaatgaatgcttcaaatgacgtaagaaatagttgtcaagacggcctaaatgagattcactagctgtttgtaagtgtcctcattgatcacaccaattttgtataaatacttgtgtaaactctgtactaatataacaatttgatcttcggacagatttatcacaatggattgtaagatggtgccaatattgaccttattattggagataaaggtctcgtagtaaaggtaactgaaagaacccatcaaaaattgacagtccattcgatcagtgataccaccgtgaccgggaattgtgtcaccgaagtccttgactttaaaagctcttttaagacccgatgcaaagaaacctccgaatggagcaatcaatgaagcgaaggttgccagaaccatggaatggaagtaaattggcttaaaggaaacaaaatcgacttgatagtcaactctggcagccaaatccaccagaacttctggtaatttgaagatctgagggatgaaaattggattaggatcgcatgtcattccagtaaaccaattagcggacaggttgtcctccacaggacagatgaggtaagtgtattttgagaaaacataactcaagatcattgaaaaagccccagtgcagatccaagcacccacaaatccctcaacggtctttttcggcgaaatttcaatcagttgagtacgaccgaaggtgattccacacaggtaggcaaaaatatcgttgacgataaccaagcccacgggcaagaggaaccaaattaaaccattcaaaatgttgttcactatgcaatgagcctgaacgactactagtaatagggtcattgtagtgatacacaattgggcaaattggaacttgtaatagcctttggtaagactggcaacaaagaaaacaaatccgagaacgtaaaggcagtaggagataaaacggtgattgacaatgaaaaatttaaaaaactcaaacactcgttcgtaatcttcagtctgcaatttgttgattgaatggtagatcaagctttcgccatccaaaaagtaaatcgaagtgatgagaaagtaccaattcaacgacgcagtaaagggcaagttctcaatacgagccttctctgtggtgatggtgatacactctttgaaaaccaatatttgaagcaaaaccaccagcagaatggtccaaatatggcctgctccaattatgaaaaacattcctgctatcatcaccaacgtccagaaagctctgaccaggaaggcctgctttttcttttccttttcattgactacagagttgggagtgtctttcttcgaagaggtgtctgggactttcgccggagttttttccattgtgggagggatacaaaaaggcaaacggtgtcttagaaggaaatcagatttttattgtattgggagcgatttgatacgaattttggggtttcacatgggttgggcgatactacgatggtgttgggatgctaaacagttgattcgcgttcgaagttgattcttgtgggactaaacctggaaaacataaaaagaaagaatgagcgaaaaaaaaaaaacaagaataagaaacgaaaagcaaaaaaaaataaggggcgcgacctggtggggaaaaaatggggataccgagacataaccagatgaggtgggaggctgtggtttcgagagtagggtctgctggggggaaggggggcgatcttatccgataacaaatggatcagagactcttccaatgtgaatagacacaattcttagcttgctcgcttcagaactgagccttgcttgcatctcacacattctatgacttttcaagtgggttttcgccaacaatagttaacggttttttcgtcaggccagagcaaagtcccttacattgttccgctcacctaaaacccttatacttgttttcctttctttgcccgttcatttcaagtcaaatacttgtgaatatatttttcctgctagcaggaatggactttatgttttgctcttgcatactttgcggtctagtctttagataaaactaccgatgcttatcaggtgggcaaagttcagtactgaaggacttcatgtagtgcgagacaaaactaatgtaatagtgcgcccaacatgcagcctgccaagcacgtatgaagctcgtggcctagcaaccagcaccagattaccccgattggccaaaattccgtgcttgccgcttagcgatctcgacaaaagtcaacaaaggaaaaaaacccggttccatctatgcatgattggcatgacataccggattttgcccaaatcagatgatcaaaaagggtataagcattctacaagagaggaaaaaatctaccgcttcagaacatggactctgttgcaacgagaatgtcaagccttcatggcctgtctcattagcgcatcaagctctggttactggttctattgggcaagggtatagccatctccggtaacgggcaggttgcggcgtatgcagcagatctctttctctactccttattcatgtgtaataactgatcgtagtttttctgcatattctgtacgtgcacctgctaattctggttaccctggtctcacctttcaaaagtacctacactaatcttccttgacataaagacagaaggctgaactccaaaggaataatcgtgcaactttccccggaacagcgacagtctacgtcagaaactcccatatccatcaaaggaggtcagatattgttatcacctgtatccttcagtacagttcttttttgttttaggctcctccctcaagaactcagtgtcttgaactctggtgccatttccgttttgtttccatacagaagtttccaacattcagaagctcattatcccccgagttgcgatgtccaaagagaccaacttccagtttgaggatggaagtgcccccatcgctaacaacttctctcaatatgaaaactttgcctcttataatgtctcatcccttacgggccccgaggaatatgacgttcttgtcgattttaatgaagcagcgtcagcttctctaactccttttgggataggcgataataatatgttcttcccggagctcaacgtcgatcaaatcgtccccgttgccctcaacagcgactcaggaccaccaggaaggactgacactccaacacattctttgagtcgtttatccaccttatctgacattgctgaaaccaatacaactaccacgacaacgacggcactcaaaaatgctccagtgctagtaccccatagcgacactcattcaacgaacatcaccactcccagctctggtccgcccagttcttctcagtcaaggccaaactcgagacgctccagagcatcaggagaaaggctggctctactgatggctgaattcaaacgcaactcaagcccaactagtgctatacgcaaggaacttgcttttaaaactgggatgagtgaacgttcagtccgtatttggtttcagaataaaagagctaaaacccgcaagatggagaagttgcaaaaaagtgaaactactggcagtggatcttccagtgaatcaaagctctcaggaatcacacaacaacaatccattcctgatgggttctcacaagaccaagctgggagccaaatagctaacattgatgatacgcaagtcacccctacttccttagcgggtccttctcacgacatatctccagttttacctgtcagtatcaatgacagctatgctttgattgactgtaagtcaattcttattggtaaatggcaacgacacaagatgggtgtgcctaatactacccttcttgaacgaatgaccaacttgtcgccccactttttaatcggcttcatgagacacgttgatttagtgctggtgctctctaaaaagaatcacgagttaaattatttttctccggatatttcaacaaaaacaggatccttttcaggattttcttccccctatcatcaatatcatcctgctccctagttgttagtcagacagacatgactgacccgagttcacaaccatctcctcaggagaagacggatttacggctagaactaagtgcttctccaaagtttgctgttttcttctactatgacccattaacaggcgctgagaattcgaatgtttggtctatttgcgaagatttcagcgagggacaaaacgtccagagtgcccatatgggggttgacggtgaccaaactccgcatatattagttggaagtcttccaagcctgcattacctaaacaactacatcatgaactataatcagggcagtgtgcagtctactccaaatgaaatattcaacagtcaagtggatcttaatataaggcaagagccggactcaaattatcatttgttctctcctgcttctcaacaaagccaggccgcaataagtaacggcttgcaccagccagtaactggttcccgtcaacctcctcattcccaacaacagcaacaacatcaacaactgcagcagcatgtacaacaacagcaacaacaacaacaacagcaacagcaccaccagcaactacaacagcaacaacagcagcaacaacttcagcaacagcagcattcacagaaacaacatgaacaaaaaggacgaccacagcaactatcacaagatccacaaatacaacgttcgcaactatcaacgcaatcattgccaggtagtaccttcaacctaaaagatgattcagaagacttctttggtttaactaacaataccagcgttcccgatgatgaccaattcctggttagtaaggacgatttagcggaactctcaaaatccgtaaacttgactgaggtcccaaatgatttggtgacttcagacctttttgagatgcataacgcctttaacgaccaaacagacgacgcatcaatctttcttaactgaaggcttctcttagtttattttatttcttgagtgtattacatctattagagctagacaaatataagttttaatccgagtaaagtggaggatcgtctctatcgatagtgttgagtgtaatgttctcgttgtcactgctactgaagttggctatatcccaaaaatttggagggaattgggtgtcggcgttgcgggactccaggtcctcttcatcgacatctgatctttccagaagtatatccctgttaaaagtagcatatgcggggggaggtggtccagtaccttctaacggagcgaacccccacttcttgacgttagcttcaatgtagacaaacccatactggcccaagttgacatgaatcgaacaaacgctagtggcaccaattatggggtagagcttggagaatttgaagttcttgacatgtccccctatcttagactctgatagtttcttcccgttcctggtgaaaaaaatagtaccggagcgaacccgataaccaacacctatgacatctccttcctgaaaacgagggaagtgattcaaaccgttctctttattgggagggaaaggttgattgtatcgtctagacccatcggattcgtagcataaagagtatctgtgccttcctggaagtctaaaagaagggtatggagaagtagctaggccgacagatactagtgttgtaatagggtctttcagtgagtagatcttggcttcaaaataatgcacatcactcgttttgggtattggtagatttgacatgatagagacctcagatgttggatgaaaagttagttcagttttgttcaccacatctatttcttgtatggagtttgcattgggtttaaattcccaggctgaaattcctctctcctgtatgttcaatagttgggatagggccagttcggtctcatcgatcggattcagccgcaaaaaatcacgggcctggaagtagagttcttgctcgttgggaggcaatagtaggaatgctctatcgtcctcttcctgcaatatattttcatctgcaaattctcccgggttctcgtgtgaaagccttattctccttctgtttgtacaccggtaaacgaggagaagaacaacggtcagtgtgactattatggcaactgagatgagcacaataacagttatgaacgtgctgctattaaaatccttctctgctagcagagacattagacttggatgttttggaaaatggttggaattcgaatctgaggcaaattgtctcatagtatatactaatcaaacaatattagtaagagttaatgattgtggtgtgaaaatctatgatgcaaagcaaggggctttgggacttcattcaatagaagaggaggaagtcggataaatggctttgtgggtgtggttgtggtgagtaggtagtaggataaaagttgggggaaaaagtatattttttagtgaggcacagtaggtagccatgggggcctgatacagaatgtaacactcccaaggccatttttcgctcctaccagctcttcacctagcgtttccgcttaggctttcttacaagatttctgcctcttagttcacacttatcagctatgactatatcctataccaaggagaaaaaggttggtgaaggtacctatgccgtagtatatcttggtaaacagttgccatcggagagaaatattgccgttaaggaaataaaggttggtactttcaaggacggagtagatatgtctgcaatcagagaagtcaaataccttcaagaactaaaacatcagaacgtaatagaattggttgatgtatttgatgaagaagggaatataaacctggttttggaattcctgcccatggatttggaaataataatcaaagacacctccctgttgtttcaaccgggagatgtgaaatcttggatgttgatgaccttgaggggcttgcatcactgtcaccgaaatttcattctacacagagatttgaagcccaataacctactcataagcccagatggggagttgaagattgcagattttggtttggcaaggtcattaagccagcctaacgagaggctcaccagtaatgtggtaactaggtggtatagggcaccagagctattgttcggagctagacattatactgaagtcatcgatgtctgggctgtaggtatcatttttgctgaactcatgttgaggaccccttatctaccaggaaaagacgatgctgatcagttgacagtaacatttcaggcattaggtactccaacagataaaacgtggccaggagtttccacgttgcccctctacaaatccctacacgtgtaccccgagccctcaagagcagaactactcaaccgcttcggagcagcttcagaggaagcgttaaatttgatgatagctatgactaggatggatcctaacaagcgttgttccacagaggaagctttgacttgtaaatactttacggaatatccacctccaacaaagcctataaatctccccatgaaaacccagaaaaaacgagagtcggaagaagattacgaaagtaataagcgttgaattcccaagtctatctctttcattccaatagttttcttacatacttcgctattgcaaaggagctagtcaaaccaggactctcaatgcccaaaagattgataaatctagggaaatctatctcttctctgatgacaaaatcttgaaaactattgtctgatgggccgatcaacttcggtcgaataccagccataataggtgccatgtcctccaattttacacctggcaggtatttagttacttcgtgataagcagcttctaagttgctggcattcaccgccaaatcgtcaaaactgtcaacccattccaggtcaggtccaaattttatttgcccccctagatctattgtcaagtgtgttcctaaagacttgacaccaggtgttggagaaggataaattaatctgttgaccttgatggctgacgaattgtatgagaaataatttcccttcgcataatattgtttgagatgtcttttttcaggtaataacaagttcgaaatacttgccgcatgtaaaccagcactattgataacagagtcaaccgtgatagaggaattggcgtcgtccccgctagccccctcttcagtatcttcggtttcgacatgaatctggtaattgtctgacgccgagtcataatttaaacctatcacctgggtacctaagacaagatcagagttgatattctcctggaatacagaaatataataatccatcagtgaatgggctgataaaattcctgtggttgggctgttcaatacagcagtttgcacctttacggcaggttccagcctcttggccctttcaacactaatcatttcggttgggatatctaacagcttagccttggaatgcaatctctccaaatattcagcctgctgctcatcttgggcaacaatccatttcccacattgaaccacttccacgccattcggagcagcttctttgtatatcaattctttaccagaaacgcacagctgcgttttcaatgaatcttctgggtagtatagacctgcatgtattacctctgaatttctggaagatgtttctgacccataagtggagtttttctcaataattaatacacgattggacggctctttggccaactcagctccaactgctaaacccactacacccgctcctattattgcgtgtgaatagtctgagtttgtctgcctagttgaagcaaagcatctgaatgagatccgaggacttaattggcttcttagggagccaatccaacggagcattggggtagtgaagaagccgacaggaagcagaggtccttctctcgaaaagatgttgggtgttggatgtctttaatgatcatgggctgttaggtcatgtatattcaatatgtaatttatttaactagcatactcttgatcaatgtcattatcaacgtccatattaccagaaatagctaagctagactgcgcctgatcacgaagactggttatgttcgtatcttgccggactggaaccctgacagaatgagcacgcgcatacatttcttgaaagtcatatttgtcagattctggaacagaagaagcagcatcttcggcagtaccgataaaccatggatgccgcaaagtctgctccattgtaatcctgtcactagggttgactatcagcaacttagatattagatctaacgcatcgtcatgtattgtatcccagtagggagagaaaaatgcaaatctacctctcaaaatctgctctcgcatagaaggtggactcagctcttccgaaaaaggaggaaatccacaaagacagacatacaagagcacacccgtagaccacaggtcaacctgcttattgtatcgcctcgtagtattactagtcaagatttctggagcaacataagcaggagttccgcaaagtgtgtttgtgaatctcatgtcaccaataaactttgcaagaccaaagtcagcgatcttcacgacaatgtttagctcatcttcatcccacggaccagtttggatttctctatgtgattttcttggtgtgatatcaagcagaatattttcaggtttaatatcacgatgcacaatctcattggaatgcaaataattgaggccggataggagctgtttgaacagatttttagattcatcttctctcaatttgcctttcttcaccaccctattgaacaactctcctccattgactttctccaataccagatacgttgtaactgagtgttcgttcattggctctataaaagtgtggtagaacttgacaatatttggatggttaattgacatcagtaggttcatttcttgattcatctgtttattagtttcatcgttatcagaggattttcgtggatgaaagattttgactgcacatatttccccagtagttttattttgagcttctttaacttgagcataatgacctgatcctaagagcttccctaccagatacttatcgaagaaggagcctggtgaattaaactcttcatcatcgatgtatttcaagacgtaagaacaggaggctgcaaaagccacattgtctcctgacttcaaaaatctaggcttctcttttgaaacgcgttccccgttaacataagttccgttactgctgttgtcatgtaatacgaagtagaatcttgaagtctctccagaacgtatcgttttcaactctagaacacagtgctttgttgaaacgtcaggaaagtttaacgttatatcacaggaagagcttcttccaatcagtacagtttctttttgtgggacgtctatgtgaggagtatcgggttttagactagccaacttggctatgatctgagctgattgaggcttcctcttcccatgagctgagatgttgaaattctccgtcagcgacttaagcgagttagaaaaggagattctcgtgagttttgcaattgaacactacttacccgctttcgtttgagacttgcaccattaagcattcagaagtgggtatggggataggagtctaacgcgcttctcagtgttgaaaataatgtggataaatgtaggcgagacttcctggaaggaattgtggaaggaaagaggtgaagggtctttcctagaaagagcactacccgttcgggatcggtttattatatgcactatataatgctttatctagggggaacatgaccattgggcaaatacacaccatccagaatgatcctcagtgcttactaaagccctccaaacacctagttcgttggttttagtctccagatcccattctccatacagcttttcagggtctcttttttcaaaatgagaaatagaacccgtgggtgactgtaacactatttgaaccttatcgatgtcatgtttgagaccatcacaagggtactgtaatactgtaaagagagaaatctcattgtgaggaatggtgtagcattgaggtagtttgatgtaaagatcctgactcaatgacctggtggtaggatacctctcaacaaacttaaatggtctatacttgccatgatgtgtgatagggatggacatagccaaaggatgaaccatcttgtcaagacttttttggtaattcttgtatccagaatacaaattgacatatccttgcgccgttttagcggggaggaaagcttttactttgcataatcggatattatgcttccagtatacttgggccaaagtattaaactcttcgttgtccactttaaccctagcaaatatttcaatgtctactggcaattcaatttcacagtcaaaaaactcgtagtctctcattctgcaaagagcttgattgtaactatgcaagcgaagtccgcaagtaatgaatgcttggaatgccgggggcagcgagtaagctaccatggtgtcgattggtggaacgatatgctgctgttcagttgtggcaggaacatgagagtggattagttctagcggtttagccaggaagtaaaaaaaattggcctcgttagtgctatgttcattcaaatccttagccaatgggttactgacattacctagggcaatgtcgatcagcctccactccccttccacaaatacgctaatccacgaatgattgatggtaagcgagtgatcctcgccaaacaatccttccaccctgttgggtcgttttaagtgacccagcacgatgtctgttcggagatccagctcatcagccataattttgaataaccaagttaattggtaagcggagcctttctttgtgaaaaaaatatcttccatctccggtggattcctggtatccatgacgtcaaaaataagttgatcttgcaattgaaacttttccgcacaaagaacaaaaagtgcccggagtctttctagttcgttctcaaactgtggaaggattcgtctggctgcaaattcttgtggaaccgaaaatcgatccagcggtgcttgacgtatgtacttgtcgacatgatataatgggaggcaatcaattgagactttggtgtggtagatgatttcatttacattaacactggagacaaatttctggggttgaaggatcaaatagttgtcattctgcaattctctcattgatcggctggctttctgttctttagttattgaagatgaacgttgtaaatcggagatttctgagttctttaagactgattttttcatgccaacagaagtctcatctaaggattccactagctggtcatccaacgttcgaaccttctcttggtctcggaacaactttctaagaaacttaggatgtttggaaggcctacttacaaaaacaccataatccctcgtttgctgagtgttttctactaggttcaagtcatcgatggtcacttcttttcttctatcactttgggacaattcataattgctgacataattacgccttgataatgagccagctgaagttgcactattctccgagttaaataaatatgatgaaacttccgtatcagtggacattttcagtttgctggcagcactattgtaggagtaatttggtctatagctgcttgcctgtggtgcatttttaatagcaagaaaattttgctgtgaatgagaaataggtatggcatgctttggtggtgcaggaggtacttcatcgtcactatcagaattagagattgctgtatcagcttcaatggccaaatgctcaaatgaaaatgtggaattcagtctttctttggacaaagaggtgtttgtataactgtcctggcctgatatgctggattgatttgctccatgtgctagaatacctctcgatgcaacagcagtggtagggtaagatgtatttttggtgggacttttagtcatatgatgtgggatggcttcactggagtatgaagtgtgcaatttggatggaacacaagatctcactgtttgctgtttcataccattattggaagaaggctgatatgactgacttctcggaaagccttggtgagcctttactgtttcgtttggcgatggcactgtagaactagatccagacattgatgttctgggagcatctagaaacctcacatagttggagggaaacatccctttcatgcgagttctcaaagatattccataccaccattgtccagttccaaagttatggacctcaattgtatccccttcaataaacccaaggtcagaggattcttctcctgtccaagaatacacggccttcactcgacatggtaattgtcgttctctggtagttgaggacatcaatagagaggagtaaaggttgggtgctggatggaatgttcctttttcttttctctatttcaagcaagcttggtgatgaatctacctgagatattcttcgtttaattagtactaagaagtaatctctagtgagcccttagacgcagatcattatggattgtttaccattgcctaattgggacatgtaattgatagttttttttgcaatgcatggtatttcaggttcggtgaggtttgcctattatttgccattacgaagggaagtagatcgtaggattgtgaagcagtcagggagttgcaatccctgagctacggagtgtaagggcagtgtgaatcaactacttttaagttaataaaaaaaagtgaggaatacaatgctgaacgagctttaaaaaagaaggtcgtacccggattcgaaccggggttgtttggatcagaaccaaaagtgataaccactacactatacaaccaaatcttctattccttaccattagacggttagtaagcctaatagtacaagtatggtaagtgttattttacgatagtctttgaccacagatcaaaatttaatactctcattgtaattctgtagtgtagtcaactttgtgacttctcacttcccaaagtaaaaaaaaagtattgttttctattaccagaatatagcttccctagagccaatcctctcatgtgagatgttaaaatgctcaggaaaatcctcagcaaataaaaaatagagctttttaatccaattgagctagaaacacactctaaggtaatgcgagccttttgacccacacagagcagaataaatgaaaggaaatagtagctaataaaaatttaaaaagttaagcccaacgcggggcttgaacccgcaaccttgtgattaagagtcacacgctctaccgattgagctagccaggcttttgttgttccaggatttggattgaaataagatatacacattgtgagttctactttcgacaacttccttcatatctgatttccagtctaacatacaataaagaatcaatcgaacctatgttgccgtggtggtacattttctttggaagccttactatttttcttccccgtgtttgcatttcgagaacatatttcaggttgattgtataaactaccatcactataaacagttaatgttccatggcattcggataggagactttgtgattttctcatttttagtctgtttccgtgtgtggaacgctttatctatcaaaaccttctttcaagctgacgaatattggcaaactttagaacctgctcactggcttgtgtttggttatggatacttgacatgggagtggacaattcaacttcgaagctttgtctatccgtcactttttgttcctgtctactggctgtgcgaccactatgatgcttcatattggtggatcttgaacggtccaaaaatccttcagggatttatgtgtgctgtcggggaatactacctgttcaaattgactcaaaaattgtttaaagatgtgaattttgccaaattggtcttggtattaagtgtcttgtctccattcaattactactgttatacgaggacgttttccaactcttttgagacagttttaaccgtcatcgccatgtactattggccgtctgagctaacattcctttctgttaatgagttcaacatcggccagtttatatccgcgttattggtcgcaggaatatcttgcttctctagaccaactagtgcaataatatggtcgtacatgggctccgttctgctttacagaagtatttactcgtttaagttggccggaattatctgcatcactgcgtttggatgtatgcttgttgctacaatactcaacaccattatggactacttttttttcaaccaaatttgcttccctctttacaattttgttcaattcaactttgtcaaaggtctggcttccttctacggtgcttccaactggatgttctatattgtacaaggtataccaatcatcatgttaacaaatttgccattttttatagtcggactggctacatataagacaaaaactacccacagaaacgttcaaatattgaatcatttactcatcatgggaggaatatatttgctcatattttcttgtatcgtccacaaggagttccggttcatatatcccctcaaaccattcatgctaatattcactgcattaggcgttcagcattccttaaattccaaatttgaaagaaccacaaaaatagtcataccattgttgattgctctgagtgcctttcttgcatattatttcactcaaatccatgaatcaggggtcattgaaataacagagcttttaagaaatgcaattttaacgaacaagtctctccacaatcccacctcagtaggattcttcactccctgtcattcgacaccatttcagtctcatttccatttgtccccaaaagaggcagacatttggtttttaacttgtgaaccccctcttcatctttcagacactgtactgttggcacactatagggacgagagtgatgagttctatgacgattttgaaaaattcatgctggaaaattttgatcccatcagtgactaccataataagctttctcaagttagaaactcaccagaaaattcgacagggaattacccccaccaatggccagattatttagtcatctttgagcatctagaggctactatggatacatggttggcagatactgcctacactaaatggaaccgattattcaactcaagattccattgggatcaccgaagaacaggggacttaatcatatataaacaaaatacgtaacgatgattaaaacaaatgatgatgcggcttaattttacatccacagctagctttgatgattagatcagtaggaacgattatatccaacgatcgttcacggatgatttcttccttggttttaactatgttaacatctctatccgattctgttatttttggcggatatacgatcggtttggctccgctttcagtaaccaacacattatggcgcgcacttagatcctccaggaagtgatgaagatgcggcggggaatgtttagaagcttcggtattgctatctggatggttttcattattaacctcagaataatccagattgacattagcttcagaaggaggttcaaaatggacatcggggccaggggcgttgttcgggaaagttcctggaactgcttcaattgcatcgtcaggagtgctgcccaacacagtctccgcaatctttcttgaatttgtatctggaaccacttgaggaataccttcaggtactttatctttggcttcggagtctgcttcttcagtttcaacttcttcagtttcaggaatttcctccaaagaaagatttgggagctgctgacccaaaatttcaccatttgaaagctcaactttgctttcagctgggcttacagctttcggttgctttattacatgatgagcctcctcttcaaactcggctgcctcttggatgtcttcttctttgattttttgatttaaatccataccacctgcaccaacatccagcattgacttgaccggggtcttaatcatgctcgactggctggaagtccgagacatctgggctgaagtagatcggtgcattgtagagttactacgagaaggattctgagagctatcggacctaaccctgtagtctaactcagttctttcatcttccgtttcccattcggtatcagagtagtcagtgaagtcatcgtggtgaacaaaattgcaaaagtgcttgccctcttttatgcaaacttctagttgctggaaccagggatccttgaatagagcaggcaatgtgtatcgtgtttccggatcttcatcacatagtctccatgcacatcgagatgcacctgtagatttaaactctttggcatatttgaattcagtcccaggacctttggttactccaccaaacttgaatgacggattggaagataaataagtcgagtttgcagtaagatactctctgaattgcaaattcttcctcgatgcagctgaaaagggtgtcccttggtaaacaacacaaaaaagcatcattcccagtgcccaatgatccatcttgaatgggttgtagggcacttttctgtttacatggtcctttaaatccatcacttctggaggggaataaggagcagatccaacaaatgcagtagaaaacttgattggggaagtgaaatctcctgggatttcatgaccataatcagcaacaccaaaatctgtaatctttaccactcctttagaatcaatcaatacattttctggtttgatatctctatgcacgatatcactttcatgaagattattgatgccaaaagctaattgtttaaacaagcaaaacttttcattcaaaggaacagatttccagttgggtttacgaataaagtcgaacaaatcaccacctttgcagtactctaaaataaatccccagcctctcgtaaaacttgttgatgagggtatctttactagagcatagcacctgacgacatgtagacatgaatctaagttcttggttataatatattccttggcagctcttttatagaattcttcagaagtttcattcttgaacaattggaactttttcaaggcataaactttgctattctgcttgccaaggatagttctcactgtagcagaggcaccggagcctaaactcttgtctttcttggagttcttttctggtagagtatactcctctagaatattcacgttaagctgatgtaactcagaaggtaaatgcatattgggattctcaacaggcaaaggcaacaacctactatcttcagattccgacccacttccattcaagtagaaagagttcgatttcgaagcgagctgctgggatggagttttgatgagaccatatggattatactgaatagagtccttacgggttaaagtagcagaacttgctggacgacttaaaggttgttgtttttgaggtctaggagctgcaatcccatttctcatggctgccaattcatcggcttttttcttagaagagttcaattctccatgagttgttgccctcataggtgtcggggcaaccggagtaggggcatgttcactcttgttcttgatatgtaaaagcgttgcagctctgcttctaatcttgtggtgtccttctttctcggatacttctccatgatgactttcagatttgtgcaacaatctggagatcttgctcattttcttctctttagtatctttgtctttgtctttgtccctctcctgtgaagtaataggagagttctgcgacttgcgcagaaacgatggtgtacgggaaactgagggaggatttgacttgatgtcactagttaaggaaaccatggttcaaatctgataattgggtacctggcagtgaaagttggagcttttcttagaattgcaaagtgttaaatgatcttctttgaaaccaggtgggtctcatataccgagtcgattgtctatgaaaaccgctgaaagatgaatatcgaatgcgcttttggtactaaaagtggatttttggaatggctgctaaaatatgtcaagtctgactgtatcagcttttttttttcttgaggagattcggcagataatccaaagtgaagggcgaacgtgtccagggcgagaaccaaacaccattgatgaagacacgactatctggggcattggataggtagtcgaaggaaggtctaagagctaacacttctttcttattagatagaattgtgagttttggaactgactgcctaacagttgaaaaaccttaagatgtcaagtgatagcttggctacaacgtccgaaatggataagaccaaatttatgttttcttcggctgtgttgttccccaattcagaagaagcatcggatatttctaaagctcaaaccgacctttattcctatctctttcaagtattcaaatacctagaatacaagaattccatgaatatcacagatttagactttctgatgggtcaaatacacgagactgttggttatttcaccaaaaattacagctcagacacagatactattgaaattttgcaggtgcaatcaatgaggcttttaggtaaggtatacaccaaattatttgcccattatatggaaaatagcagtgataaagtttcaataggtttaattgagttaacaaatcgttgtttggatccactgaccgacgggttaaagaaattgtccatgagatctaattggtactcaaccatcaaacatctcaacattgttattttgcaactgttgttcagcaagtttaaaggctttttgaatagtttcaaaagtactacgttgacgactttgtataaatatttgaaaaaatgcacggacaactataatagttcggtcgaaaactcgactttcaaagccaattacttcaatgacatgatgctgttaattgatattattctaatgaatgattccagtggaactaacattttagattcaaaattgtacaatagacttttgaagatatctaaaattgttaccactaagaagccgaacattgacaacttcctggtgaaagaaggctatgtatatcccattcaaagtgtgacatttgccaataattttttggtgtcattactgaaatctgacaagtttgtcctatcgataaagtctaaaaaagacagctcaaaagacggatcgctgtatttgcaggcactagccccacatttatccattctacgtgaagcctcgagctccaattatgcccatttaagacttgcatcctctaagaacatcgctgacttgctatgtttttactatatcacttttgtcatccctaacaaatccagcgatatttcttcaaattcattgagcgcatgtttgaacgttatattcgacgcttacacagccatatcttccgatataaggacaaaagttagccagttggaagtgtttgttcagttcatatccagcctcaatatttatcacaggaccaaggttgtttcgtccgatggaataaattttgtggcatctacctcgtacgctattatcaactttattttgaataaattgttcctctctacgccttcagtttcaaaagatggaagcaaactgaacgttgtgatcaatgaaaaatctgattacaacgatgcattaatgactcttactcacttgggttatgtttatgatgctatcatagcacaaatcgactgtgatgcaaattgcctgcttcttcttactcggttggtctctaatgaggccctgtttgccacaagtaatgtttacctcctttgcactttactggatttcgtgaagaagtctattgtaagcttggatcaatttgtgctgtctcaccaagaactcgagggatctgaatctttcgatttagtgaagttgctctctgaaaagttgtataaactctccgacagtaccaacttctacgttagagtttccgcctgcgaaaccttactaaagctgatacagatcaaacctgagttatcttttgacattttgaacacatcttttgaacaattatcaacatcattagaaagtaatgagaacgaaggcagcttgatcttaaatgagaatcatggaagagcttttatcatatcgaccatcctaactaatctcagagaaaaagactacattagcacggattttgttctaaagacactatcactagcattaggatacttgaaaaattttaactcctctgttgtcgtcaataatatttttggttcaagctctgcatcttttatttcagattttggctatgaaaggcaactcgtaagttggattttgatgatcggactgttcaattatgcatcaaatggctctgatacgcagagtaatatgctgttgttggataactccaactatatgtctttctggaagaatctcttggcccacaatattccctccaattttgtcaagattgattctacaaacaaaatcacaaaccttaacgaaattaaaaaactattggagataaaaaatttggcattgacatctttattggcctatattacttttttaacttcgtgcaaggctaccgatgctattcataacctgaaaaattccgatgagacaacattattgtctccagacctgtctaagaaaataaacatgatccttaacaaaagcttcacgtttatcacttatcttgaaacccaactgtatgattttgttctggactcccatgtgaagcagcaaatcattttaaacaagctaagaattctacaaagctattgcaagctacttcctttcctaaatataagaaatgaatttaactcatcgattatgcttcaaatcgtcaagaatttcagtgattcaagtctctacgactatgaactaaatttgagcgagttcaacagtgtaaaagatctcaaaagggcaactaaagttggagctgaattcgatgaattatcaatttttcgcatgaatgacggattaacatttggcctgactagcaagctcaatagatttcaagtcgaagatttgatggttaaagctactcaatttgcaaatatatctgctgacaacgaagtcgatttcaagcgactgaacatcaagtcgtccttagaatcaagaaacgttaaaagctttttcaatccgcttactgtatttgatgaaacatttgagacttttgtctatagaccaattcaccacagtcttttgaacgattatctcttgctcttatacaacggatctgaaaatatcggctattcagagagcgagcaatatgctcccagtgttgacaccatggtggtagatgtttctattgagctcttcgcatctatctttccttctttgagtttcaagattcagcagtcagttttggattctttgagcagtcagctgagaattgagggtagcaagatttctccaaggaagagggttgtctatttcaatacagctgtcaccttgcattcgatgttgtcatacgctgagaagaataaattgctgttaccgttaacaactgtttgctctatcgttgaatgcattaagacactcaacaagctaacgtcttcacttgtttttttgaactctgaatcggttggattggcatgcggtgctctggagcgaacaactgaaaataccaaattcatactagaacaagtggacatcattgtcaattcgattgtacaagacaataatcccattgcaaggtcatttgctgttctttcactgtcaaccattttcaagcacaataattttatcaatgcaaaagggatcctcgatgttgtgtacactttggtgatggacccacatcccggtttgaggcaggcatctatagatgcgctaataaatattttggagagctatccccaactggagttgaatattaactttgtgaaaatggctatatccaaattactgcttatctgggtgaaggatgaccttgcagatagctgtagttcgaccatattttctaacctcagtttcacgctcatcaataacccttatccctcttcgataaagctgctaagaactataatcaatgtgttgggtcctaacatttcttccttgaacgcccagatccaagaattggttcagcaattaattttgagctttatgtatttcacaacttatgactacgcccatatctctcaggagatgctgatattgctggaagaactgtctatatatgacaaacagctcatcgaaggatttgtttatgttaaattcctgaagtttgttttggtaaacaatttcatggttggtgtttataacttcaactcggttacactcactctcgatgataatgaagatttaaataccaactcagaactttatccagtgtccacgagtttgagggtttggaaactggctatttactctacccttcagttttacaaacttcatatcaataacttagagtcttctagaaagttgattgattccaagttcaaaaatttgataattattgcattagaaaattcaccggaaaattcttctttgcagtctctatttcaactttggttccacaatggcttaagcttttacggggagaatgaggcaatgtcacagaagcagatgtggtttgaaaagctttttgagctgtttcatatgactaagacggaactgcagaatgaacttttggagattttccggaaaaggataaaaaatgctggggtctactatgagtcaaagaatgtagctttgaggggcaagagaacaggtcaaattttggcgaagaactcttctttgagtcgcctttcaacgaacactgaaattagcgacgataatgatgaagaagaacaaaatgatgataacgagactgatgatgaggaagaagcccaagaggctctagctggtacaggaaatacagaggaagcacccaaagattctactcttggttccaagagattgatggactcaggggatgagtctctaaacattattgaagacgaggatacaaactggaaattcaagcattttatactgaagcagtttattgtttttatttcgttggcacgaaatgatagtagactgaagacatttttggctcaaagaatatccgatgtgatgagaatttcttttgttgcatctacttccaatatcatgaacctgagattgacaggaatgtcattgttgggtgatatcattgacatttttgcatcattcaaagaccctctttatcccgaaatgtccatattagaccagcaacaggctcaattgataagttcaattgttcccgcttttagctctgattcttgtgttccattggcatgcgatgctgttatcattgcaagcaagcttataagttgtaatattttgcctgtatccaggcttcagcgaatcactcgagtcctgactacagctttggaagacttttcaacttttgatcccaatgctggtgaaactcaagggcatataaagatcgggtccgttctgatacccagcgccaaaacgcaactcaaaatgaagcttgctgtccttaatgcttgggcacatctgaaaattaatttgcaatcagacgacgttgaactttcggagctgatatcaaagtatattgacattttagttcctatgtggatatattcattgagagagtactctctattggcctatggatcaaagtttacttctgatagccatcaagcctcaagcaagttgttgtacgaggagtcgtggcctaacttcttggaggtaatcggaattgttgtgcacgaagaccagtctgttcttttggattttctcggggacgattcagagaactttttgttcgtaatttttgcagagggtatagaaaccctggtgaaaggttcggccaatgcctccactccaaatcaacctctgtctccagaatgcgttaaggtactaagaagtttccaccacattttcaagttgaagccgttatcggctttacttgctaacgattccgttttcatcgaattcattgatttattctacagattgttacttattttaaaccacgaatcgaaggttttaatcttagatgttcttgaaagtattaatctggattcgttccacgatcctgacaagctattcgaactattgagattgagctatttacctgttattcaaattcttccgtttgtgtcagagaagactatagaaagagagaaacttggaccattttctgataaggatctgactttgttgaaaaaatcatttagcttgcttcataagttaatcagccatcttcccgaaatgatccaaattgatttgctatcttcaatgttatatgttataagcttatgcttcgagttgaacaatacagatatcatttcagtcactttgccattactaaagctggtagtagtatcactgaattcgaaaggaagatcggatattttgatcaagttctacaatgagataaaacctggcctgttgagcaacaaacactcaactctgataagaatgattttactgtcggcggaaggcaccttttttttcaccaacgaggactgtgaggtgtttgcacaagatttgtgtaaaagtttgatctccaagcaacaactaacctttacgacacagtttgttagaaatgtcgtcaaacaagcaacagctggaaacgttgatggtgctaaaaacattgtgcgcaagttgcttcctgcattgataagcttgctgaagaataacttgagaaaaaacgactcagacaaaattgaagatcctagactgattcttgagattttcattgtcttcaccaagcaactgacagacgaagacaatttgaaatcagcattgggtctgactttgccgttgatactctgggtggacgataaggttggagatgacgatgtgaaagtaagaaactactgccattctaagctattggatttaatacaatttaacccggccttatttaaggatttggtcaacacgttgagtgaagaagagaaagaaaagactgaaaaattagtcaagttacgagtcaacaatgactggtcttccgatacggacgaacaagaaagtcacattgagttgaaacagtttggttgagcgtattgaaacatatgtacaattcctaatattttaactacttttctttttcaatagacagtaatgctggtatctcagatttgtcttcatttttctgtggaagcgttttggaagataaaggattcttcccaggcctctgctgtgatcctgatctatgaacttatcacagtgtaccaaggaccaatcatctaataaaactgcgggatcttgatctgagtaggatggggccaatattgctatttctttttgttcagaatccacagctttggaaatgtcaacgtaaaaatcacactcctcaaaggggatgaccttgtcggattcaaaaagatttttgttattatacagttctcttggtatattagacatggaagaaagccttgaaacggattcgtcaaaatcacctggtaacatcccactaaagcctgacctaacaaagcgtagacgcatagaaggaggtaggaaaaatgaagaaggatagtgataccattctctaccaacacatacattttttggagtatctgaagcaaactggtccagatgttgatagacaaataacggagcactataatgcgaaataagagcaaaaactcttaagacggagataacaacaataaatgatgaaaacaagatgataatcgtgagattaattgctttgtgaagaacccttttgtttggaataaatacagttgataataatgatggaattcgaatcaattgatgagtagcaaatgcagcacccaaagtgataagtggataaatggggtaaagaaacctttcctctttgtgtggttgggtaaaaaatatgacagaccaaaggtatagtggggcaaacaaagttataagtttattagaaccgccctcatgcccaaaaagtttaacattggaactcctcaaattgaaatcggggagaaagttaaatattagcagcaagggcaaacttgcatatcccaacaatgctaagaaattgaagtttagcagcaaattgaggatgtagtatgagactggctcagtgccaaaaatatcaggaccaacagagtcatcggtattcaagacgttgtaaagaacaatgttaagaggaattaattctgttttgttgtaacatattgagtcaatttggaccacatatgcaaggataagaaggactatgaacacgcttagagcgccaataacagccaattgatgcaattccttgtagtaaacttttcgaacaaaaatggtgatagcaaagggcagagccaaagctaatgcgaaaggccatcctagtaatccacccactgtgtaccaaaaaactgcctttgctactatcaaatattgactggagttgttgagagagttggctagttgttgtttgtgagctggtgagatggcagcagtctctctgattgtgcgcattaatgttggtaattgtaggtaatcaatgacgtatctaatggcaaaagtgtgacaaaccatagcaaaagaggatggtaataaggctatcgtgctatgagacattcctggagcaacggttgtaaatagaaggtaccagaaactgatcttactgctgacatttttcttcaaactatggtacaacttgacttctgcaaccaatgaaaaaataaccagcagtagtctgaaaaagtagaaaaagtagtaagaagggatatccaggaacaatggtggatagcctgctatccaaagtggcactagataggaccaagatcggatggcatactctggagaatactcccaagtctgttttccaaaccctctaagcatgaagttgagtggctcccagtagttgaacacttcatcacagtctgaaataataccatagaaggttgatatcagtctcagatagaaaaggccaaacaacaagagcctgttggagaacatgtatgttggttactgtaaaaggaagaatcgagcgacggaaggccaccggagaggaggttagtgggaaccgttgggcgggtgattgaaacaacaatgaataaaatgaataaaatgaaatgaacggggaattagtccaacagtctacaaatggtatcagcgtaacgagtagttgtagtgaatcgattgtggtcaatgtgatcgacactcctcagctccatatcgaaactttatgcatgaacaccattaatggacaataaaaataatatattgctctagtcttaataaataaatacttcatttggtctcctcctcatcaggcccaaacctgttacgtgagtttgcgtacatcagtccgctgtccctgtcaatgtgtttaccgaataacaccgtttgaggaggatggaaaatatctttgttggagtaagttgatttgacctcccaccatgggacgtccttcatgatttctccctctctcttgtagtaggcaaacgttcttctaactacattcctgtcctgttcggcttgcagtagaggcatcaaatgagctctggcccacagcttttctcttttcaattcgatcttctctctgtttgctaaggaaatctgatagaaaccgtatccggtagcggtacagaggccaagaaaccaaataacaggcctgaaaccacgtgagggtaaatttctcttccactggatgggtgcatacccggagatgggtggtaagtcttgggtagccatatcgttagttgtggttctggatttgaccaatggagtttttgtttttcgagagtggtagttaattgagcgatgttaaatggcggatgttgaagacgatggtactgtaccttatcagattccaccttattgagagattgttcgcgcaaaataggcacctttctctctattttaccgattatggctaccaagattgactcaaaggagtcagctgttggactattagcggcctatgacacttttctctttgactgcgacggtgtgctatggttaggtgatcatttgctgccccacgtcgtcgaaactttggaacttttgcgatctttgaagaaaaaagtgatatttgtcactaacaattccacgaaatctcgaagacaatacactgccaagttcgccaaattcggattaaatgtcacagaggaggaaatattcgggtctgcatacgcttcagctgtttacttgtcgaccattgtggctcttcctaaagagcgtaaagtttgggttctgggccagtcgggaatagaggacgagctgcatcagctcggttatgaaactctgggtggatctgacccggaattagatagagagttcaactccgagtctccactattgaacgttgatcctactgtcggagctgttgtagctggtttagatatcaaggtcaactactacagattggctgctacacttcaatacttgagagatccaaaggtagagtttgtggctacaaacattgattccacttacccacaaaagggcagagttttgcctggggcagggtcaattgttgagtctgctgcttgtgcttcgggaagacagcccgttgcttgtgggaaacccagccaagggatgatggcagcaattaaagctgttcatcagtttgatcccagtaaagcaattatggtaggcgaccggctgaatactgacatgaagtttggaagagatggagggctggccacattattggtcttaacaggaattgaaaccaaggaaggtctagactctttggctcccaatttgaaacctacattctatgctgagaagctaggggacctgtttttgcatagcaaataatgtgaataatttatagaatgcatctactatgcagaagatagttttagaaacgccacaatgcatttgtaagtaggtctcccaaccagtccaagggagggctccctcacaggtgccgcatctccccccacgtcaccctcgcgaagcttccgatagcgtggaataacccccccttcgattcctagacatctttcaataaatccaactaataatggctaacgacatatcagtattagaggactcggagttgatcaacctcaacatctttacggaattgctagtcatggacgaagatgaagaggatttttcccaagggttgatcaccacttttgttgaacaggctacggcaatctttcaacagatagaagaggcattggcaaatcccacaaagactgaccaagacttggttaatttgggaaacctgggtcactatcttaaaggctcagctgctgccttgggtctgagcaaaatccagtatgagtgtgagaaaatacaaaactttggagccaagactccattggatggcatagggccgaagtcattgacgggcactccagaggagatcaatgaaagctggtgtcaatgtattcaggactctttggaaaatgctaaggaatattttggacagacaagaaagctattggcgcagtattatggagtaggtatctagaacaagtatcataatttattacttatatactacacacgttattcttcatcttgtttctttgtttcagcaacgacgttggagtccagtatctggtacgtgacaatgagggccatagcgacaaacccgaaacctacagcgattgaattgagctgagtatccgtgatcattattgtggttgtggttggtgaggtggagtttaagaagagattgacggattctcaaaagagttcgagggctctattctcttacctccttccctgaaaggggatcgtttgtctttctggtttgttgcgctgaaagggcctcgcgaaactatgccctagaattcttgtctggatttagacggccgctctttcttaccattcaatgagggctcctaaaagtttggaggacatcctttttgagaaggtaggtacattcttcgtcataataagaataaggcatccatttctaacacccagcttatgcaaagtgtagcatttcaccgattcgtacggtccatacatgccaaaataaacggtttacctcccccacatgtccaggacagaatgcaatacaaaatgaatcatatgaatcagtacgactatcttttccatccaacatcatatcaaaagttcaaggcttggagcattcttttcggtcaggaactgcgcaaaacattccgcatataaagccaatgcattcgaatatcaacttactcagaaggcggttgatactatgctatcctttgttggtttcttaaaactctttttattgaccatggtaacatcgtcagttgttgccaaaatgatatccttatctgtgccaaacttgaagttgtcagctatgacctttgagtcatatttctttatcaagtatggatgactatctcccttttgcagtttccgtaacgaccaagatacaagataaggtccagttgatgagacaatagtttgtgctttactatccaatccgttgttgaaatgggctttggtgaaactcaggcctgctcctgtctgcatctttatgaatgccacatgttcaggagctagttgcaaaatcttggggtggggtttattatccttcccataggacttggtgtaatagctcccagaattatcacccttcactttagtatccactagcaatagatatgtcttgcatgtagctaaaatccagcgtccgtcgttgcttaggtcaataccaataattggctcacccaatccaggtaattgtgtctttgcattgattccaacccgattatatagccgaatttctccagtggcactacccactgcaacataaccattttcggtcgtggccaaggcagtgaacttggggttctttctgtatacattgaattcacttttcaccaatttatcacccgacagacgaggatcaagtttgaacatggattcctctgaaacacccaagaaggttggctctcctgagatcgtggcatatttagtagttggtccaaagtcttccagatctaaatcctccctacctctccattcttcaacgacttttccgtattcaagatccatcttgtataatgtatcttgctgagtagggtcttggatgatcatagctttatccccttcatgaagcatcatcttctgaggagctaattctttgcctttgattgttttcaagttttcaatagctgtgtaaaattggagaccatcgtccgtagtcttgaaaacacctaacttatcacctcttgaaacgtaagaccgatcgtttttaataccgacttttaattctttattaatgttgtgtagattagcccttttgggttgcttcttcaaagatgggtcataatcattataatcctggtcatcatcagaaaatcctttaacctcacggcgtcttatactagtacctgctctatcagtatcactttcgtcttctgattcatattcttctgactcatctctctcttcatctttctcgtcttcttcagaagagtctatgtccattgcttgaaatgcctcgatcatgtaatctttatcagcattttgctttggcaaccattcggactggtttaatgtttcccacaaatatttcatcagctgtgattggaattgggacaggtcatcgtaagaccgaaacttgattaaccacgaagcaggtttggatgagcttaggtcagagaaaataaatgaagtatgttcaaagttaaaaactgggttcaaatcggaatcaatctttatcaataaatcagtattctttacgttcaaatagtacgtgaaagctttaggagacacaatcctcacaatggcatcggcagctttcaatttaaaaacagaatcattcggatcgtagagtctcaaatctcctgttacagtgtacaactcgtttcctttcaagatttgagagttgaagaactcctcatcatcgtcgattacatcatgaaattcttcttcgtcatcttcgtccttctcttgattctcagaagcaccttttgcatcatcagattcaaacgcagtttcatgtttcacaataaattctttcaaagagtctagagaaaccgttgaagaatcttttttgtactttctttcatattgacatttatagagagtctgcatgaactgatcaaccaacgtttcgtctacactttcatcgcagataaaatgaaacttgtccccaggatcgccattcagatcattccatgtaatctgccaggaattgtcttcataaagcttatcaaactgcaaattctggtcaataagaaaggaccattcttcattgttcacatcttccaactccgaatagtcattcccagtaagctcctcatcgtcactcaaatcattaccttcttcataagccttgttgagtactagctggtaattgtggagaagtgacgtgcgccgaatagatgccacaacatcgttgtacaagcactcagactctccctttggagactggatggatctgaccaaaaagagttttcccaagggtatcatgataagttcgtctctgggagacgaaccaaaaaactttttgatgatgttcatgtagtagctgattagagtagtcttaactaagtcgactttgtttggtgctgttacaaagataccaaaactttagatgtcgatcatgtgacgtctccaatgggaaaaacaaaataattataaagatcagaagagactaaaaataaaacgtttctctgcttgtgactcttaatgattttgagcaagctgtcgtttagacacgtcaaatcaaggattagccagccgtatgttaacattagtgtattgaggccttattcctccaaaaagagtgcaaacaaatggattttaccaaacttgacaaaacttaacgaaactaaggaacacacagtgacaaaacagaaaagaataacgaaaagtggtttagacgaatcagacagagagcttttagtgtccttgaactctggacctcgtatgcatgctgattggaggaaaatgaaaacgcttccggaatggaaaaggcaaaagtttgcacttgtggaaaagctgcaagggtccaagtggaaccccaaaaagaagttgagcagagatacaatcgaaggaattcgtttacttaaagagaagctacccgagttgaaagctgattactttgccgaacagtttcaagtttcacctgaagcagtgaggagaatcttgaaatctcgatgggagccaactttggaggaacgggaaaacatagaggaacgatggaaaaggaggggagttaagcatctacaattgaaaattaaagaacaattattaaagacagttaaagaaaagggggaaaaatccgaggacgaccggaaaacaattgaaagcgagtttgaagatgatgtcattgttaataaataatcttgtgtcccaaaagcttggaaaggccgaactaggagcaaaactattgccttgtatataataaacaactgatagtcatcaattggtttctctggttttggctatttcctgccatgtttcgtagttcttagaaaggaagtcctgtatctgtctattgaagtggttgatcaattgcagaatctcctttttaaaccagatatggaaagattccaattctttgataacttgaatattgatgtatctgttatcgtctttgataaggcgttgttgtatttccaattgcataattctcaatttgcagtcatggatctctttatgacgagtctcctcaatattatggtccgtcagagacactaaaactttattcagttttttcaatccaggaattttccatgaccgagattccctcaaagacttgtttattgatgcggccaaatctgcctccgtaggggagtcactcgtaccatgatgggtcgtttttggatcatcagatggctgagcttcttgatccaaatgcattttacttccatcaacttcattgttggtagtggcagcaaaatttgccacggacgcttccagcgtagaatgatctttgtcctgttgtaaaagagagttcaagctggctcttttggattctagtttgtctgtgatatatttgagttgactaaatttattgcgattgaaatccatcaattgttttattactttgataaaattcttcagctcaatcatcttgtctaagaattgcaagtttagtatgctagtgagaacactaaggttgaaaaagttgctatcgaacactcttcctatgtgttccagaaatacattgtcttgcagtagggatagtgaattgaactggattcctaattccttggaatccaaagagttttcgttggaggcttgcaaaattcttcggtttaatctgataatattattgagtatgatttcatattggctgaaatgtgcacgatattgaaggaaaagtttcatttgctcacgctcgtcttcattctcataaacatctagcgacgtaggttcaaagttgccggcgttattaatgtttatgttaagtaaattgtggggtacaggtagtgtcaagtacatatcatcatgaagtgacgccattgggtctcttggagatagtctatagatagagcacgactgcaaaccatctatactattgagataatcatggaaacttgaattgggatccaaaaaggaaacaaaaatagggcaatgtcgtatttcgtcattctctagacagcgattgagaaacacttccagcagtcttcttcgctgttcaataaagtttttcgaatttgatccaaagtttaatgagatcatttcagtcccgcctgagttgctggagtcggttgtgtcattgattgctgaatgggtgggtaaggattgatatgttccacttatgaccgaagcaatggagcttgtggccaggttagattttaaagactgtttcttgggaacaggcggtataatcttagtgggaagagatttgactagcatattcctgaggagttgaaattcactgtatcgtcgtttcacaactaagttgtcctccagtctgattgaatatagcacaaaagatctccctgcatgtgtttcataggttttctccgtcttgaatatttctgcatgtaaatgtggatacttgtccaaatacgattggattcttgatttagtagtgtgaagattcagggttgcattatcgttgagtgtcttatcgtggggaagactagtttggttgctttgtttgttcaaggagttgccgctttcggtttcatttatgggcaaattgacaaatctgctttcggtgtcaaagggactattatcctcctctgacagtgacattgaagtcatgttcgaaagttaggggcagggtttgatactagagtagttgaagggatcggcacttgagctagaaatggtagggaggtcagatgttggttacaattcgcgattagataagtatgccgtattgggtgggtccaaggaagtgagttctagtaggaagatctctcgttcactaaaaaaattgcctcccctccagggctgctcctaactacctacaaaaaacaattccacatatcgtagcattgcatacttagacaaacctcttgtcacttagataccgtacaatggatccttctcctgcaacctcaatggttttgtcaaaccagtttaacaaaattcctgactgctttctgccctccccggagcccattcccttgtagagatacttgacgagcacgtcctgttggtccgcatccagttcgccaatcgtagacgatatatctgactgtttcactgacgagagagtctcaatcacttgcaggagatatatgtccttggctacagagtcggctccgtatggcggatcttgaagtagaaacttgagggcatcaatcgcttttccctgagacaccaacgtacgtgcctgctgcactttttgttcaacaacttctgtgggaacttcaggaaccgcaggttgcagttcttctggtctcagagtgaagtccgggtcgtatgcgtcaatatctattcttctccaatcttccatggtctcgttacttttgtcgtaaaggggcggagaaagtgctgattatataaccgagaagacaatgcgtagaaaaacggatacagcttatataatcacagagatccggatcaatctctgatcgaggggagggcttacaaatgtgtaaagtgcaagtgtattatgtatgtatgctttattttctactcttcttagacgatactctctctgtgtggtcactgtcattctcactatcattactactagtctcagcttgctcatcgtcccctctggccgattctttgggctctatgtcctcaatgtatttgtcaataaagtctaaacattggtctctgatatccctattggtcactagcatcacgaccaagccgtcacttcctacttcatatttcaactgtccttcattaggataagccactttttcatcaaaaatgtcgaaaaactggttcattccagtaaacgtggagatattcgaaagaaatcgttcgtgaagctcaccatctggtatttctttggactgaaccaccagcgttattctaaaatcattttctaactcatcttgttccggaactggatagtcctctttattggaggccatagtggttttgctttaagaaagtgatacgaaggaaaaaagggcaaaaaagaaaaaaaaatactaaccgcgatggatgttggatgtcaatgaagatagcttcatctctacagcatcttactagtatcttctttgaccattccatcctcctctacggttatctcgttgatcagaagatctgaaattaccttgtccctctctgcctccaccaccatggcttcgaaagcctccggagcctgcccctcctctatatgccccacgatttgaacttgtggagtatctctctgggggaggatatctatcatatcttggagcctgtctggtaagtttttctatttgacgttttgtgtaatgacgaccacctaaaccacctccaagacgccgaggtttccaatttttcacagttctacctcgttcaatatctactagaacaggtcggttgttgattttcaatgatgaagagttacgatatgcagttctggcatcgtctggctgcttgaataccacaaacccatatccttttgatttgtctgtgtttacgtctcgcacaacacgaattctgtcgatttctccaaaaacacccaaactgttctgcaaatccacctcagtggagttgtaatctaatcttgcaacaaatatagtcctcgaagcatcgccaatcatgttgaggtccttctcagggttccaggcggccaggtctcgctgcaatttttctgcttccagttttctcttttcttgcttcaatctctgctgccgttgttgattaccctctgtaactgtatatgggacttcttcgttatatttttttaccaaatcaagtaatcctccaactccctttactatcttggttcttctttgttctattggataatccacaggctccaaaaacttgaaaggaggcttcggttcaaataacttagctataaccggaggaaaagtagcagcagaatcagaagatctaacattaactgatgctgttaagcccttactctcttttatagtattcattgggtgttcatttcaattccttgcagtggaaggcaagagagttaagtaagatcttctattatatcagaatttcgagcatttttagtatccacgtataattttgatacaccgtgtctgtttggtgcacctatcagggggaaaactaattcggactgaactcaattgatactccataatgacaagtgagaaacaaatgtccctagacgtttcttctagtcatagacacgaggacggaagtgtcgccttacccaaaataggttccacaccttcgccaagttgccagtataaggagggaaccttctctgcttatgaagacgaaattgtaaatgagctagacttccgccagatcgaagacacagaaaccagcgggaacttacctgtgatagacaggccacagtttgcattactagtaatgctatacttgatccaaggtgtgccaatagggttggcatttggaacaatcccgtttctccttaaggggagcaatttatcattctctcaagttggagtattctcattagcatcgtacccttactctctaaagttgctatggtctcctattgttgactcgttatattttaaaaatatcggacgcagaagatcatggattattccagtgcaagctgtcagtggattaatgcttctttttctttcaactcaggtagatgcgttgtttcttgatcttgaagctaatttatacaggctgactattgtgtttttcattctgattttgctatgtgccactcaggacattgcagtagacggctgggcgttgacaattctttctccatcggcactttcgtatgcttctacagcccagactataggattgaacacaggctatttcatgtcattcaccatatttttagcgttcaattctccagattttgctaataagtattttagaaaagttccctcagatgtgggcccaataacactgagtggctacttatatttctttggatggatatttctttcagttactgtgtttttatggttcaaagttccagaacagcctgctcatttaaggcacgtcagtaagaaacacgacgaagaagaagctatagaaatgtatgacctaaatgctgcaccaggaactagtatgacttcaccattcagggatctggaacccagctcaacgtttgagtctttagtcagtgtttacaaaaagatgatcagagtactacaattgccaaacgttaaactgtttgtagtgttacatctcatttctaaaattgggtttcaagtgaatgatggggcgacaaatttaaaactattagagaaaggtttcaccaaagaagatctggcaatagcagttcttattgatttcccgtttgagttagtctttggatattacaccgcaagatggtctgctggagaagaacctttgaaaccgtggaggtatggatacattggccgattgattgccgccatgctgggtcagctactggtatggtcattcccttccggaggagtcacaaccccctacttttttgcagtaatttcacagcatctattgggttcattcatgagcactgtccaatttgtttcaatctgtgcatttcatacacaaattgcggatccaacaattggaggaacctatatgacaactctaaatacactggccaacctgggaggtcaatggcccaagataattgttttcactttgatcgacaaattcactaaagctaagtgtatcctgccagcaaccgtaaaggaacctacattatcacaactaggaaatacctgcgctaatgctcacacgaaagaactttgtcaatcagtaggaggaaaatgtcaaataattacagacggatactttgccacaaacgtactgtgtattgctattgggttccttctttattttggttggatcaagcgaacggcgaaccaccttcaaagtttgccaagcactgcttggagagtgcaccaggactagctctcttttttcataaatctgggagcaatataaactgtcataatacccaaataactccaaaacagtccgaacaatttttcactcatggaatgaaaatagataccagtcattaacaacatccatgtccatagaaaacatagacatagaactaaaatctcaggataatctcctagcacctgtagagcttgggtaaactgtctcttgcggatggtaagaagtagcctcttgaacacattcgtgtgatgttgcacaatatttacctcgtgagccagtgagtgagtaagttcaatcattaaaaatatccacgagatagaaagcagaaaaacatgacctgaaggatcatgtcctccagtccattcaccttttatagatctgcacgtgcttgaacttatgatggcctcttgaaccagcggttcggaatctttcttactaaaaaactctctaaatgcaggaaacctttgaatatacctttctgcttggatggtgggtatattggaacattttccacccgtaaatacaaataatctatccataattggcagaccaaagcaccattgggtgaaaacccaccaccatccggttatgagtgcgagtcttactatagttacaggctttatcttgacaccttttcgtaactttgcaacgcagaaaatagtgaatatgataagattccagccccatccgtttttgacaaaaaccatattaaccaaattccgcttatcagtgaaatagttattcacttcctcggaaggcgaaaacagatagatcaattgccccaacatcagcacaactagtggcaacaaaagtatcaccaactctcgaagagccaaacgggaaatgctgctaagcctcttggctaacgagttaattatccccaaatgctgctcataagtggcagtattgtccatctttctaatggggcactaatttgctaggtctaatctgacaagtttaaggataaagtagtgaacctttacaccacctgagtgctacgctacatgcgctgataatctcattcctgacagctactgagctaccagacgaaggaataatggcagaaatagaatccaaagacttgcctactcgatgggaggtcgagctggaggtatgttgtatatctaatgggtgctgattttgactttagaatgttttgacgaaatattaaccttcaacatttagtttgttcaatcattatccaacttacagtacctaaactatttggccttaaatcgttatcttgaagacgaggtatttctgaattatttggaatacttggaatattggagggaaccagagaatgcaaagtatttagtgtaagtttttatttttttttactttctgcaagatcataggtgctaattcgatagatatccgaattgtttacacatattgactttactaaagaatgaggagtttcgaaaacaaattaaaggtatggatataacctctacgctgatgaacgacatggttgataggtggaaggatattccacaggtagtgaatggagagggaaaacagaaaacaaaagataatgaaaacaaaaacgaggaaacagacgacaagcggaaagaaaatataaacgaatctcaagtattgagtgaaaatggcagcaaagggttggctactgtcaaagcacccaatgaaccaaaagaattgcatggtaatgtggacctttcccctgggataagacattctcgatcccagtctcccatgaatgaatccccaacctcggaacaggcttgaaattatcatttgtagcatagcataatatatttaaccgtatacggtaattatctataccagactgggttgtggaaactaacttgaatgccagtatttctttcccgcctagagaatctgattatcagctttttaggttttcgcgtgtcaattaattcgtagtttacactaacacgcatcaaactccaaatcaaatgacggagccactgggagaaggacatgctctgaacgatgccctacgatcaacgcaggaattgctttcagagcataacgataatttggaagcggcggactacccaaaacagtcggaggcagacaggaatattgcacttgagaaagaactctcccagctaaacaaaatcaacgacacattggattccgtattggaatcgataatagtcaccaacgcaaacattgagcgaataatcacatcttctgaacagtccaataaactaatcgaaacatgggcgaagatcctatcacagaataaacatacctttgaactactggaggatgactcgtggcagggatcatcaagagacattgatacctggaattccaagcttatggaattgacagaacttcaaaggaagcaaaaagaaatacaggaaagattgggaagggaaaaggatcaggagttgaaacaagaacaacaggcacaggcaaagaaaagagaaagacaggaaatgctccaaagaagactttacggaagacggtccacaattaggaaacagtaatggtataatcgtaataatatattatagtataatataataagaataataaaacatacagtcaaaggtttactcagccttgacgattttggcgatcaggtcgcttgcatcaacagagtcgttctccttgactgcgatctgtccaatacgaccagcaacaggggaggagataaccatctccatcttcatagcagatagaactgcaattggatcacccttcttgacttcgccattttcgtgcactctaacctcgacaacgacaccagccattggagcaccaatctcgttagggttgtgagcatcagccttaggtctagtgatagtttcaacagcggcattcttgtcctcaactgtgacctttctcatctcaccgttcaactcaaagtagacttctctggtaccagatgattgagatagctcaccaacagccatacacttaatgattagagtttttccttgctcaatggtaacatgtatctcttcatcaattttaggaggagataagaaatgtctggttggaagcacagacagatcaccatataattcttgttgcttcttgtaggcttcgtaaacctttgggtacatgttgtaagaggcaacgtcattctcagtaaccttactgaaacgagcctcaagatcctctctaatggcaggaatgttgtatggctccaaagtcaaaccaggtctgctagttagctttcttcttttacctgagatgacatttgttctcaatggttcagggaaacctccatatggagtacccattaagccttcaaaaaagtcaagaacagaatctgggaaatctaactcagatgccaatctttcgacatcttcggatgacaatttattagataccatgaattgagccaagtcaccaacgaccttagaggttggcgtaacctttacaatgtcaccgagtaacctgttagctgcctcatatgccttcttagtttcaacccatttttctcccagaccaacttgctgagcttggaagagtaagttagtcaattgaccacctgggatttcatgctggtagacttcagggtcaggacccttaagatcagcctcgaaacatgagtacaaaagtctcatctcggcccagtaagcatcaatctctctagcattagcttcagggataccagtctcaatttctccatctaaagacgcaatgaaagcagacattgaaggttgagaagtcataccagacatggagttaacagcacagtccacaacatcagcaccagctctagcacaggccaccatggaggcaacaccagtaccggcagagtcatgggtatgaacgtggattggcaacgaggggaactttctcctcaaagcagagattaactgtttggcagcagtaggtttcaacgtaccagccatgtcttttacagctaatatgtgggtacccatctcaacaatctcagtggccaggttgatgtagtattccaagttatactttttacctggtttcaacatgtctccggagtaacacatggtggcttcaacaacacctccagctttcttgacagcgtcaactccgaccttcaattgctcgatatcgttaagagcatcaaatacacggaagacatcaacaccagtgtctttggcctgcttaacaaagtgatcaatagcgttatctgggagagaagagtaggcaacaccgttagcacctctcaataacatggagaatgggatgtttggtacagctttacggagtttgcgcaatctttgccatgggtcctcgtgcaagaaacgcatggaaacatcaaaagtggcacctccccaacattccagtgcaaaagcgtgatgcagggcgtaagaagtagctggagcaatatttagtaagtcaatagttctaacacgagttgcgagcaaagactggtgagcatctctccaggtagtgtccataatcatacaaccagggaaggcacgtacttgttgagcaaattgttcaggacctttctccaacaaaaactgtctccatccatcaggaggaggaatagaaacatcaatgacatctccatttatgtcagtgattgcggggatatcagcttccttatgtagttttggcagacccaattgtcccttgattgaggaaccattaacagccagatcacctaagtaagccagcagcttctgagctctgttctgagaagtcaacattttgaacaattctggggtatcatcaataaatgtagtccaacattcggaggtcatgaaaacagggtgagtcagtaaagccaacaagaaaggaatgttggtcttaacacctctaattctgaattcaactaaagctctgatcatcttacgacgagcaatctcgtagttagagccagaagtggaacacttgaccaacatcgaatcataatggggagagatgacggcaccagcaaacccgttaccaccgtcaagtctgacaccgttaccaccagaagatctataaacttcgatctttcccgtgtctggttggaaattcttcgtaggatcttcagtggtgatacgacattgaatagcaaacccacgtgtggtgattttttcttgcaataagcctagttgttctaacgaagcaccagcagcaatttgaatttgggcagctactatatccacaccagtgatctcctcagtaatggtgtgctcaacttgaatacgagggttaatctcaataaagtagtgtctgtactggctgtccaccaaaaactcagcggtaccagcgtttctataattggcagtcttggctaatttgacagcgtcattcaagattgcattgcggacctcaactgggagtgtctttgcaggggcaatttcgacaaccttttggtgtcttctttgaacagaacaatctctctcaaacaaatgaataacattaccgtagttatcagccaacaattggacctcaatgtgcttcggtttgtccaagaaacgttcaatgaaaacagtaccgttaccgaacgcagtcttagcctcactagaagctctaaggaaagcatcttctatgtcatctccttcacgaaccacacgcatacctcttccaccacccccaaaggcggccttgatgataactgggtaaccgtattcctcaacaaaagctgtagcctgagcaacgtcttcaattggacccggggtaccagggacggttggaacattggcagcgtaggccaagtttctggccgaaactttgtctccaacagcgtcgatgacggtatcggacggtccaacccacaagataccattttcctcgacttttctagcaaactccgaattttcagacaaaaatccgtaacctgggtgaatcatgttaacgttgtgcttcacggcaatcttgatgatctcgtcaattgcaagataagcctggactggagagtattggccacgctcaccgatgacataagcttcgtcagccttcaatctgtgcatcgacaaacgatcctcgtgagaatagatggccaccgtgttcattgagagctcatgggctgttctaaagatacgaattggaatttcgcctctgttggcaaccaaaatcttgttcattgtgcccagaagagacgagtcacgtctcagctggtacagcggggagtagtcttcttcggccatatctgaaggaattgaataaatatcctgtcttttgatttagaggagtgataaaaaaaaagaaggtatggaagccagaagattggtaggataaaattgctggacccactcacatctttatatatcgataccaaggaatttttaccgcccaatttgcgaaggtcgtgtgcgggtgaaagatattggcacaaccgatcgagagagcgagcgagatagagaaggggagtatgtcataatctttttttcttggacagaaaagaccgggggttcctgtctgttgcttaatctcagcaggcaggggcatagggggtttgatgagagcgaattagatacaggtacggttagatggtttggagtgaaggcccggcagtgtgccctctaattggcacctttcgagtggaaaaagtacggaatgagtcaataattggtcatccattcacaaggctagctcaagctgtaatcggaggattgtcggtgcaggtctatacgatgatggtgtgttttagcccaaaaaagattatgagtttcatgcactaccgatgatgaaatcaaaaaaaaaaaaaaaaaaccaaatagggtggggtgaaggttctcgagtgggggtgtgcgaaatctacgcatcggacagtagatgacaaattagactagagacagtgggaaagggctattcttcctgattaggatgaagtttcgaaggatcgaagtttctaggcaatgctgaatttcaagagacagtgggtagcattcttctttggtgatgaacttaacatgagggaacgatgaacttgtggcaagttattgaacctacccggtttttttgtttaatgatagcccgaaccccggagggtttaccatcaagtacttttccccagattgtttatatttcccgagcaaggatcccaatggctccataaatagattctccgttagaaaatgtattgttagtttttttcgaagtaggacaaaacaggcaactggcgtccctgcccaagtttcaattatctctccttttcgaactccttccaaaattcctgtccagcgtaaaatttactatccagtgaatatggaaggaaccagcaaattgtgcttcataatacctcaaatactatgaactgcattgagatattactgtagtgtgagctcagttttaaataacaattattcaaactagtcaacatccacacagcattctgaaagcatacttctcgaatgctagcttacatatagatttttccccttcacaactgacacacaaatctaatctcttctggaccattcctgcccatagttccttgggctctgcaagccctcttcatttgcatctttcaaacttatgtttacctcttcgttttccaaagtctcaaaaaaatcaaagaataccttcaatgccagcccacctgagaaaaagcaaaaaaaatctgaatcgaaggattggagtcccaagagtccacaaggtggacatcccgagttttccgaagagggcaccagctccaaggagtccaaaactgtccaacagtttccttccttcgatcacttgattgacgatttaccatcgtttgaaatgcataatagcttgctgaatagaacttttcaagccactgattccccaagccatgatcttcctgacgactcctcctcaacggatggcaaccaaaatcgtttttccgaaaatcctcctgttcgcccttctttggtaactcagggaaccgcaacctcattgactcgttttcagaactccaaccaggactccatactgaataatttgaacagcttggctaaagtgcatgcgccattgaacgtcacaatcaagcttaccacaaaacatggagacggaaagaggtcaactctgctagagccaatgctgaaagaatttaccactggggacattgtcgctggtatcgtcactgccaggaatactagttccaaacccatcaagtttgacatgttcacagtttccctggaaggatacgctaaagttcttacaggatcaggctcgtctaatctcaagtattactctcatacatttctcaacatgtttgacctcaacgcatcgttccatacgtgtaactcgcctgagtccaacactttgaagatcgatcccagtgatggattctacattggacttccagtggacaaagttttccggcccaacgtgacgtacaaaaaatcattcactttcaagtttccttctgtgttattggatcacgtttgcacgcaccagcatgatgctcattttatgttaccacccacttttgggctggacaggagcagcatggatgggagagccgaaaaaattgctataaacggcaattctggctatggagttttatatgaaccaggttcccctattctaactagagatcttagttatgctaatgagtccgtttcctatgcaatcaaggcgagagccttgagtaaaaaagaagactatgaagtgcaggacggagagttcaacagaaatattttggctgaaagtgaacaccatctaaggtttattccggttaatgcgtacgacaaccctgcgaattatgagctttctactgatgtccagtttagaatgttgaaaaagtctattgattccaacatttgcaagttagagcaacactaccaacttatttactttggtatcgaacccaatgatgtggattataacttttccaggatgtactttaacgaaaaaaattcagaaaaaaagcttaacccgtatagttatcagaataacatcagcttgcaatatgatgtcgagaatttggactgctccgaaaggaaaaagttgcccgatgccaagcagtttcaaagtagaaaggtttacgaagaagaggcattcgaactaaagaaacaatcagtgatcagcatccctatttcaaataaacggtctcaaaacggttttatgcgaatgcgagccaaaattcctagtacaggactaacgtacattagaccaagattctgtactccttcggtggaacagagtaagaagactgggctaaacttacaggtaatagaactggaattggaatatgtcccacccatgaattgccatacaatgaatgcatccaagatgattaaacctcctcaacaggatgtcgagatcaaagatattctacttgaaactataacctataggtcgatcgagccagtgccagttacctttgcgaattttaacttcaccaaagaggatgagctggctgaacacaagaaagattttcttacattccaaaagcgtttggataagctccctaaaaaattcgtccatgctaacatgccaaaacagactcttagagacatcaaagctatggttgacctgagatatcatactaacaacatcaaggttctgaaaatcaaatctcaagtacaagaaaaatggcgcccgatagagatattggaagaagacaaaccgtctcctaagagtaccccaaccagtcctctttacgagaaatccaccagttatttccctcctgcggaaacatactttgaaagtcgagctaacagctttagttctcaaagcggagagaaaaataggtccaagattaagtggagcaaaaaaattgtaattgagattgattttaattatcaacaagatttcaagaaccttgtcttagtgcctaccttcagtacatgtttgcttggacgactgtatggaatagtcatcaatgttgatctccatagttatggggtaaagtcgctaaacgtcccgataaaggtgtacaatatgggtgtttaggagtttgactaactagattagtaagaagaaatgacctgaaaaaacgtaatcatgataagctgggaagttattgaattgtgactcagtgtttatctttggccctggaatgggaaagcattgatgttttgatgtttcttcggcaaatcgaacattctggaacgtatatgaagccttattaatttgatagtgaagagtcagaaaagcgaaaaattagaaagtctcaattgtattggggggtttcctgcatactatctctgattgcaccatactgtatgaccctcgaacaatagagcgctatcaccttttgaacgtgttgttctcataaatgggaaatgggacttccgctgacaattcagctgaaacgtttttgggcgggtgactcattaagtctgtcccttcggccatttttaccttattgagatctaacctccttaaatatatataacgggagtaagaacctgcctttttctatatctactctactagacttctctatactaccactattggctgttggtcatgcgcaacgaactgccaccgtatagatccgaaaacagggttcaaatccaggacaaacatgatgatgatatctatgacatattgccttcattcgaaatgcacaattactaccttaacaggacattcaaggatgtagaattggaaaccacaagactttcgggtatatttcaaccccctagctattgcgatcattctactaccactagctcaactgagtctagttcgtctacgttgtattccactccaagtttgctggaagtccgaagatcaggtatcttgaataacgtcaataagttgcccaaattagaaaaatctcctttaattctacaaattcatgttacgaaagatttccccaagttaggaaagacttcaattccagaatcagctctaaaggagtacacatctaacgatcttatcactggatatatcactgttcgtaataccagctctaaacccgttgattttcaaatgttcacactgtccttggaaggaacctcaaaaattattcaacttgatggcccttctagcggtttacgctttttctccaagaatttccttaaaatgtttgatttatctgtttccaacaacaatataccgaaccaggatctcaaacccggtgccgttgaccctgtagatggtacctactatggtcttcctgagggcaacgttctacaacccaatgttacttataagaagtttttcgtctttaagctgccaactcaatgtcttaatgacaaatgtcagcatttcggttgccaccagcaacatttgatgcttcccccaactatgggtgtagacattaccagcttcgataagaaggctcaaagcatcaaaattaattcaaacttgggttatggtcgattagttggtgagctggggacccccattaagactaaggattttacctctgattatgaatctattacttatatgttgaaggcccgatttatcggcgaatatggcaacgagctggcccgtttgtctgaaagagaataccacatccgttttattccatatggtttctgtcaaccttataatacctctttgagagaaataaacccagaggtgcagttgtctcaactatacgaaacttctttcaaccaattagccgcactaaggcaagaatccgacctcagaaacaattttggtgttgaagcttctaccactctgggtcagctataccttcaagacgatgatgaagaggcaaaattgaagcaacagaatctaatagaaacggcttcttcttccgaaaagcaagttttgcaagacaagacggaaaaggctaaccagctggtgagcttccccatctccaatccgaacaaggatactaactacgaggtcacaaacctatttctgttgaagcaaaacaaacataccaagctgcagagagttttgaaaggctctaagcataaggacagtgccagaaacgagtttggaagcatcaccatcattgccaatgtccctaccgaaggtttgccatatattgcacccaagttgttgaaatcttcttccgccaagcaaggtcttttgaacccaatgaataaggctaacatcaacctgctagagagctctctagacgacctggaaaagtctgatctgagtgtcattgatatgaacttggagtatgaaccgacttcagagaccggtttaccaaatattgatatagcaaacataatgttgcaagccataacaaccaagacttccacatctgctcccataactttcggaaattcatccaagcttttcaatggctacttcaaggaccctgaaacaaaccaagaaatcaacaagtttgacttctatgtgctcaaattcaagaagttgcagaggcaaatccaaaagatgagcgagacggatctggctctatttgatcgtcaaactgcttcggatattgccagtatcgccagtatgcaatatcgtaagaactacattccaaacgtggttcagatacagtcaatgatcaatggaaaatggactaagcaagctgattccaacaaatacaaaaagaatattaaaatcctaatcaaacttaacgatactaacaaaaataactacacagtgattcccactttcgaagattgtttgatatcgaggctatacaacttgaagctggatctctcattcaaagagaacactgcatcaaaggacggctttgagatgagccgcagtttgtatatccctatcagagtgagaaagttcgacttcaacgagtagtcattcgtaatctaagtactttttatttaagaattatatctctctaatttttcaatatctatctatgggtcgtcttcaccgacgatctgcatccaagttttaccttcttttttcagttcttgggtgatttcctgtttaatcttatatggcaagcttgggcctctgtaggcaaatgcagtgtataattcgacaaaagtagcacctgccttagcaaagtctatagcgtcctttccacttgcaattcctccacatccgacgagtaccaaattggaatccttagtgtacttcctcaagtaccgtaaagccttaagagataaaggtttaagcggtctaccagacagacctccactttcttgcaggatgggatcattaggagaaacataagtggttggtctagaaattgtggtattagaaacgacgataccatcgatacgggcattttttgcggatgttgcaatgtctttaatctcttcttctgttagatcgggagcaattttaaccaaaacaggggccttagatttgttgtctagagcactattgaccttatctctttcgctaacgactcgctccaacagactggtcagtttcgatccagcctgaagatctcttagaccaggggtgtttggggaagaaacattgataactaaaacatcagcatagggacctaaacgttgtatacctttgacataatcttcgacttcgtcccctgttttattcttacccaaattgattcccaataacttaccaggtctgaaagcattattgggtggaggttggccacttttctggtagtcttttacaaatgaatcaaacctctttcgcagccttgccaaaacattccaatgcccagaagaattgaatccatacctgtttatgactgattcatctttgggaattctgaaaaaacggggtttaggatttcctggttgaggttcaggagtaattgaaccaatttcaacgtaactaaatccagtattgtaaagaccgtccattgcttcaccgtctttatccagaccggcggcaataccgacaggattggataactcttttccaaaaacggaaactttcagtacctcatcatcaatatccttgtacaatcttggagatagaccatacttaagacaaagaattcctaacttgtggccatcttcggctgatgtagtcagcctaattgccggacaaaccaggtactcgtgaatggcagatcgggcatcaaaaaagtacaaaccgaagagaactcctcccacaccaatagccagaggacccgccagcgacgccttgagcagagactggggtttctttggcaaaagtggcaaacgcttagataacgtgtttagggcggactttctcaccaaattgaacatattaaggaattaaagaaagttccagcaaaagtgggtaaaatggacccttggagtagtttaagtataagatctctgacgaaaataaatcattcgatgctgacgggtgtttcccgaattattatataattataaatcttcaatcggattattcgaggaggggaagcatggtctcaagaattgatataagatgatgagactgaatgatgaacagacctactcctcagctagatgatagagatttatgcttcttaagctgattgaaagtatacccattatccacgggaacagaaacttagctgagtatgacgttcttggactattcgaaatgcatatactttttgaacaggagttcgccacaaaacgtatcccatgtcagttctaaagaattcggacttagacgattcaaggaacatgaacatggataagtttgatctgcaacgccttctgaagaattgtctacatagcttcaaaagaaattggcaaattacattccccagttaccagagaaacaattgacctcagagaatattcgtatccaatatatgatgaatttttcaagactttaagcaatcaaagatcactggacatcaaaaacaatactcctgctgatatttctgggcctcaaaaatgtcaagaatgagcccaaaaatctcaacactttttggaaaatgtcttatctatccgcctattggcatctatattaccgcaagaaaagacatcatggctgagcaaaggtgtgaaatcctcgatcctggacgattcatatctcagattctttctagaaagattattctgtcaaataggaagtgcaacaggatcttcgtctcaagcttcttttttttttaagttggacagtatgttcatcatttgttgacccatcacgggttttctcaaaccacgttactcggatttgaattgggcatcgttatctgggagggcaccgttgatttatctgaagacaaccgaacttcttgaacattagtatctttgtctgcaaaagttttgtgttcccccaagactcattgagtacactataaagttaccattagcaacaccaataaatcaagcaccacgacaaatgccgctaaaaaatgtatatttggtcatccttgaagtgagggaatattaggtccggtttactccttttggttatcgttcactcctttgaagtggaacctgcgtttgaacggacaaccaagtattattcaaatccaatcaaaaatgagctgattgacttgcggcaacagtctcagcctcaatctcaggacttatcaaaatataggctaacttatgtgatcaatggcacctcacataagttagactccaaatttcatgagagacatataacattttacagagcggcattctaatacatttctttcacgcctctagttatctctgcttggaaagctgtagaatcaaataattggtaaataggtgatcacatatcttcaagaactggactccggagtgatctgcaaatctgcatgaggtttctcaacacgttctaagaatagttctcaaacttcaaaaaagtagctcggatgctgttcaatagtctgggaaggcaggaataaaatatagaattaaaccactccgaggttagttctgaagcgtgtcccatctgcagcctttttccaacctttgggggttgtttaatggctcagatacttgagaaagacattaacataaacatccaatcaggagacaacaaactgcatgagcgtacgcactaccagggaaacgtgtaactccagctggggctagcagttgcttctgagactggattggttggaaaggttgcctgacttttgtttttggagtcgaccttagtttcctgttttttctggtgaggtgtgtcacggtactatttattagaaactgtggatataaatagacttcggagtaaggactccggtccgcggatcgctgtggaggagtacaatatccccacaaaaaagtgagaaatttgaaattccggctgattgttgtttttgaccctggttgctacatttgaacaataggattttgaaagcgttactatgacaattttggagaagtccggggttacaaggttgagtacaaagtgatcaaaagcgcaattatctacatatggcaagcaaagacggttgctgtaagacagagctactcagtcctttcttttttgcaaaccaaaccatcttgattgtgcgtgatccaatctctatggcacccaactgttggggatgagccactgcgcctagatcatctattaactttcttttcttttttccatcgcgcaaattttgtattttttacccgatggagtttctttttctgactaaggtataaaggtagacggaacacttgcaaatcttttcttctgtcacattcatttttgcacaaaagcttcaagattgaatagcaatcgcttccccaaattcaactattatcccacactccccattaaatgtcgttatcgttagacaacatagttccaagcttcagattggacggatcagtcagtattgtcactggtggttccggagggctggcttctgtgatcaccaaagcccttttggcacaaggttccgaaattgctgtcgttgatctcaacttggaacgtacaaaggaggcagccgagctcctgatcgagtggggaaaggaaaacctcgccaaggccaatggaggctctgtacctagagtgacttactgggcctgtaacgttgccgacgctgccaatgtcgaggaggtattcaccaatgtcaacaaggaacatggtaagttggctgaatacttagtacattgcgccggatactgcgagaattttccggctcatgagtaccctgcccgaaatgcagaaagcttggtacaggtcaatttgctggggtcactatatgtttcccagtcatttgcccgtcctttaattaaatccggccacagaaacggatccatcgtgctagttggatccatgtccgggactattgttaacgacccacaacctcaagtcgcatacaatatgtctaaggctggtgtcattcacctggcaagatcacttgcttgcgaatgggctccttacaacatcagagttaacacactgtctccaggatacatcctgacacctttgaccagaaacgtcatttcaggtcatactgaaatgaaggattcttgggaatcaaaagtacctatgaagaggctagctgaacctaacgaattcgtgggctcagttctctacctcctttcgaagactggctcttcttacaccacaggacataacctggtggtcgatggtggttacgaatgctggtaagagccgttcattatttttctacatgtatattagtatattagtgataggtaatacagtctaccaatcttaaaggtttaaatttgtttcttatcttctggatctaagcttatatgccagctttttaaatcgtctcgtaggtcagccaatcctagcagttttggtgttctgcgtcgcttatcgtgatcaaaatcatcgagatcattgaaaagatcactgtcatcaggatccggctcgtcctcatcaaattgttgcatcttggttatccattggcttcgaacttctgaatcatgagtgggtccattcggcgaattttcgtaggaaccatgaagaatatcaataaacgctaccccatcttcattccttttccatcctgtgccgttgtagaaaatatcttcaacgcactctgatggagtaaactcggggtagaaatcatcaccgatattgaaccatgagtattgtaacgtcttacttaccagatagttcaatgtaggatctgtaagtatgctgctcttgtttcgagaatcttgattctccgaccctttgacattggtatgatcggtccgaaaatgtaactgatcccttgcatcccgtttggaattagtggtacgatgcttggtcggtgtcagtggtgaagtcaatgcagaattgggatttgaggtggagttattttcgccaaaagaagaatttgtatcttcgtctatcacctgattcaatccctgaaaaatatgtgaggtttccagctgagggacattgaactctctctcgggactgctgtctatggaagtccttgaagcaggagaccccacagtatttctataactactatatccacttgatggcccattagtcttcttatcatccaaatgtttcattagaattgaaattttgcatatggagttaattttactgtctgccaacagatacctattcgtggtcatctcactaaaattgatatactcagtcaggttgacagcaatctttcccaaccttaccttctgcaatttctttggatgtttgtttgaagaagatgtagccctactatcctggtcctgatattcaacgtacacttttagcaagagccatttgttctccataaggcctgtcttctggtcctcacctattttcaatattatgtcatggttctgatagttccaagttactttgttattttctattggttccttctctgtttgtgattgatacaatacatgtgtgcccattgatttgcttgtttgttcgtcatgcgaattagaatggctacctttgttccgtatctggatcttaacgtacacttttcctgctaattgaggaatatttattagttcagatattgccatatacagatgaaaccgatgcttcctcatattatgctttagtacgttcattaggaactgtcggttgataccagagcaacagaaggccctttgttggggaactggaactgcaaataatacatattgtgcggtgcacgctatacaaagaagtatatgtatctgctttggtgacaaaatcaagtaatccttagatcttcatcatcagagtcaattatgaactcctcaggaccagcagtatcatcctgaccatcttctaaatcaaataattcaaatgaatctccttcattgaggtttgggagttttttgtatcgaaattgattaattcgttctttgagcctatcaaccagtttccggcgacgttgtcttcccagaaaaaaaaacagaattaagaggcctatggtcataaacatcaacattgaagctaaataatttcctttcgaccctggtttactaaatgaattgttcatttggtattttgggcgagtgaaaccatctacttcaccgccattcacaaattgtcctgaaggattattataaccaacttttacgtcagaagtgtctatgctttctgaagaggcatataatagagcccttcccaaggtccatgaaaactctaatccgttgattttttctgctacttgtaaatgggtgaaattgctttcgactagcgatgaatcaacctcagggagtcccaaacctcgatgaaggatattcagcagatacgtcgatttgaagcataattctgcaagctcatcatccttgagatcgtatactctatttttgtccttgttgttcaatttgtccagttctttccacggcatgttgcatatcttcagtgtttcggcagcaaaggtctcatacgaatacgcattaccatatgacatcaaatccttgctttttttgatttgcagaatattggaaatagcatcccagtaacctgacacaccaacaaacttattcacgtcaaaatctattgctggcaaggatgaattggtaagaagacacccttcaccctcgcaatctaccagttgcgaaacttgattataacattcggtatagtttccagaaccactaacattatgacttttcgaatgatatccattaggaaagcaagcatctgtatctgcatctaaattttcaagatacttttcatgagcctcgaacatcccgtagcctaagaatgatgtactagagaccgtgtaatttaggtcagttttttgactgccagtagtggccagattcacagaaaacagttgatctttgtgaaggctgctttctgtcgagttaggctcaaaagctatctgtgtagacgcccctcccatatccaaaacgccgtacgaagagtggcccttcccatggtcatgtagctcagggttattgaaagatcccatcaagtaattggtagataaccatgcataaagaccttctacatcaccatcgatgacgttgaaatgtgactggcagtctggaataaagaaacctgacttttgaacatgtgcgcatgcatattgcaagatttcctctctcttctcagtttccacaagtctcattcctgcagttgcatgcaaaaagataggagtcctgaaatgttctgactttggtattacttcagaaattctagttagaagtttgtcaatatgttcactgactttctcgggagattcagcataagtcgctataccaggctttattttcttattccacttacttttcgttactattgtcggcagtctacgctgaagaacaggggggttatccccgtgttggtctgtgggctccttcgattcggaatctgaatcggaatctgagtctgagtctgaatctgaattggcatctgagtttgaatccgaacctgaatctgaacttgctgtcaaaccggtctcagacttagaatcctcgtcggaaaactcttgttcagtttgttctataggagtatcttcttgttgtttatcttcgtaatccattctcttgttcattcctaggtgattgtcttttatatattggtaactaggccaaccataaatgtatgctcttgagcctctcgaaccagcgtcaatcacaactatgtagtcattcagggttccgttggttgatataggtgccctgagatcctttgcgggcttatgcttattgagagccaccatttggtgataatcttgacaaagtagtaggaaggacgttgactgactgcgtgagctacccaacaacgcagaagaaacacttcgcgtgcccaatgattatgtaatgtaatttaaccctatcgatctatttaaagagagaccacagactctagcaattatttaccgcaacaaacaagactgaaggtcaaggtgcaatgagtactattgtgactatgatatacttgctcctactctttctcaaatccttcgcctcaaaaaatagaagaaaccaacgaaaatggaacaaaaaattcaattacatgataacacaactttctccaccttctgtagaactcttggagtcctccgtgctctcaatgccttgaatcaaccgctgaaaacattcatcaacgttctcgttcaatctagccgaacattctacgaaagaacagttaaattccttagccagattctggccttcttctattgtaacttgacgctgtgaataaagatcagatttgtttccaactacaaccaatggaatttcttctgttcccacagagtccaagattttatctctcataattttcagcaaatcaaacgaagaccgagatgttattgaatagaccagcaagtatccatgcactccaatgagatacttttgattcattaaagaaaattcatcctgaccagctgtatctaaaatttctatcaagtactcttgtcctttgataacgaccttcttctgaaactggttttcaatggtaggataataactctcaacaaagtgattctccacatattgcaccgtcaatgaggattttcctactgaacgggagccaaagacggcgatctttcgagcctttgccatccttctgatgttgatcttctgagtagcttcctcctcgattcagcttggggtaagtcactgattaaggaagaagtaaagaagtatcagatatcagtttcatttaatgtttaatgcacgaccatcaattattttgccagacaaattacaatcgcactgcgatgagatttcgaaaggtgcaaaatcttactaaacacgggcatagagattcataacttctgaacaattaccacatccaagagctgtgttcattttatctttacctctacccagttaacccgttcctgtcggctagttgtattattggtcgtgcgttgactaattttagtcgcttctctataaactggtcttttatacttcttactttgtgcataacctagtctagacatttttcctctcttcagttgtccattctttgtgtttgttgcctattctaatggttcatacgtggtctgatgagtcatctatccaattagatggcaaatcagttctaaacgcaccactgtatgaaactaattacggaaatacctataaatcgaatgtctcctatcacttcaatccaaacgtctccaaatatcattatggggtacgacacccaatgaaaccgttccggttactattgactgatcatttggtcatttcttacaagctgtatgaacagatggatctgtatcagccaagaagtgccactgaggatgaactaaagcagtttcattctgatgactatattacattcctgaagaatgtcacaccggagaacagtaacaagttcattcaagatcttcgtaagtttaatattggagacgactgtccagtctttgagggcatatttgactattcatcctactatgcaggcgcatcgttagatgcgtctaggaagttaatcaatgggcaatccgacattgccattaactggtcaggaggcttacatcatgccaagaaatcagagcccagtggattctgttatgttaatgatattgtgctatccattttgaacctcctcagagtgcatccaagagttttgtatatagatattgacattcatcatggagacggggtccaagaagctttctacctctcagatagagtcatgacagtttcctttcaccaatataacggtcagttttttcctgggactggtaattacgatgagacggggcttggagttgggaaacactttgccctcaatgttccacttagagatggtattgacgatgagaactatgtcagacttttcaagtctgtcatggagccattaataagatccttccaacccacgtgtatagtacaacaatgtggtgccgattctttggggtgtgatcgattgggtggatttaatttgaatatcagagctcatggtgagtgtgtgaatttcatcaagtcgttcggaatccctctcctagttttaggtggaggaggatacactcctagaaatgtcagtcgtctctggtgttatgagacgagcatcatgaccaatacgaaattagcttcaaagcttccggaggaattgccttttaggaatttcttcgaaccggattactcactgcatcctaacctgggtgatcgaattgaaaacaaaaacacaagaaaatacctggaaagtgtacgaatcagagtaatggaacaactacgttaccttaatggtgccccaagcgttgccatgcaggaaatacctccggatatccaaggcatagacactactgatgaggaagaggcgctgataaaacagttgaataaagaaagtgaattggatgcattgctagaagaggataggtactggcttaacgagaaagaaaatgctagagttggagaacttagagattaattaaatccctgtattaatattgtcattatgtattttatgtatttaggcgaatggaacatgttatcgtcatcttctctcctagaaaaggtcttccttccaatgtacctttaatgtaaagtcaccatagttttctgaattctttcgaagttaattttcagcctcctgttccaagtttccttaaggcatcaaaatatagtccacaacgtctatgcgcttaccctctgcacaattttatcaagatagaaaagaggaaacaattccaatacccctcaactatgtgtgcatataggaataattgctatttaaggtggctgcattatttagcaatgttgatcatctatgtcctttattgaatccgccaaaattaaaccctccaaactggaatccttgctgatgaaacacattcggattgtaataatgatgttgttggtgctgttgatgctgttgatgctggctgtgagaagccgcagggtcgtttggatcttctccgtacttatcatatttctctcttgctttctcgttagaaagaacttcgtatgcattgttaatttcagccatcttatcctcaagttcatgactttccagatctcccttgtacttgtctggatggaattccttgatctttcttctaaatgctttctttattgtcttctcatcggcatccctggaaacatccagaattttatagtagtcattcttgggagttactttctgctgaggaggttggcggaactgttgctgttgctgctgttgctgctgtctctgctgttgaatcactttttctacccgactgtatctttgcttccaaagatgagtcttcttggtgaccttagagtatctatttaggatctcatacgcttgtcgtatattagagtccgtatttgtcgagatcaagtagtccagcttaggaatttcacaagccagaggtcttggtgtcttgtcctggcagattttcatcaacaactttttgtgcctggcaaaattatttgattgagccatgctttccactaaaactcgctccaaattgttttttaacaaattttgcttcaagagttctccgtcttctttaaacttgaaatctttggaaaagtcatatcccaatttgagaagaaaatcaaaattgttaagtcccaatcccttcttctcgtaacccaattgtgcaatttgtttcggttttagctttatcaacttttcgggattcaagaggaactcataaagtgaaatccactcttttgagcttaactgactttcagtaatggaagtaccttcgtcctctgaatcgacggcagaaatatatagcaatgccttgtcaaataactcaaaggcatgggctagtttgacgttgactttagtatataattgtgctgctttgtaatcattatcaatccttaaacatttctgtaacattttagaagcctgagaaaaattagattttccaaacagccgtaacttgtaaagattaattaaaacatccaaatcgtcttcccctttgaacagtttttttaattttgggttgaagatcttaagttcccttggggaggatgagtactttccattttgagctagagccacgtaatcttctaaaagcatgtccaatttggattggtaaggaatgtcctgcaagttgatgacgcagtatatcctcaaatacctgatctcgtcacaaagtggactgatctctctaagcttactcaatgtagcgacgctgtctttgaagtttttctttactacggttttttcagcctgactaaccaaatgattgaaattattcttctgatcgaagactgcagaatccagttgagctgagccaagtatttcctctaaatctttgaacttggcctgtttgatatacgactctaccattttatccctgcatgcttttcttgatgggccatactctaagcatttccgaaacatttcggaagagctaatctcttttgtaaatgacagatcgataagtcctttggtgtagtaaaggttggatagcatactatcaatctcgttgctctcattcggatcatttacatgatgtctgtaaatcagaagttcgtccaggagattatcatattctttggagattgatgatgtaggcccgaactgagagaactgttgggacaatgagtcaattttttgggaaaatgattgaatgctagaagcatggacagcttgattcaatgctacagctatgaaaaagagatagttcagcctcattattgaagaatggtgcgttccgctgccaatagtagtgaaatagttcaggacacggtagataatatggaggtgcttaccaaatagaatgttcgagataatcttgggtaacaataagtgcttaggattatacgaaaataaaggaatacacgaagccaatcatgttatattagtaattaaggttatattaaatttagtggtgagttcagtacgtgacaaagcaataaaaaactgctaactggcatctttgtaagattcgtcagattcagcactgccattatcggaagacatttcagccttaggagagcatgccgttgaggcttcaacttcttcatcattctttccatctggcagttggtgctcctggcctaggttcaattgacttatcgtatcgtttttgaaaagattctcttcttgttgaaccctatctagaacctgcttaggatattctttcatggttgtagtggggggtatgacgctagactttagatttccatctaccttttgcagatcctctgttccaatgagggcttgcttccggttcagatcaacaccatgattctcagagtccgtattagaatcgacagacaaagcctccttaaatacattctgaatctcaagcgagacttttagcgcacttgaactatcatttgtcttggttacaggtccatacgattccagcagcggaagtgaactatttcctctattgttatcaacatggtcccaggtgcctatccttgcccagaaaatcttggcccgcaacttgtttatctcacaccaagctttgacatacacatcttcccgagaaaatatccaaattttcgtcttgtctgaatcattaataatcctcagtagtgcaaacaactcgcagatagttcggatccgtgacacgcaaaaagtgcaaagggaatattgatacaagtgcgctggggcaatactttgcggaagtattatggaagatgcagatgctggtttgcttttagatctcctctgtatcttgagggtatatagcctagcatgctcaagtatatcatttcgtgactctccgcatatagcgcattcctccattgtggctacaggaggagaatcgctgggatatgaaaaaagctttgtctctgtatctgtgtttctttggtggccaagtttccaggcttcatttattccactaataggttcaatcacaactcttccttccactatagcgctgaggaatggcttacggttaaagtaactgacgccaggtgcaagatccagtcttagtgccggttcaatgtcttccagcatcagttttttaaacaatgcaagttctttaattgcggcgtaatcgaaggacttcacagctctaccctgtagaaatgtgacaaatcgcttgaaatcctgaaacccctcttggtccagcctcaaagaattataaattggcgaaaaaatgtatttgccgttgtaattttccaaatctggagatccaaaaatgtctgctgaattggagcttgggaggtcaccagaattgatatttttctctgaatccttttgccctatctctgattgcgaacttataggataagaggtaccgttatagtcttcctgagcagactgtaatggtgaggcaaaactgttgtcctgcgtcaaagttggcgtagctgtctttgctctgcctattctttcgttttccatgttttctattatgtgctttaaagttgtcaattcttcacttaaagattctatcatatcatctttctcttttatggtaagaactaatcgtctattctgaatttgggtagagtgggtctcttttcgggcgtcactgaccatggtattggcctcatcaaatagtgatgcactaagctcctcaatttcatgtcgtaacttgacgcattcttcctcagcgtcctgcttcaatttaaaagctgcttgcaattcgatgttagtcgacttcgcattatcttccaaacctttaacgcgctctttcaattggtctctttcaaccttgacagattccaatccatcaactttagacttattgaattcgagattcttgcgtaaatctagcaactcagtctccaaattgaaatttctagtcatagcgctaactagcttttctgaaagaagatccatctccggagacgtcctcgccaagtttttcgaattatctgtattaggcatgataagtggtacctgactgaagagagaaactagagcaccctgagatatcgaggatggaagttgttctgcatgttgattagtgcactataatctggcaagaaccctacttcatcatgtaatctaacatgaagggctccaccagcttatcggtaagtgctatatattagatttagacccggtgggttaccttatagtttattcatcatcgattggttgggcaaatgaaataggggtcccctccttggctattgaattcttgatcgtaaggttttctaggtcccctccggtcaacgaccgagactttaaatgatttattgtaatgttggagagctcttgcaattgagctgcggttaattggccattgctttcattcagcattgatctcaaagtatcttctctaaaaaagaatacttcttcatcggtcaactctaaatcgctgtcatcgatatattctgaagactttatgttgagatctagattggaaggtttccttttagcaccttccccgcttgattcttctcctatttcattgttgctgtcaaaaattgtttttcttattcttcttgcttgttttctcttagatcttttaaccttcttatttagtgatgaaaggccatcggagatatcctcatcttctgaactgatgaccctgttccgcttagctctcttagatggaggcctggcaacacctcgatttcttcgttcattgaatttcaactgttgctcgatgatatctaggttgtcattcacaatgcgacgttgtccattctctccaatctcaaattctatttgattgtcatcgtcagattcattgacgaaaagatcatcttcttgatcattatgctgattgtcagcaccgttgaattcatcagtaccatttctggagttgggagctggtttcttcaagtttaccagttcctctacctcagcatgattactaggaacatagtcctcttcaagatactttttgatgaaagaaaggcatatctctaaagaactttggtcaatgtgtttctggagaacacatttcattcctgtatgtgtcggtatgtcatatccgaccaactccagaagttttcgaaatgtagggtttcttcgaatagctgaattgtacgctttgttggaagcttgaagaatatataggtcctcatcttttgaagttaaatcttcacctgtcacaatatctctgtcattccatgagctcatggaatcaacgatcgtctcaacattatgcttgagccattcaaccaagtccaagtttaacgcttttaacagagaaaccaagattccaattttttgttccaagtttagctcttcagtaaactccagcttccctactttgtactctctagcagttttctcatggacgtcgggcttttctccagtgagaaagtattgcctgattgatacgtcaggattcaaagaacaaaatggcatttccaccaaaatttcctttgaatgattcattaactgatacaatttggacatgaagtacttggagaatgattgcaaatctcttcgagttgactttccgattggaaggactaagtgatttgcgttgacccaataaagagttttcaaaaagtccaatctgtagagatgaagtactaactcatatttgacaaaaacatcataaaagaaatggagtgccagtttgaagtgggctgcatccacatcatccagcctttcccagatgctgatgaacaagtaaacagtttcattccgaatgagtttggttctgatcgatttaatgtcagctttctttttaaatgctaatgtccgcatttgaatatcatcaacttcacctggctcattatcttcttcctcagttgctgcaatccttgagtttctctttttcgtagatttagatttctgaataataacttggtcggaatcgtagaatcttaccattgcctccgtacttttaaagatcgtagacaaaaattgggccgctttgtcaacaaattgagtagataccttatgagcagatgaaacaatcgatataaataactctaaataagcctcttgcccaactattgaattcagtaaaccttctgctcggtcaatcagttgcgaatcgttcgtggacaacatgaagcaggcattggacaacaactcgtcaagacatccaatcagaacataacacatattaaactcctttaggtcatggtactcggaaacttttcttaaaatcaaaatcacattggagtggtcaaatgcagaagctatattgtagaaatctttttttttcaagccctgaaaatactccaatatccattgaaggacatagaaataagcatacatcaaatatgatcggatgttatcatctgaagagtaagtgtgaatcagtttcgaaaaaaaaggatcaaaagattcttccataaacgactgtaaaaactcaatgagaatcttcaacccttctgagtctagtcgtttagctttgtgcaatcttaactgtgagtctaaatctctattcgtcgactcattcttggcgatccgggtatacgtgcgactattgctatgagattttgtcttatctagggttgccaataagtcttttggagatccagagatggtgattctctcgtttcctctttgcagggatagaagagtgccaaagttagagtgtctggagctgtgatttctcttaataccatcaaagatattcttttctttactcaccaaatcactcaattcaagcccagcttccgtcatactcgagtcatgctcattttgaggttcccccaatatgaaactcgacacttttataccgttgagaagatagtacaaacattctagacacagctggtggagcattgtatcattgtaagctttgtctgcattgctggttagagtcaatattaagctcaagactttggttttcttcagaataatcatcacccggttcacatccacgtcgtcgggagatacgcccacaggatagttactactgatattcagttgtttggtagtcttcttagagttgatccttgcatctgccggttctattcttataacgtttctgataaaggtcaaacatagatacataacttttaggtcccttgtcgatctcttgttactaactagcaagggtagcaaaatcctcaatacggctttcaaagtaaggccgccctgaaagttcaatattctattcttatacgtgagatgagctttctttagcttggggtaaagaacaatctttttctcgtctgttttctcaaattcaagtaccagcgggtttgttagcatcactagcagttctaaacttgacaccacaattgattcccaatacttggggttttctacttttttaccttgattatctagttcccattgggtcattatatgtatcaaatcattaggcactaaattgcaatcggcacaagcagatgcaacgtcccaattgttcatttcgtggtcgactgttctgatccatcgtttgatatcctttaagcaaactaatgcctctccgcccaatttataaatggacaatttcgattctgtactgtgatctattccgcccaatgagctgcatagaatagctatatgcgatctaataaccctctttcttaactcttcgtcgtgattctgcaactcaggttgggtggatctagcttgctttatggggcctgaagatttttctgtgaaacgttcttcttcatcactactgctttcaactatatgatgagtgccactgggctcattgtcaataatgaaatcatccagttctggatcttccgcataaagactcatgcttagtgaactgagacagaaactatctgtactaacgcgtcgcgtgaaatttgggatccagaaaatatgctacgaaataaagattctcgcttatgaagaagaaaagttgtaacaaaaaaagactgaagagaagggtagcaaaggtaattggctttacgtaagatgagttatctacatgtaccgtatcttggagcaaccgagcaacccatttaaattcagtgtgatacgtgcgttgaaagagaccatttacattaaggcgttaaggaagaaggttgcccaaaaaaaaaaaactccgcgacggggaattgaaccccggtctaccgcgcgacaagcggtggttctaccactaaactatcacggacttatcagaagtttttagatccatttattatatcaatgtattagactcacttttcgagcatcagagtttatttgaaaggcaatctcttttctctcatggttgacttctgtcactagcgtttttctgatgaccaagtcaaaaagttgccagtttcttgtcataattgtcggaagagcaagacaaaatgcgatagaaactacccttgttccaaatgctacttaaaggatattgagtgctcctaccctgacaagttcaggtccttaagattagacaagctgataaagtcgaagtcgtcaggggaaactgtaaagactgaaagctcttccattctaggttatgactcaaataaaatgcagcagataacaccaccagaagagttttctatggaagacttgtcagccttctcaactgctagctctgactcaaaatctcacagtacagattgtgagacgagaatagacattcctggtatcaaaaagagtatccagttttctcatcagtctgacctcatgtttcttgacacaagctttgaagtttcagggagtttggtctctgttacccagtatcccgagggaatggacaaccctcttgagtttccacagtttgtgcaggacaaagaaaagaacattacattgattaaaaccttacttcatgaatactttcgcgttgctgaccttcctacgttcagctttcccattcgtttcgaagagatgtctagaataatagatgatgctgaaaagaataatacgtggcatctccataaagatcatctttttttggctatatcaattctacttcgtatactcaacattataccgttggaacatcctcttctcactaactgtgtgtttttgaaggataaagaagttcaggttgatctcttcaagagattttttttttacgaaatcttcttatattagacagttcattgagtgtggaagccatgttgattctagttgaagaatgcctatgcgaagatgagtatgatctttgtagttcaacaatacttgaattactgaactgtccattctatcaagaattatgcacctatgttgctcactacgattgcctgactgttcagaacatgaatccaaaagccaaacttgacacgctcatcaaggacaaaaagataatgagatggagtgatttattctgcaagttttgtaaatatggctcattgctttcgataaagttgtttcatgagcctcttgaggatagatttccaattttaaaagacgcaaatttgaagacagaactaaagcttaacttggccgattcggctatgaagggattgcaatatcctttcgtgtggacgcgcacatctgatcatgataagttgctatcacaagctgttgaagttgagattcaagtaatctatgatattaattatcataagctaaagattaaaaacttgctggctggtgcaaacttgtcagagtcatctattgcgactatcgccgatgatgattttcctatagtggatgaagaatatggccaagtcgatgtcgatgattacatccctttagagttgacgagttcgtcccctcaattgcaacacctaaagaaattagctgacaatctgtttgttatcgctcattgccaaatgacaagagtttgtttgtcccttccttcggttgcattgtgcatcaacccgttgagattgtgcctttcctctttgaagtcggggttaaactgcatattggatttaatgctcatgtttcttctgattaaacgtgtgctatgtggcgaattatcggaatttgattatgatcaatttcgacgaaccatcccagttataaacctctatgttttcaagtttgtacaaggtttctttcatattttacatttggaatcacagattctttccattcaacgctaccaaatcaatattcttgcagcaatgtttcagcaactgaaaagcaaaatagttacaagtgcgaatgctgcacccaacaaaacaattctgaggtacctcgatgcaatcgaacatctctgtgccgacattaacgctaataatgacgaattggagactactgttggcggtatttctcccacagtcagaagctgctatactgaaaaattacccggggaacatttactgggcaggaattcgcctgtggagtttaacttttctaaactggacactaagttttgcccattcacagagtcattgaagagaggattgaaaacgtggaagatgaataggaggagcttgggctacagaactaagacggaactattaacgagaaccgcggaattggtggcactacctggcactgaatttgacggtactttagatagtttctatgagttgttttgttcagagcactaaatctaggttcgtttttgcttgtaaatcttcactgctgaattgaatagtttaagtattcagttgttacgtttttttttttattggactttttaatgaattaatttttttgaattaatttttttttcttttcagcgctctgattgggattcagtattttaagaatgctacaataatacgtccactggtaccgggattcaggcagttattgttgtgctgtgcatgacctctccattcttggtcataaagtgggggtaactatgcttatagccatctcttttgttaggccaagaaaattctgtttttcatccatgattgggccataattaacgtattgattcttgataaaggagcatttctttttctgtagtttttttgccagcagagagatagtatcggcgaaacttagacctgttcagctctttaaaatgctaggaatgaagaaaaactagataataaggagagttatgttcatttcctcagtgctatgaatgtttatctacaatatgtttactaaagagaaagaccattgtaaactgtccatacaggtaaactctggataacatacagccacgctttgatagcattataaaacatatattatttctaagtgtggatatgaaagaaaccagacaagacggtttggttaaatcgagaacaataaacatgaccacagggacttcatatccaaataaacttttgcgattatcaattttgcataagcatctgtggtgcagttttgagagacgtggggcacgaaaatagtcgaataggtaagggtttaagccatcctacaaatactacttgtagaccgttcaaagatcgacttcaacgattagtttgcctgaaattctaatctgttctagagagtagctctccagtggcttatcagtaatgagccttcatttttaagaggctccgatcagcttgacacactagtacagttagttcatctggatttccaacggagtagaataccttgttgagacagcgagtgaatattcgaaattgctgcttcgggtcaccagcaaggtatcttacaaaagcacctgtatgcagcgaagcaatcacgcccactactgcatgcatcgcttgaacctaatgctatttcatgtacaaaataacaatttaaaaaaaaatcagttgttgttcgcgcaaaaagtcaaagtggccttggcgtttcagttgtgtgtctagtttgggtaatttcttataacataaagtgaactaccggatactgaatgctgagtgctgctcctccaagcaaggagattagaaacaagctctgcactgccttacaacgcacccaggaattgttcaattccgatgcaagtgttaatctgatctcttatctgataagatcttgaacgacgaaaacggtattgtcattgattactgatacaccaatttcaatacttgtaccaatctacgagaagagctagcaaaaacaatgctgtaaaaaatcatggtcttattctgtcttcgaaaatgaaagggagagagaactgggcggtagtaggatggtcagtggagaatagctaagatattaaaacactaaacctcaaaaatcttcgaacgactgctatacagtgattaaacgattaagttgcatgtttattggtgtccacgtcggtaggagttttgtcaattgtacacaatatatatcccgtgttacggcctgtttgtgcgtagcaggcaacgtgtacgctaaagctgatctacatactgaaataggattttccttctcacaaacaaggagtgtacctcttttctgacgtcttcatctgcccagttgtgagcttgcattaaaataatcaggaagaatccttcaataatcatagtaggagtattacagagtaactgtcccatctcactccatctcaacgcacttgcacaaattataagtccgagaacaataaggagagacactccaacagcccatgtcgtagaacagacatcgttgacccaaacagaaatcttgtacgaaagagtagcgggaggaacttcaggttcctcagggaacaccagcccaagctcaccaaataggactttgtcttcttctttgcatctagcataggtactctcatcctgattcaccattcgcatatatacgttacgaaggacaaaaccatcaataaatccaattagaccagtgtaagttccaataataagccaccagttatcactccagttcattggatgaccaatcaacaaccaaacaacgataacaaaaattgcaataataacaccaataccggtaccaatcatatcagcataccaatcgatagcatgaatcgctatagttcttttctctggcaccaaggccatttcaaggttgggctccatatccttcttgacagcacgtattctagcttcaatagagtaatctaaatgcattatctcatcgagcgtcttttttacatattgatcatgtctctctctgacattctgcaaaaagacagatgtaatcaagagtaccactgctgtcgcagtgttaatgtacatctgccacgtgttagtgaaagtgcctctctcaggattagagccagtagttacaccggtgaatggagggctgtttccagtgctagattcaagcgcaccgcaaccgatccaaacaaagatacctgcccagtaaataatgactgcaggtaacgaaccaattgcctcgttcaagaaagaggacattttgtcaaaccaaccttccacaggaaggtcgacagctgaagattcagcgtagtcaatgtttgaaaggtatttttgttccttcgtttctcccgattctagcttttcagcagattctatcttttcagaatcgacgtagtccggtgaactaagtaatcttctataggtagcaactctagagctaaactccgcccaaatcagattctgttcaaaagactgcatcaactgttgtctcatcaagagagtatcccaaatataagtctgaatcgattgagcatcctgcataacaacttgccaggtattcggtgcgtcaaacacaataccgataactgcccaagcaatcagaatggcccacatggtccaaaacgtaaactgtgttccaaccacccacactaaaaagtccagtcctttatccattttagtctctttacatccattgaaaccaacttcatcttgtcttctaatttcgatgtcaatgtttggctctttttctccaactgcgtcaaagtcttgagggtccacggttttagcagtgtgtaacacagtgtgacgctggcctggataaccaatccaatttctccagaagcccattctctaagagttacagcgagatgcgataagtaaaggatgcgccgatgttttaatactatttgcgaggaattaccaataaagcatgtacagcatctctatgtcaatttcaaattattagcgctgcagactagtgcattgaaacgcagtagaaccttcttggcgttttcgtttcctacctattatagtgaattaagccgacaaaaacaagatcacgtgaacgacttggtgactggctctaaccggtcaacattattgaaaccacctgctactcatgcgataaaatatgtggggtgacaattttcttcgtatcatccaaacgcattcaaaaatgacaaagatgagtttagaaggctaccgcggttcgtttcgaaaagcatcctatcaaaagtccaatatcttgattcccatctttttcagttggcagcgacgttctatttcacgaacaaggaaacgaagctcaaagctgaacagttacattagtgctgcattttaggtagagtaagaaattattccttatagtagaggtgaacttccgagacgaccacgatatttcaaggcccgaagcctcctagtggctctcaccttggtagttaatagtttaggtgcattataacagttccagtcgctattttcgagtgaaaaggaccccttaatttatttcttaagcgcaaatatgctgcctgcatggctcttattctttctaatctcgatggctggcttgcgtggctgtcagacatcggaccctaatttaaattgctcattatttttcctgcatcaaaattttcttcaacttcttaaatgaattttatagacgttgaaacggattccagattaatttgataattaatctctttggagctattgtggcttttcacttttggggccgaagcactttttttttgatcatagcacatactagttactgggagaaaaaactaggtccctttctaagtaataatttgtctccaggatttcatgcctgtacttctcgcttatacggtccctgcttcatcacttgaagccgaggttgtcattcgaagggtggtttggtttggcaaacatagtcaatctattttgtcagtcggctgaaataaacggctggagcttcctagtgaacttgtagaagcaaagatgtttctctatgaatgctgtcgatggaggagttgttaatatgagttacaaccaaaatggggcgtacagttattcagattaagactaggtaagtatcgatgccgtgtgaccatgccgctctaacttggaaatggtacaggagttaatcgaattacttcccagcccagcctatacagtcatctgtcaaattcttagcttttttttccgagacagggctgtcctcaactcctttcggataaagccaaagcctgaatttttttcagttgttgttcaatcgcatacactcgttattaatgtcagaaagctttggaaaatggcaaacaaatcctttacgggcaatgaatcatcacaagggaagaaaagaatgtgacattttgctgtgctactatcaccctctaatcatcgtaataccctgtgtttgtgaagaatgcaggattatttggtgtatgattgctcacaaaaagcgattaccagtgacaaagaataattcatgtggtcatattgtatggcaaatctaaagaccaagttgttttatgcctcaaaacagatcttagggttaattaatgtcttaatctagcaattgaggatcggaccaattgtaaatccactacgattgaatattctcatgcgaagagtttcgtcgcggttcaaatttgcctcagtcatctgaaatcagtgtaaatactgactgcggtctggttctcagcaatggtagggtcctaagtgatcaacaatactggtggcgtgcagggcagcacagctaactcttcttggagaccatcttttaaggctcgtaattgaaaaagccacgatcggtcaaaatttagacatacacatagaatatagagataataatacaacagctataagaaagtaatgtcacagttgaaccacaacggccgatagtatcgtggctaccagaaaagttcagagataatttgatcattcaattggagcggaacgcatccggacaccctggaggaaagcatcgtaatacacagtactcaaaggtggcgccctgcagttttatgaacggtttgagaagcctcgtgaagttggtccgtgtcattggtccgtgtcattggtttaaccgaatcaagtcttcaagttcttcgcgagccagtagattttgaaagaatccaagaatatttaaggggcgatcatcatgatcgagggtaggtgaaaagtcattggaagacggtgaaatacttgctgtcaacctttcgtcgacaactgctgacaggagactgaaacaggccagaactcatatagccctcttacacaactccttcttttttatgctctcgaaggaattgtcaaatacatgaccacttggcaaataatgtgaatctcacaaaagacggagtcgatataagttttgaataaaaagatccaacgcatggcgatttgctggttgctgctgacggtggctatttcagaacaaggcttcaattcacaggagacaccgtccaatacaagggagcggcggcttatgggaacgtgttctccatagggctgaacaaggatatgccaaacctcccaaacgatacatccgcgggtcaagtacggagaaattatgtttctttctctccattagggctgaatcggtattgattcgtcgcacttgcttttgatcccgaggatgtggcaaagaaatttagttggaatactggagagttggggccgtgagtaccttagaatgcactttgctggttgggatcctgttattgatatggtgttaaggacgatgccggatatcatttctttcctctggagaccgcaccctgttgaaggatttgacaatcgaagatctcttgcgtctgccgggttgcagcgcatccaacatcagaagcatttcgtgctggagcacggtttggatttgaagatgtttgagctctctatcgatctcttcaggagacagtcagtgatgcctacgtcgatactggccttcctgcggcttgcgacttacatcgggctctcttcttattcaatgaatcaaggcgtcattttttggctagagtagaaaaacagttgggctctgatgcagatactcatatgagatatattagtgcagcaggaaatgacaaggactgataggcaagattccgttaagtagaatcctctttcgagtgaatttcagaaaataatctgaaagcaggtttttaaagggttgttgatcagcaaggtccatttttgagaacagcatacattgactagatgccgtctatttcagtctatttgttgctgagctcggagaatcatattgaagacagttttgtatctgtaaaaggacccatttccagttttccataaacgaaaaagatcacattctttatgctgttttgaaacatctatctagtaaggaaaaataaagtgcaccattacaagttaattttatggaatccacatttcttaggattgtaaacatctcttttttggagcttccggtctgcggatagtttctctggtcaaaaacaacattgaccacgttgatcagctgatagcaaagtgttgggatgagtttgctgggactcagctgtgaagctgctttgataagccttacactcgagactacaagtctctcgtttagctctcatcaaaagtttcatataacttgtcatggtggccaatgttagatagtagtgtactctacgttacagtactggagaattacccatttcacaagatgcgcttttcacttctcgatgaaatggtcttaaacatgcctaccgtgaagctactggtaatatagtagcccttttgttttgggatattggagtggttcaggggtacggtgaatattagcaatgtgccgacatatacagcgaaggcctaactaattcatgtttcagttgcaatcctacattttacgcggtggtagacaagcaattgatgattactgaaacacaagatattctcagcagcattcatcgtttgcagcccgttgtggtcactttaactagtctggctacagtaagcattggtttgtattcaatgccaccacgatctcacaggcatttctattaccgatcaatatcaattagtgaaaactgttgaattgtcacttactggtgaaacctctatctcgatcgagtcattcaccacccacccatcgatgtcgggaatgaaattactatcaacgacgatacgtcagagactggcactacttctaatattaagtcaacactatttattacttctagggctcaacaatggggcttcttccttttacgacttcaatgttgcaattttccattctcctgtggatagtcacccacttgtgaatgaaatcaaattttctgtattatggctacaaaaacctgggaaaattgacaactgcgactggtgccagtgagattaagtttgacagtcatttgaactgacctgattattatattcaaagattgctttcagtaatattggatctcacgcgttgatgcaaccatagagtatgttgagttttcctgagttccagaagacgaagagtatacgttgtcgttcaggaacgttgacaacaattgaatttttttttgtgcggtgctactgctgccgataattctttgcaaaagtgtgaggtacaatttttagaaactgagacaatctccgacaatgtcttgttattcaacaatactagagacttggggtcgaatgtaaggaatgcacaatacctctgcgcagaaagctattaccccttacgagttgtgctttcttcagtattgcacaacactttgtggatttttagatcaagctaactgattgtattttgttgactcagtaccaggttggccaacgtgaaagctcaacatctacatgccatctatttttaggtcccagaaaccgaaagaatcctttttcgtgtctagaaacaaataacgctcagaaacaaccaaaatccaagttcacgagtttacttgactttagatcttttgatgataacaagaagaagacttctgttgtatgtctatcttcagcgggttcaaaatttcaacttttacctgttgatccctggtttatttatctccccgttccttgtacaccacatggaattcaaccagtataagctacacatatttttgtcagagtcagtaaccagcattgtggcaaggaaacttgatctctcaatgtcgatgcggcaagcgcgatagtgatcggtgttaaccatctgccgtaattcacgccagaatgcagcctacttgtatactgtgagtatatggtccaaaatggcaacccgctgtcgataaaaacttgcctacgagatttttagcaatcttatagttttttttgagcctttatcggcatccaaacttttgatttatcctgatccttcaagagtcgtttttcaaaataaaatcagaggaataatagaattgttcttcatcaatgcagctgcgtccactttctatcaatttccctttaacggattatcagttggacattgaaattcacaatactggacatggatcttatttctttttcgtgacaatcaagtttagtcgcaaataatttattttaccgatgaaaaaattttcctttcgattccaacctgaattgaacaggcaattttgtcaggagtcacctcttagtcactagacactgctagttgcagatgaattcgaatctatttttttcaaggtcaaaatctacagaaatgagaatcagactgcaatttggatttcacattaaataagaggacaatttttctctactttgttgtttaattccgcacatcaaatcttgcatatcttctgtacagctcttaaaatcgcgcttataaccacattgtgattggattgttgtcctcgacagtgaccatgcctgcgaacatctgaaatttcttaatttttctcatataattagaatatttctgcaatccctttttgctgactgttgacacaacattatgaaataattaccctatcaagaattgatagtatctttcatacctggaagtttaccatctcatcttattcggaagaaaagtgcaaataaggcaattttgaccaatatgtcccctatcaatgatgatcgctcccgttatttactatccccagcgattcatcacacttcatcgcatggcagtattgccaatagatctggcatgctcgacaatgaagagttgcacgatcgcagtcaccagagcttgcctttacccattcgaagagaaagcatctctccgtttttgaagttcactgatcaggagataccttctgtcagtgagctaagatttcccccacctccagcaataacttctcaaaatacttcaaagtttgtagaatccgtagatctacgtgatagattgcaccacagtgaagattccattgccagcccctctgtggctttgtccaataatagttcaagcaaaaagcagaaacaacctggctttatccggagtagtcgctcgaaatccatttttgagcagtttgagttattaagcaatacaaatgttcagaaatctctcaatcctggaggagaaaatttagtgactacaaagactcggccctcaatctcaggcattgatatgaatttcctggcaaaacagccttcaagaacctctatcaaatccacagctggaacttcttttcaacaagaaacgaaagagaagcagaattctagcaatgatagtgatgttggttgtcatgcatccaattcgtcgaaggaaacaaaggaggatgtttgttttcccatggccgtagagaatgtaagggttcaaggaattaacttcatggagttggaaacttttattcaagaagagggattggagaaaaaatctttgatgaagcgagaagaagcgtttgaaaacttcgattctggcatagctaaaggtttcagctttggcaacagcaagccaagctctgcaaccttaaagtatgtaccaaaggacattactcaaaacacaactgcagacaatctggtgccttgtttccagtctcagggccttggtgatgtctatcttcgagagaaatctaatgattcttctcacaaagaagaaagttccaatgaggatgatgacaataatggtgtgacctttcaaagccagaaaagaaacactgaggcagcttccgtattgcctgacaggtatagtttttattcgtctgacaataatgaaactgttcatgctccagatatatcttcactagtcaatgaaggtcagaagattgaagaccttttcggtactgaagccacttggtggcttgattgcatttgtccaacagacaatgagatgaaagttttagccaaagcctttggaatccaccctttaactgccgaagatattcgtatgcaagaacgacgtgagaaagtagaacttttcaagaattattactttgtctgtttccactcttttgaaacagaccccgagagtgaggacttactggagccgattaatgtttatatgattgttttccgtggaggaattttatcgttccattttgctcctatcaatcaccccgcaaatgtcaggagacgggtaagacaactaagagattatgtcagtctgtctgctgattggttatgttacgcaatgattgatgatattactgatggatttgctccagtaattcaagccacggagcgtgaagcagatgcatttgaagagtccgtattcgtcgcaagagatcaggaatttggtatcatgttacagcgtataggtgaatcgagaaggaaagtgatgactttaatgcgactgctttcaggcaaaacagaagtgatcaaaattcttgcaaaaagatgcaaagacggggcaaacggcacttggacctccaacgtgtcgttacagcagaatattgcacctagagcagatattgcgttatatttgagtgacatctcggatcatattattaccatgtttcaaagtttattgagctatgaaaagatttttagtcgaagttattccaactaccttgcgcaactgcaagtcgaatctttttactccaatctcaaaattaccgagattctttctaaaattacgttgctgggaaccatattttttcctatgagcatgattacaggcttgtttggtatgaatgctacagttcctggccaagatgctgggtctttgacttggtggtttggaattttgggatgtattctagcagtagtttttgcatttggttttttgggaacctactggatgaatcgttcactagggcccaataagatgctgactcctgtttgtggtgaaagatgagttgaaagtttagagagactgatgaaacaatattttcgagaaagcaaggcctatattaagtctctctaaggttaagaaatacgattaataattcgtattggatcattattaggcaatgtcaccagattatcgtatgcttttatacacagaagatgggcgcagacatcttggatccattggaaaaaagagatgcacgtttgatagtctttgggttctagcagacatcacaacacgccctcccaagaccacctccaccgtgaaagacgcattggcaggcaaaggcctaaacataattttgttggatgctgaattctcctgcaaaaaaaaaagatctcataattctacactcttgtcagtttcacagttattgcgtatccagttttgaaacttaatggtacaaaatagtagagcttttacatctcacgacaacaagtcgagttgtccttctatatggctagatcaggctcactactatccagcgttctgcttggaggaggatcggttgtaaggcagttgttcttgcacggccggccgtaacaaggggttcaattttaacttttaggagtttctcaatgctcggcatcctcagatttgcccgccggttggctcacaaagaggggggttcgtggacaaaactcgtttctcgaagaacaacccgggataacccaaatcctagacggggaccacccgatttgagccgttcagtccctgaacgtagttttgaaactccaacatactacaatgtgtttcaataaatataaataccatgttgatcaaataaatttaaaattatttggctcacgtctaaatgacgtgaaaattctttaacatcaagtgcagttctatttttagtgcgatgaaatggacttttaccccaggttatcaatagttgtgtaggagtccgagtttgacgctgacgtaacaaataatgccgagcctagggttacgtagactgtgaaaatttcaaaccgcaagaaatggggtgagggtgcaatcagtccaatttctaagctgctagttttgaagaatgttttggaattccaataaaagtggataggaaaacaaagcgggctcagctaaatattgcattattcttgcaaaactttctgttttcgactacttatgtttctggaaacctcatgatgatctgctactcaaattagactattgcaagcatgttctagatcttgcctcaagtcttttatcaagttggtttgcgcccggaatcggaaactatgtaatagaatatcttggcctgtctttgtttagcatgttctgacttgatttagaaaggttgattaaagaaacctttgccgtttttactttatgctcgatacgtaaaaggaattttggtcatttatgggaccttgaatacaactagtcttttgaatttgaaaggaaatcaggagcattcaagaatagatacaaaaggaccatctgctgctcttccctatcttcaacttgtttgtctacatcaatgttttgtacttgaatctagtcgctatttgtaaacacaagctagttgctggattcttccagttgcaccatgtaatagctctgaatagcccgctgcaaagctggtccaagattaggccattcgagaatcttaacgctcttatcaaatagtcgcggctttctcacgtcataggtgttgatacgctgttccagctctgcaagataatcctcgttgcatgctagcatcgcagggcgcttcatcgttttcttggaagaagaaactaagtgtttggaccagaattgagccaagtttgatctcacgcggcctctttctttcctcctctgccgaggatcagaaactgtatagcctccgaccagtaattcaataatcttgatgacttcgacgctggtaatatagtattggcatgcaatcgtgttatttgccattttgtggctgcagccttttgattttctgctaaagttttgttttggtaactctgtgaagccataatgcgcttcatctgactgacattcagtcacaaattgctcgtcagattcgttgccgttgatgaaacatttcagacacgagacttccaaaactttcacgtcaggatcgcttgaaggctttgtttgtggattctctttagcagacccaactatagaaaaagaggccacaatttcattcgactggtatcttctctctatacgaatgattcttctactatcttcaagctcatgcttgttccattctgggagacacatatcctcgcaggtattgttttccaatcttagatgggcagcaacgtaccgggttccaggaattaatggctctttgggaggtctacaattgtttcctccgaaactacgtccacgaaccagcggtacgtacgaatggttaaggaacattgatcccaagactttgaattcatgggaagaatcaaatccctcgattctgttatgctgtctaagttgacatattccttttttggaattaacgacaccttctaatgacatagtgggagctgtcaatgttgccatagaaccgtcttctactgcggataccgctgagaatagttgtcctggatcaaaattagcctcgtaagggcatggatcctcatctgacggatcaaaagatataccagtatttgagtacacaaacaatgaatttttttctgaagaggcatcagcaacaaggacagaggtgtcagaaccaatgaatgactgaaccgaacttatttgagggatttcagagtaaacaaacattgcagaatgtgaattgaaaatatttttggtaaacatttcagacaacagatttgatccttgctgtttatgctccaattcttggagatgttcagtttttatatatgttggagcagataaaaccatggggtaaatcattgggttaccggctgtgtcttcgacaaaatcggctttcaacaaatcctcagaaagctttttttttctgaagcggttatcgctgataccgttgctgttactattgttggtcctaagataacactcgttcccagcgtttactgtcgacatagcgacgaatggagtgcttgaacttgctgacagtagctgcattttaggtggatgatataggttgggataagtaatagtaagaaaacaaatctcggacaagccgaatgttgtttgaccacaacaaagagatgtatatttatggatgcaccagggctaggtaaagattttggagcttgggcaaagaaaaaaatacgggagaaatctgcacacgtcacatgctcagttttactgcaaggtaggcggaggaggacaactatgcatttatgcactatgaaatccgcgttttactggttttttaatctcaaggaatgatcaccttcttgccgcagcatagacccaatagtatctaaactctattggaattagtaactgatgttgcagtttacatgatagatggcactaccacgagcaagggatggcattttttttttttaggcaagcaagtctactttcgtatagtctaccacaacaataatgcaaaggcaaaggaataccaaatagtttgacattatacagctacttgctagtgaacggttatgtccatgcatcaaaatagtgctaataaatcccagttttcgaaatcatgacttttcggccccatagtgaatgatcctttagttcgacttaaatgttggtcttagcaaaataagcaactcaagaaatactcctttagagaatgaaaaactcagtcactaaatagttatggtgcagcatacatgcgggatcgagtcacttttaaggttcaccttgagttcaaattttaaccacatgcatccaaaatgcaggatgcaaagagcataacataacacttcgcgcagttaattacaaaccgtaatcttgctcgcacacggtaaaattagtctcggtgagttgcatgtaactcttagcaaatcaattcatgactcatgcagcgatagttatagttttccttttgttaaacttgcataaaccagttgtggaattctcaaggagcaatcggcagtagcctgttctgtacatattcatatctattagaatctggtgctatttatgcctcacttacctattcatcatgcgattaaataaaacgtaagccaaacgtgatcacgagagcttatgcgcaatgcatgtgacgccataaaaagtacagcaagataaagtcaactcaatttgaaatactagttgcctgctttgttcgtgcttgaaagtgaaatgccaattctaacctttccaagaaatttcacttgaaaggcatgcgtataaacaaagttgaccaagaagtcgcagtatacagtatggcactaatgttaatagtttggaattagcagtttgcggcaagcttgttcacaattcttatccaagcagtcaaaactacgcatgtactcgattaaaaacttctgaaattttacgtgcaatctactttcgaacgttctgtcgtaatgagcaatggattgagcatgcaggctattctgcaaatatcgactgggccttgtttttctttttgttcgttacttgattttgttttacaacttgagtttaaactggtttcgtcatgacaaatctcaaaaacttgattatactgaaattctgccccacaaggctgcatagcatagaatttatgggatgaaataaaactgcttgtttgatgagttccaatatttatccttgatatttgctaagttcaaaaaatagtcgaatactatcttctatattttgagatgcctggagtttccaatatgtttcactgactcaaggacaaaactttcaacaagttaaatttttgcaacacctgtcctcattgtctctaggaccattaatacattcatcgagggccgttactttcaagggaaaaaaaaagctcaaaaaactacagcggtatcggtgaatctctttatggcactacttctatttggtccacatcatgaactcggctatttgacatctgatactgatgaaacgattttgcttaccgtaaagatacattggcgttgctcaaatgcctcatatttgcccaactgaggagtacaaaaccattaatatggattctaaagaagttcaaggactcaacttcgtatccttgcaacctgaactgccccaaaaaaccaaagtacgttattaatgtattgggccctatcaatttaagcatatttgtggtttgctattgtacttagtttgggatgcaggaccagtgcttttgatgctaggaactagcaattaagcgagttttgtttcacctataaataaagcgatctagcttggaaatgatgattccacctttagtttataccactgcagctgaactgccggttacatcacatggacatccgtacagagggatctgtgaatcctcctttcagcgactgtggaccactctaccaaccagttaagccattaaaactgggagaaggcaagtgcctcaacttctgttgttgagctgactagttgggataccacaaagaagacaaaactatggtcttgatagagggccatgtagacaactcttaaggtcaagatacagctttttttgtaacaacttactttccttctccagtccatggcccagtagatgtccgtcaactgataatcgagttaagctaactgcagagggtattagagccttccagctcagattagggtctttcacaatttaacttaaaatatgacaatcactgtgcgctccaggtattttcctgattcaagttagcagacttatcacggcactactacaaacatcgcccatttaataccgaatgctggatgttttggtttgatggggatgcagacaatactttttcccgaattaatgtctggattgtttgttagatattttgtttctcgcaattccagacaataatagaaaagccaacgtatttgctttgtacttaccgatctgctcatgacttgtttacaagaaaaatttgattgctttctaattctttcgttttcctatagaggtagttgtgttatcctagttgatattctttattctttattatctttccgttttcattgtgtttcactattgataataccagttaaataattgagcacctttagtacacgtaagagagatcaactattatgcaataatacgtagctcgcgtgtagatagcagttgaatatctcgttccaagaagatatgctgtgagtgagttctaataagttatttcttggcacaatcaggcttggtagtgagtttttttaagaagtctcatatgatcatgttggctactgcatggaaagtgcattttgtgagcacttggtctatcttttgctctacccatttaattgtaaacgctggttcttcaaaactcctataaaccggtaacctcggtttaggctttatattttaaaaggcaacatctcatcattttcttcattatcgattggaatttgtggcctccaatttctaaattagtcaagtagtgctgccattcctcatagtcgagaaggaggggagtctaatcgttccattattcagtgctaacttgggcttggcaagttgagctagttactgatatagccattcaaaaattcccctcgttatgcagatttacttgataagtccgatatttcaataagtatatccgattgtgcatgcgtacagacaagggccgattcgctgttgtagcattaatatctgtcgtcacctttgtttaggactcttgaaacgattggcgtaattttaataatcaaaatttgtcggtacaagtgcctttaacgggtcattaatctgagtaattgtctttattaagctacgggtagatgcaagtgtcaaaggttgtttgtgcgaactgcctcgacttgtattagcgaatagtgaatgctggatgctggatgctggatgctggatgctggatgctggatgctggatgctggatgctggatgctggatgctggatgctggatgctggatgctggatgctggatgctggatgctggatgctggatgctggatgctggatgctggatgctggatgctggatgctggatgctggatgctggatgctggatgctggatgctggatgctggatgctggatgctggatgctggatgctggatgctggatgctggatgctggatgctggatgctggatgctggatgctggatgctggatgctggatgctggatgctggatgctggatgctggatgctggatgctgga

SEQ ID NO: 100 - DNA, 79912 bp, Pichia pastoris
actcccggatccatataaatctgtatccttcacttgaaggaaaaacacttactcatctacactcaatacacattctgattgcaaaggtctagttgctgcaaaatctttcacttacatgcgaagagcctatgtttccgatgacgtcttgactgtaggaaaagttgcatcttccaagtccaactcgaaagaaaatgtcatcctaccaaagattgcaaatcccagacctgatgttggccagaagaaagaccaagcgctgcgtactactgcattgagcgtgatatgttattctttgctccattcgtatacattttcaatccaaacatactttgagatggattgccagctagtgtcattcattttctcttagttggttagccttctgtatgctgcaatcctgttcgcgttagtagcctttcgtgcaagcaaatactatttgaagcctgcagagagttccaggttccactttgcctcgctgttggtgttgtctgtgcctcctgctctgtaagagtttgcacagccatgcaaaagaaaagtaactttagagttgaagatgacagagtgttttctaccttggcaaaataattgttgtcccagtgcgtatggctgcaacgttgaaataggctattgcctcagaatcatagagctcaattatattccaagtcgtcgaacgtcctacgatggattgaaaatcgatatgaagccttcaataaatttcaaaagcacacaataaaaaaagaaaaacatttagaagtaaataaagttaaatgaaaatgaaaaataaaaaggggcatctaaacgaagaacacgttaaccagcggaaccaaagctgctccaaagaacgatgaccatctcagggcatttgcttctccagtttgcggggaaatagttgaaggttgagagactgtgtcagatgtactgtgagcctcaagctcggaacctgtcaggctgctttctgctaccccaccagattggtacgatggctgggctgatccagccgttacggccgatccactggcaaagtcggatgactttaataccgtttcgagagtgctcagctcaactgccgattgatagctttccagaggaacatacaccggtaccacggttgtagaatgcgtatctgcaagagtggtggtcttcagaatctctccagtcacaatagtagcttgagtgcaggtgaaagcatcgcatacttctcttgtgattgtaacagtcaaagtatggacatttggcacaacgtggctaggttttgccgtatagattgtttgcagaacctcacttccactaatgcttgttgtcttcacagtgacaatgtcggttggcaaaggacagtaggtagttacaaccgtagtcgtacctccggtcgtgagagttgtctctgtgacaccagtcagagcagtagtcttggtgcacttttcaatgtcacaactggtcaccgtcacaacagtagttgaaatactaccgtctgtcaaggtgctctcactgggcttgtcgttgtgatcactggtgattgaaggacaaatcacaatggtgctaccatcagaatctgtagtccatgtggtgtatgatccagtccaagtggaggtcttatcggcagtaatcgtagctgatggcacaactacaacagtgcttccatcagagtcggtggtccatgtagtgtagctaccagtccaagtggaagttttgtcaccaataaccgtggtcgactcggatccctcgagagcaaagttgtaaacgtacccttggtactgagtcaacaaggcgccatttggtagtttgatttggaagtctagcaaagcgtgctgtgatatcgcggcaatcacaactcgtagagggtagtactggtcagctaagaggtactgtgtagtgcttatagtctgccccaaatctctagtgtgttgaataacaaacatggtctggacttgtttcaggttttaagaattcgcacccgacgctttgcaaagcctggccggcagcagcaggactgcccacaaacaaaattgaattgtagtcagtgttgctgaacgaaaagacatactcaccatccactggagctctaaagaatccttcatactctatggttgcgttaacgtatgatccggtattacccaaagcatctctgtcaatataataaggccagtttgaatccgtgtcaaagttaatgtcgctgacgccagtagcatttgtcaccaatcccaggttctcatagccataactcaggaaaccgatctcattggcaagctcgtagttgtcagcgggatagtggaacacttcaacattaaagccgtcaaacacagaaactccgtcactgactcccgaactaggaactggtgtttcaacaatgttagtagcagtttcagtatcagaaggaacaagttcaataacagtactgcttccatcttcaccaacatcggtggtgtacgatgtttcagtaccggtccatgtggcagtagtgtcggcagatggagttggagtaggaacaagctcaacaacagtgctgcttccgtcttcaccaacatcagtagtgtacgaagtttcagtaccagtccaggtggcagtagtgtcagcggatggagtaggaactaactcaataacagtgctgcttccgtcttcaccaacatcggtggtgtacgaagtctcagtaccggtccatgtggcagtagtgtcagctgatggagtaggcacaagttcaatgacagtgctgcttccgtcttcaccaacatcggtggtgtacgaagtctcagtaccagtccatgtggcagtggtatcagcggatggagtaggaactaactcaataacagtgctgcttccgtcttcaccaacatcagtagtgtacgaagtttcagtaccagtccatgttgcagtggtgtcagcggatggagtaggaacaagttcaataacagtgctgcttccgtcttcaccaacatcagtagtgtacgaagtctcagtaccggtccatgttgcagtggtgtcagcggatggagtaggaactaactcaataacagtgctgcttccgtcttcaccaacatcagtagtgtacgaagtctcagtaccggtccatgttgcagtggtgtcagcggatggagtaggaactaactcaataacagtgctacttccgtcttcaccaacatcagtagtgtacgaagtctcagtaccagtccatgttgcagtggtgtcagcggatggagtaggaactaactcaataacagtgctgcttccgtcttcaccaacatcagtagtgtacgaagtctcagtaccagtccaggtggcagtagtgtcagcggatggagtgggaacaagctcaacaacagtgctgcttccgtcttcaccaacatcagtagtgtacgaagtttcagtaccagtccatgttgcagtggtgtcagcggatggagtaggcacaagttcaataacagtgctgcttccgtcttcaccaacatcagtagtgtacgaagtctcagtaccagtccaggtggcagtagtgtcagcagatggagtaggaacaagctcaacaacagtgctgcttccgtcttcaccaacatcagtagtgtacgaagtctcagtaccagtccatgtggcagtagtgtcggcagatggagttggagtaggaactaactcaataacagtgctgcttccgtcttcaccaacatcagtagtgtacgaagtctcagtaccggtccatgttgcagtggtgtcagcggatggagtaggaactaactcaataacagtgctgcttccgtcttcaccaacatcagtagtgtacgaagtctcagtaccggtccatgttgcagtggtgtcagcggatggagtaggaactaactcaataacagtgctacttccgtcttcaccaacatcagtggtgtacgaagtttcagtaccagtccatgttgcagtggtgtcagcggatggagtaggaacaagttcaataacagtgctgcttccgtcttcaccaacatcggtagtgtacgaagtctcagtacccgtccatgttgcagtagtgtctgcagatggagtaggaatctgttcaataaccgatccgtcagcatcagtggtccaagtggtgtaagtaccagtccatacagaagtggtgtcagctgagggagtaggaatctgttcaataactgatccgtcagcatcagtggtccaagtggtgtaagtaccagtccatacagaagtggtgtcagctgagggagtaggaatctgttcaataactgatccgtccgcgtctgtggtccttgtagtgtaagtaccagtccatgtcgacgtggcatcagccggcggagtaggaattaactcgatgactgtgctgcctccattttcaccaacctcagtagtataagaagtttgactaccagtccaaatagatgtagtggtatcaaccggtatgttgggaacaaacggttccacccaaagctctgcttgatatgtcgttctatcgccggtgtatcctgtactcgctacattgatataaacatttgtttcacctgttgctgtggttgttgaataccaggttatgcttcgtgcatttacgtagtgaacatttaggtatgtcattgtgccggataccgagctgcttatgctgaaagcctgtggggggtaagacggatccccatcatagcttccaaatgctaatgcagttgctgcattagtgccgaatgacagttttcctattactgaaccagtaacacggttataacctgtcatgtgtccatcggtaccgagcctacaatagaattggttaatgggagctgccgtggttggttgccaattaacgaagctggattctaaccgacgaggaccaccaggaacataatacaagtcccaatattgcatggggtttgacaaactatcagctagaggatagccatttggagtgagagtgcgaaccttaagcatataaaacgtatcttgtccgaatgcgtgcgctgcaaatatgataaagcaggctagcactgtcactaaactcatgttgttctttgttcttggctctagggaaacagcatcggtggaatagatggcaaatttatatactcttgtatctgagaaaatattgatggacaacaggccatgtattgttgaaatggaatagaatgtccgaatgatcagtttatcattcgtgttctgcatgaaatcgtatagcgtgataaaaagccagaatcaccttgcataagagtgcagcattaatttaccaaactaggcccagatatgaaaatgggaccgaaaatgatcgcaaacaagacctaaattttgctatatattcccaaaataataaatgacgtgtaggatgtgtccctattgcaaaattccagtaggtagccaagtgtaattccacacatacttagccggattaatgaaacaaattgaatagcctgaaattttgatcaattgctattaggtcgccaacattattaaaatcactttgttttctaaaagtcgggtctaatatcaacatttggaatttcaagatattttacgttaatcgtgaaccgcgtcacaggcttaggttacttcttactattagctgcactcgtgtgttatgcttggcatagcccgtgtttatttgaatctgcagtattagttgggtacatgttgcacattatgcaacctagctgaaataggtcagacccaaatgaaagggatgacaattgtggctagctgcatgaatcatgcccttgatgacaaaaacgttgtaataaatattaacaccttagtaaatactctaaatgctgccatatctagtagagccaaatctgagaacatattcattttactttttttactttttacaagataggtagttgatatatccgttacgaagatatctgttatttcattacgataaaaaagtttcaaagtcattgattgatgatatttgctgctgcacttaaactataatcaaactagcccatttctatatgcgcgccattttaagcgcaagaatttgagaatttcagaactatcatttcttttgcttgcacaaacgaaataggcaactaagaatcaacagcaaccaatttagatggttgcataaacttaaattagtaatgttctctgttcaataccacagattcaaaacatacagagctggcattattgaaactcttttttttacagccccactcaagattgatgaccagttagttccattaacttccaaaaattagtgtaacttttacagaaactgagacctaattccaacatttggctttactaccataaagatagcaggatcatccgaattttgggtacaggatcttaattaatgatcacgcggcgttgcatgcagcatgcagcttgcagattctaaaatcatccttcaaagcattcgtcaaaacaattctctcgccaagaaattagtagattatattgtgctgcagcatacccttctcagcctacacgcttaaacctatgtggtgatgtcacgtgtaccggaaaaaaaaatacttcttggctgcatctcaatttggatactgatgacgacaggaatcaaaggaaacagaaggcaacaagagtacgctaaatgacttattggtcaaatagcttctttgataccacatgaaatactgattaagctagtaataccatagtggaaaattgtgatttcctgtgcaatacttaataaattctccttcaaacttgtcaagggagagccttaaataaccacatgcttacgaaaaacatttgcactactcactcttctatatttgtatactatctatctacgaataggcgtagttgggtcttttaaaatggcagacacctttttccttgttattaatgtctatatgggaagaaacttatcgttcggggactaaacagtaggtatcttcttgatcaattagttcaggaccaattcttttgatgggtttattgctgcgcggatagcacagtcgtttgcaggatggttctaggcagagtttgacacagtacttgcaactctagcctatgactttttaaggttagtctgtcttttcgaagaggcttgaccgctattttgtacagactggcaagggtatgcaatatatattcttggcaaaacttcacttcactaacagttgacgctgaaagaaaaatggcatgttattgtatcggtagaccattctatttggttgagaagctagcaaggaggaatgagctaatggtggtaaagatgttaccaagctgaatgaagttatttagcaagacagaatggaaccagccaatgttaattgcaatgtcaaacagtacttgtgctggcgctaaaatcagtgcaatagcaagtcctgacgcttcttcagattgtggtccaatccattagtatgtttgattttgttgtctacagaggcaaaagtgcgtatgaagtagaattaagtaaaatttttaaaaagaaggcaaatttcgaataatgatgaaatactcctcagttgtgtcaataccatcgtttaaataaaccttcgcatcttcggactaaaaagaatctgttttatcagttcaagatggccaacaagcaaattgatatgtgggccacgagtgagaaatccatcaaactatataccaatcgtaaatcagatgccgaatttaatccccttatagggttcttttttgcggtctcttcaaattaatggttctctttggttgtcctgaccgtagcatagccaaccacaagaaatctggaactttatacggtaaacttttgtcttgaagccagtggcagaaaaaaacgaacctcaaacccggaaaaagaaatctgttttgaacaggtttttagacgattatatcatagtaataaatccaactctggcctaagttccaaatcacaacgaatacagtgcaaaggaaaaaacaaacaagaccgatgttcagatgaaaaattttccattaactccatgcacaatagttaattgtatacttgggttcctcgatgtagttttgtttactttcccgccatttacaagcgacatttttggcaactcaaaaatttgacgtttcattctaaactttgagttgacaactaccattatcggatgacctaaatcggggttgctgcatattcgtaataaattaatacattcgctgcagtacaatgtttctaataaaaacatacgtacaatatttgacccactaaatcttttgatagtcacattcaattgataaggtatctccccatcttagtcaactctcaagaattagactgagtcaattacctctgttttgttcaaaatagtagttgcacagacccatggcattttgaaaagcggcactgatatctctctagccttcaactttaggtccagtaattatgctcatctacagtctccgtgtatattcaaagattacacgctgtaatttcaagaccgcatcacatgcatcatgcataatacgttgacgcaactaacttggctcatttcatgccgatcgaagggcagattggcgaagtggcgtgtaaatcagcagatttcaatataagggcattacaaaacaggatataaccgaactttttttaaatccacacttggtttcatgcaagtgttgaataaacaacatatgatcatctacgcaacctcaagtggtggcaacaatttgaattgagtgcgcagagactaacatgaatgtaaccagcgaagttctagacgcgcgcgcctacattcgagaagtagacaatcaaaacagattgtttcactaatcctgatgatcaacagtactaacacgatatcaaaaattgagtatagctaccgggaaaagtcaaaatgccaatttgaaactcctgggtgggtggcacgtaagctgagcctcaaatgtaatattaccgcttgatttcgccacggtaaatatctaatgtgtatccccgagtaaagggtggggaatgtgatatcatcagataatacttcgcatgcagcctgcaggtaataaactttgcctctgaattgaatattaaacctaaactggccgtgccaaggcattgcctgtaccgcgaataaactcgatcaacttttaactgatgctgtaggttacctatgttacctatcagacaatactgtcacgtggattaggatataatttcctcttggctgcatcttgttgtcgtgtggctggccaatcacaaaccaaaccataaaaaaaacgaaatcctgataaaaaataaactcacttctcttcacgtagctgctttgatctgtacaagaaagaacgggattcgataaacatcacaatcaagaattatgactttgtcccccataagagaatggtcaggatttctagtagaaggtaattatcacaaaggagcaactaaggatttctgtccgatgcagctataaaagtcggaaatactcatccacattcatttcgtgagatagaaaaaaacatcgcacatgcgagtgaacgcgaaaaaaaagaattgaaaacatggctgtgcatactgcataatactcaaatggtgtatttatgctttccagagcactttagctacttcatgtatggtgttttctctcatattttactttttgaacttgaatttgctttttttggtcccggaccttttgtttgtacgtgcgttactgaattgtggtactgatctcgtgggcctaatttacaaccattcagctggcttcctgcgtttttcccaatgaattcatcttcaactcgtggcctgcaagctatatcactcacaccaactagagttttattcactttgagcactctgttcgccgatacgtcaaaaatgtctgctgagaatggggactatttcaggacaaacagtagcaatgaattcagcaataactgctttaacaaagaaaagctctcggaggacctcttggaggccagttttgtcgattccccaatcgaagacacaataccccactttatgctatcttcttcaataaatgctgattcggaacagcctcaggaaccacagcatcgacacaagaatcaatccagttgccatcgggaactcaagatcgaaacaaacgatcagcaagaaccgtatctgttgcctgatatgcttaccaaaaacatattcaactcacagtcttctatgtttgtctattccagcatcccacaaacaagctcagtgcaatcgtttatagacacaaacattttttccgctgttgatggtggtgccgccccagaagaaaattcattgtctgtggactcaaccttaggtccatcttctgaccaatcatttgaaaagctatactcttacgaccaaaattttgagaaagaaccacaatcgccagcatgtcccttagtaaaatgtgacctagtaggcatcatgaaagcatccacaaactcattggaggtagctgtcaacaccaaaagacaaatgtttcagcttagacaccaaaatgaaattgagagtctctatgtttctagtgacatcgttattgcgacatcaaattttcttgaccattcatggattccgctgatccgtggacgtaatttcggaggaagcaactgcaaaccgcccaagaaaccattatttcctggagcgcgctatgttactgcccgtctacgattggaatacagtagctgtgaagatatgtgtttaccggaatggaacgagtatgaactcaaagacagtagaagaatcattcgtcttgagaggcggttcgactccaatgaaatcgtggcctccttttccattgtcgggtctgctgtagagaaccctgaaactaggcctgcattcaatcctaacgtcaaagtgttggaagtttcgtgtctaaggtgtcttaccaacaacaacgaatctgacgaggagaactgtgtcaacaaagatttggatggccgtgtccacaatatggttaaagactcaattggatgcaagtactatattaccagtgttgaagtcataaagattatagaattactggtcggaagctcttcaatttcagatccccaacaaatgagaaaagaaagaggccgtgtgagatcaaacttggctcagttctggtccaaacatttagtttcttcgtccaggaaaaccaggaaacaacgtttcttgccaacatgcaacgatgattatttcgcagagctggtccatcgtatcaacacttatgacgtgagaaaacctcgactattcgataagagcgtaaagattctggaatggcctaatcttggaccagctttgcaacgggctatccagagttactacatggttcgactggaagaatctagcaactaacttgcttacagatagtgactagcttcaattacaaacctagatgtgaaacaataagtttaggacaggggtagagcagcaaatggtacttttgcatttatctttcgacgcttctgatttcctttcaaactcaaaggactagtagtatccaaggtcgataaataaccaaaatttttcttacgtatcgagcataaagttagaacggttggttaactgaatgtcttttttgcctcgaaagagggggattgtcaagagtctcatttgataacagttgctgcgtatgtttgcacaagaaaacatgtcacatataagagaatccgtaaatacgccggttctctaataggttacagctagggtgcaggctttaaagcagcatatcaattatctgcttcaagaaatttgcacctagaacggcatgagtatatggaatgagaacaaaagccgcaaatagtatccattttttttcttcttgcctctgttacccaaaccaagtacaagcgatatgaatcttttatgttttcatgtaaaattgtttgctcttattgccactgtttttgaataagtgggaaacgttgagctgatgctaacggtactcagagaatggccagatccaaattgtttttggttctgctactgatgataatcgaacagcgcaagccacaactacatgaatggactaggtatccaagtcaccttgaattcttactttcctaataatctggacacttttttacaacaggtactgtattccattcccaaagatgatcctccagttagcgggtgtactactgagagacaagttgaaaaaacagatgctagtgcagctgctatttcatggtttcctagtgcatcctggtatgttatttcttatatggtataattgtttgtccttcataaatatgcgaagcacaaaattcaaattgccttggtgtcaccaacatttggtatacggatttgaatttaacccactttgagaacagcgatgaaggattagttatttatttttaggtccagaaattgtgtaaaaaactttcttgtaagtaattttacgtattaaactgttgctgattaccaacttctcaacaataagaatgcaacatctacccaagtatcaaaataccggcacgtactcaaactctgagcttccatcattcggctaaatgctgcacccgtctatgatgaaacttgctgtagtcctatgtttcaatgatatcattatgacaagagaattcaaattatgcctccaatttatagtctacagctgaagataacccctgccacctgtccagaatcatagtattatattaggttaaatttttagatggtttcaaaagacacatataaatgtatctcaaaaaagacgtactcttgttacggctagcatttcgtacctagtacccccagaggtttggaatcacaagtatgtaccttatgagatatcctaatatactccgccgacgtacttttatcatcattgactccagcccgaacaccagagctgttcaaacaggctctgattaatcatggcacacagagtgtagcgtccagcacccaattcatgattacatataaataattgccaactaaaagttgacccaactaactacttggtctctgtacaggatatgctggtgtcacgtgagaatctgctaatccccacacaatcattcgcttaggaatgcttaacttgaacttatacattacccaatcttataatctcaagggtgtcctcattggtaacattagctttcattgacccattgatcaaaccacgttaagctggcgattaaatcatcattcaaatttggaatgccatccttgtaatacaactcttcagtttcagcagtgtcagtacccataatatgcggacctttaaagacttccagttccatctcgtcagtatgcttatggattcgttcctcaactttttcaaactgtaaaaatctagctttattgacattattgggaccatggtcaataccaatgtctgtcaagctctttaaggattttacgaacctcagcacgcacaaatgatttaccatttttagtgtccagatacattcctctgccataccggccttatctttcaattgagttagaaaattcatagccttctggaaatccgacgtgcacttttcatgataaagaccagcgtttatcagaatcacgtcgattattgccacattgaatagcaaggataaattcaaccaccatggaataaacagtaaatgttctctgaattcgatcaaagattgttaaaacctccgatgaatgtgccaagagtctagtggtatacgcaatcgatccgtcagattccagctcgcagtccaacagttttagtagcatcttgttatataatgatagcacgatatcatgatacgtcaaatatatctggtcaactaataatgaatcataatcacatcgttgcagattttcgtcacaccaatttctccagttttgcagttgatcgttgatattacatagaaattctttgcgcatatcagcagtcttcagattatggtactgaatttgtcctgcaatcttagcaaggtgaatcattgccaatgctggatgctccaaccaatcgtcagcggaagaagtcacaagtggtggaagttccaaactaactgtcgaatcatgaatctcgaaatcttttccactctgataagagtataatttatcccaagtttaaacgagccaaaaaattctctttgccttgattacttcgtactgctttaagggcgcttcaacaacaatgttcaaattcaaagacatccctttacacattctaatggccgtgcccaaagaaccgaaagatgaattctgacgatgcgttgctcttagataaagtgttactagtacccatgattgaattagttcaacagactgccactcgaaacttagttttgatataacttcatgcgcagaatcaaacaacttttcttccaatcttgggttgatcttggccttgatgtcgataggaatctctggatgggcctctgaaaaccttatcgatatcgcaaatatcaagtagagaatcgaagtgaacaacctggttgactctgagggcacttctttggagacaattaacatatagttatcatattggtttctgaaaactttgggatgaataaacgaaaatagcggattgattctatctagaaaaaaatcaatcaaccaactacacaaacagaaatcacgaactgtatcaataagaggatcaaaaggcggcaaagtcctttgctttaggtagtggccaactgacatattccagccgtaatactgaactcttggaaccgcaagatcttcactttcttgtgcagtaaggatcgcatggacagattctgcaaacttatttgctaagatactatgatatcttgtcacaacaccatacctgttttgagaatactggtagtgattttttaaaaacatttgatcacaatttgctttttctaagtgattaacaccagcgcatgtgtgcgtactgctttgaagctccataattctgttctcgagatatttgatatattcttctctactcggtttcttttgctctaagctaaccaaaccggaacgaaaacctctgttatctacactgtctctgggtaaccacaaattgtagtcacacggctgtgtatgttttgaacaattgctacaaggtgatcctccatcacattttatttttcttcttttacaacggctgcaagcccgctttgtccttgatctattcggaatgctgctcgtttggccatcaactggcagggatgtatctgtagagcggcccttatcaattttatgttttctagttgaagaaccgatggagccggtggcgcctttatcagaatcatctaagggtggtactaatgacggtttgggcgtcatggtttcagttatggttacaaattgagatggggttggtgcgaaaggtacttccgtcgcggtccgcttacgcggctcaagatccgaagaacggatagtgtaaccgtcatcttcttataagaaaaacgatataaaaacatgtttcctaagaccacttataaatggtagaatacaacttagaaattattatcaatcggctgggaatcgccaaaaataatcatgtctgattcaacagtcgaacaatcttctccagatgacaatatttgcaaactgaaccacctaaaaaaagaggaaacaacgaagcaagtaatagaatttgatcaagaggaattccccgagggtggatttgggtggctagttgtcattgcaggttggtgtatgatggcaacaacttttggaatggttaacagttttggggtctatcagacctactaccaaaccacactgaaccctgatcaaaatgctttcaagattagtgttattggtgctttgcaacctttttgcatttatctttttgcgataccaaccgttactttgctgcaccatctagacgctagggtcacaattgcaataggggcgtttattcagatatttggtctgatgatgatgtctctaacaactaatatttggcagttgtttttaactcaaggcctgttatttggaattgggagtgggattgtttacttgtctgggctgactgtggtaatgcaatggttcaaacggagaagagctctggccatgggcattgttagctctggatcaagtctgggtggtgtttattggcctattgctgttaaaaagttgatttcaaaagttgatatcaactggaccaatagaatattggggttcatttatattcccttaggagtgatcatggtggtgtttttgaaacctagactatctttaaaggtggtgcaccaaaatattggagtttcagatgagaaaatcaaaacacaatggctacctttccagtttaacgtcttgagaaattggaagtttttgctattaatttctagctttacggtgacaaacttttctctttttccaggtttgttttacattgatctttatggccaaagattggcccaaaaactcggaaagtcactggtagatcccgactacttgatttcgattctgaatgccatgagtctactgggtcgagtgattcctggtatcctggcagatatgtttggccgtatgaatgtcctgatacctttcctgattttggcaggagtgactcccctggttctatggttaccatcaaactctaatcaactactactttcctttgtaattatttggggctttgcttctggagtaatggtgtcactatttccaacattggtacctcagctgtttggagtaaaggacagtcaatctcgtttgggactatttcttgcaattgggggcattggtgctttatttggaccgataatttgtggtaccttcattccattggctgttgatgcccagggaattgatgggtttaacaaagttgcaatttttgttggtgtaatgatgcttgggggtaccattttgcttatccttctaagacttgtatactcaaagaagcttaatactatcatttgatcattagactttggtgcattgggctaatttgattatttgggtaacatttgcgatgtccttataatacccatatgcagttcttttcattgcggctacatctagcataaaaacccttaccagtttagactgttcaaagttcgatggattgaatgactacgttgcaactgatatcgcaacgtttcaagtttataacaagccaactaaccattatcagctgcatccttttaacgagaataagacttccagcagttcattctctgcaccagttacgttcaaaacatacgtgggtggttctgtgatcgcatctttctggtgagtcgtttatatacacgaagtttgaattcaaactacgccaatcactgctaagtaatgttatagattggaggcttagtagctgattagtgtcaggtttttttggtatgcccccagattaggataggtatagaggtgaactgcatatcgagctttcaaaaattgaccaccaaagtagtttattttgacctaaattttgaggagtgtcaacagattcacgtttacgggataaattttcacatgtcgtattttatcacgcacattaatgtgcatctgacttgttgctcgttcgactcaaaaggctatcatagaatctgaatattcttgccaataaggaatacgttaataagtttgaagtcggtgtaagatgttcgttgtatgaaagtatcggttagtacattctgtttcacacctctttccttattttgataacattctcttacgcaatcttcattcttcaagtattaaatgatgctcccctgatgcgcgtgcaagtgctactagtcgcaacacgctgtaacacctaggggagggaagttttaactatttgagtcatgttttggatgaatgctgtttggataggataaacggaagcagttgtaagttgtaatgcgacctgctataatcaaggagagaaaaagttatattgagacatagtcttgaacctaagaatatgaatcaaaagtgagggcataattattgtttcccctctgaacttggtgagtaacagagtaggcataggatctcctcaaaattattaaatctattggggaatcttgaacgaatctcaaaaatacattggaaagaatgtatactttggtttgtattaagttatctatagtagagttggattgcgaggaaaggatgcagtttttccctgagcagagaggtagtcaacaaatgtcaaaaattgaccaacaaaaaaagatcttcaaggtggttctactgacaatgtgcagatcaattgttactttactaactatattggatctagtcgaaggtttttaacaagaatagactcccatgagaccgataaaagccatagtacggccgaaaataaacaaaagaattaccagatttctgaaccggaaattaatgaaccacaggcatgaagtcatgcatatgcatgagtatgcataatttgacccttgacagatccaccagaaatcaaaactccatgaagcccctgaaaaaaattcggcaatgtaactaatgaatactcccacaattacgaagtataccgattttagaccacatttttatccttggttaacattactttactgtaatcttgaggaaatccacgatccaaactattaaaactatgtctcgttctgctatcagacgtgtatgtcctgcttgctttgctgtgtctaaaaatgattgaaggaagagatgcacaattttttggctacaacgctatttcactaatagctttgccaacatttggtaactttagttgagtagtcagttttcttgcttcattataaatggtatagttatatgagacccgctttatttctgggagtccacctgaatatctttaagtgaattaaaccctcatcatacgtagttcaaatatcaaaaattctgtctctcaacctgtaagcagtacaaaatacatcacaccaacatatacttaacattatgtattacgtggacatgaaaatgggactttaaacaattcttctagtgatgttgagctctaactcatacgatgagacgaccacttcagtttcagcgtcccgcgcttcaaacaacaagtgtgtgtcaggattttgggggctcttgtcaacacgtaacttgggtttgccagattgcagcttaaaccattgctcaaatcttgtgccatcttcttgagtgacattttagttctgttaccgaactggttgaaaatgcagagtagaatgggctagttggtacggcatcccttgcttaattacactactcagtcaacttcaatcacctttttttatttcactatatacaactaaacatcctaagaccagtttatctcacgggattggatgtttgtgtaaaaatatagtattgattagggagcagtaattacgatccaaaagcataacagactcttacccaatctctgaggcaagaatatgcactcatacaagatttttgacaacattaaggatgccatagcggatgaaaaatactttcagagaatcgtcgtctatctgtggccaagaaacaggtcaacgaaaagcggcgcttgtttgaggcaatctgttgataaaaaaaatccacagagagagtaatgggatgtagctagccatcaaaacatccaggcttattggtatttgtcattataaatctagaagtagtacaaccagtgagtactcatctttggtttaggggcatcagttgcaactggattcacaatggggtaaagcagcttgctatttacatacttctcatgcattaaaacttgcgtattgacagttgaaggcataattgtagtaatgcctgagcgtgcatttatacgcataatagacctttacactgacctatgcattaagaattgagccttatggccccgaactgtcaaacaaatatcaactttaaaaactacgaagggagaacacttgggaggatcacattatatggttggacagaatatgttaggagtcttacttaacacgtgaagaaattgtggtatccctcaacagttttgttatcactttctcatttggttcatttgggcaatcaaaactaccttgtttaaataaacaagtctttaaaactacttaatataacaacaatcttaacaaatatctagtacttgaacctaaagtcaattctcttgttaccatcatcagttgttgtgtccgaatactgctcctgttcctctttggtaagtttgttccaggcacgctccttttgtttgttcctataaggataataaacaaacctggcaaaaagacagagaccagcggtaccaaaggcgattccaatcagctgttcatttcctctgtggtacaatggcgcatcgtcctgtctataaatattcgatgctatgataccacctgcttgtgaaaacatattgaccaatgctgcggagacagcacggtttcgaactgagttggaattcaccgaacaccaagcaattgatatcggccatgttggagcagccgataagaccaccgtcaatagcgcataggtaccccaggcatcaacctgcgcgcctggccagtatctcaacggaaaaagacacgacaagaaccacacaggtagagtaaaaagagctaatgctctctcatcaaaatactctgccaagtatgaaagtcctatcattgtgaaaatagttatgatattacgcggaatgtttagagcgttagttttcaacgtcgaaaatccaagttttctcaatgtcagtgtcatatagttagcagctggcgccaccccaatatctcccaaaattctgatcccgtatattggccacatgtcgtagtccaaaagtgcctttttcaactccctcaaagaaacaggttgtcggttgttcatgtctcctttggtggggtcatctctcaaaactttgtttaccaaaatcttttcttctctctcagtataccacccctttttacggaaccacgctttggtgtgaactacagatggaggcatcttaaagaatgaatacaacccaaccagcagagttccgattccttcgagaagaaacatccatctccagccttcaggcaaagcagatgttgaaatcttcagcagcggcaatgcaagcaaacttgaaagcgcggaggttaacggattggagatgtaaaagaaggacagtcttgtaccaaactcttcatgattgtagaagtatgacatccacaggcaaatatcacaaataaaacctccctgagctgctccaagtaggcctctagtgatataaaatcctgccttgttggtaatagcagcctgtgacacggcaaccagactccatataaccatttgtgcaggaatccagatatctgctcccaattttttggacaccagctgagacggtaactcagcagacaggaaacataccaaattaattgttctcccaacgttgtaatcattggtggtaaggttcagatcatcaagcatatcgtctgctagtgcttgactgatgttgtatctgtcaaagttcagcgccgtaaacatgatgaaacaccaaaatgtgacattccagtcattctttcgaagaattttcttctcttcctgctttgtccaggtaagttccggatcaaagagctctcgacattcgtactcggactcctcgtaaactttcctgtagtagtcagcgacagctggctctgcaaaaacgtgatggaggctctcagacgagtctgtctcatagtcctcgatgcgtttggtatccactagtacaggatttttctccgtagagtcgccagagttgacgctcgccttatctagcttactgttgccttcacttttagacccgactgatctaccactcatcttctgttgttcatgatccgagcagacgttgtagttttaaaggcatttcggagattgaattactgttagatgtggaccctgagagccacagcacgtcaagtttggagaacaccattctttgcgaacaactagaatgaataatgtgatagcgaggcatttgaatgccgtggttgtggggtgtggcgcacacaatgtctaacgcaacttcattgccaacgtccccccaattagcgaggtacactttttgctgacacttttgacagatgatttttttgcttcttggctcagttgggattacgtcagatcgagataaaatgagaacgttttctatggcttaggagtgcgccccgacgggtagaggagaagaaggtgacgtgattgaatcacacgatatggattgcgaagatatttatcgtggggatccacaagggatttgaaacttacatttaccacataccccttctttaatataaaatatggctgaaactcagaaagaaattattgatagatatcgaacattttttgataattcaacttaatccacaatggcaagagtaaatcccgtctacacccttaaaccaaatgaggctacagccgctggccgtaagaaaaagttcgaaggaattgccaacagtgaatacaagacaacatcagactctcctacccacttctttcctgagaatgattctgtgagaactgatggtgtgttgactgtgtcgagggaagcaaaagaagcctcactgtatccgcaatggctccccacttggaaccctgagctgaagttcgttgacgaaccggcattcaaccacgtagatcgtggtttctttgctgacccagagcttagaagactctttccgcagaacggaaagcatgatatcaagaaacttactccaaagtttggttctgttgtcgaaggcatccaattatccgaactatcaaatgatcaaaaagatgacttggcattgtttgttgcccagagaggtgttgtggtcttcagagatcaaaatcttaaggacaagagcctgtctgaagttaaaaagtttgggcagcattttgggcctttacatatccatcaaacatctggtgcccctgaaggacatcctgagtttcatataagttacaagcgaagtggcaggacacgttcttttgagaagaaagtttcggccatgacttggcactctgatgttacctacgagcttcaacctccgggaactactttttttggaattttggaaggccccgagagtgggggagatacagcttttgcagataccatcgaggcatatgagaggttgtctcctacttttcagaactttctgtcaggcctaagattgattcactctgctaaggcacaggcagaagattcgttagctaggggttccattcaacgaaaaaagttcacctctgaaaatgttcatccactagtcagataccatccagttctcggcaagaagtctatatttgctaaggcgttcgggactaggattattggtttaaaacaagaggaaagtgatttgatactgcaattcattgaaaaccacattgcaactgcacttgatttacaattaagggcttcatatgaaccaggcaccgtggtagcatgggataacagaagagcgctccactcggctcttttcgatttcttgccagtagactccgtgagacactgcttcagaatcactccaatagctgagcgaccggtcggatccagggaggaatatgagaattggtcaccaagcaacgaagagaggactgttgaggagtgggagcagttgtaccagaatggaataccaggatctgagatccttgcaaacccacattcagttaaataatcttattcgctggatcatgttctgttgcttgatgatgtagttatttttaaagaaataagtataatgatatggtttttgtaacagaagtaagtttcgtatccactgaatggaaaactctcaactgcttttcatggcctatgatcagctgtcctcaaagttagcatattcaaattcctcaatgtggactttagtaagtcagaagcaatggccagctatttctttagcctcagcaaagatactgcgaagatactttgcgaagatatctttgaaagttttgattccgttgtagaattacatccagaaaagacaaagcaacatatctatctacaaacccttatcagtccaaatctaatcctttaagggtacgaaaagaagtatatgcagattttcttatggtaccaatttgtattgtttcaaatgtaatccagcagcttttttgcagaagatgcagaactccctgcaatacgtgcaatcagctcaagaaaaaaaaaaaaactaaaatgacaaccatcgcttgtaagggtctcaatactttgcattgatactaaatcatccatactagttcaataatgtttttatttttctgttctactcaagtttacaatatttagctaccagaaatgaggttccctcttttctgagagcgagatttaattatgatttcgtttgtcttctgtgtacaaaggcaagagagtttattctggctactaaaaaaatacacgaacctagaaacaactttagtttaacaaactcctacccgttttgatggatttaaacactagtgggtgtataggtttggaaaggacctatagttggggtcaacgttgtagctgtctcagcacattgggtaccagttggagtaattggcaaaccgcaagtgtccaaaggaccagctaggtaaccatagtaagactggtaaagacaccatccacaatcgttacaagctgcaatttgttgcgaaaaggaggaatcagtggcacatagacattctgagtcgaaaggacctgcctcgggaccacactcccaggcaccgtagatggctaaaccacaagccatgtgacacatgtaatcagctctcttttcaagagcaggatccaaagcgtcagcaaaggcctgaggaacaagacctctggctacatgttcacgtgcctgttcaatggaaggcaaagaaattgcatttactgcagcaatagcagatagtagggttgcggcaaatttgttgaatagcattttgagtgttaagttgaagaatcaaagaagaggagatagttctgacgttaaaacgatatgaatggcacgttatataaacttctgtcaaaacctagaaggcagtaactcatgctcagcagtctccttgcatccccctgcatggtaaaaatgtcaacactaccctcttttagctgaagggagggcttattttgttcggaaaaaaagggtcaagttcactaaaaatacgctatccccgttgattagcgatgaatccgaaatttccacctaccataacacttgactacactcttgtggtcgtatcgggtgccgtaacgaagcgaaatgtgcatgcacgagtccaattgcaatcaatctatccctttgataactcgggtcattgaacgacttctatccgtatcatgaaaatgcagctaacatttgaaaattgaagaacaggaaagttaagttcacagagcaatacaaccttcaagtcatatagattctcgtgcttacaatatctaggctttggtcgcacaggatcacagttcatctatcctgttaaaaccgactttccagtgggtattctgcatcggtgtcaagtcaccattcacatatattccatagctttacctttactagtcagctgcttgacaaagccctctatattgtgctccctgaaactttgaaattataagtggggggtcgtggggggcgggaggtcgtacatgtaaccagtcttaggttactacggattattgtacagcattgtcaattcttttgttgcgaattgatcctcggcttgaatcctctgaataggtttacccctggctcgtataatgcattctaatatgatacccccctaaagttgtatttgtatcggagggggtagatttacacatcgcgatttgcgaaattgctttccaagctggacttacccagacctcataatggcagagcacctgagattgtggccagccaactaattgaagcaacctcttatcgaaaagatatgagaattagggtagtgagtatttggtccaatctgatattgcagaacagttcaaagttttatgctctaagttcctggcataactgtcaataacctgctgcgatcaagccaaagatcacagaatatatcaatactctcacatttctttcgtcccgtatttgaaaatctaagaaccccagattgggttttatacagaggatattcccctgtatctatatgtcaaaatttgacgggttatatgtggcttcgatttgcttttttatatataaatttaaagggggacgccacaatagctaatcgataaccagaagtgctcaaattacacacattaaggttgcgaagactctcagcagatcatctcattcttagtgagctttcataatgtatgcaccacactctatatatgggatcagtcattggcagcccctatttgataattgatcctcagccgataagctgttggactgatggaataccagggaataccagtgactacacccaaattgttcttatgaagtcaattatttgggttgtccctcccatccttataataaatctctagttgcaaatttcatgaacatccttgctgaacctgtttcacatgtacctgaaaaatgttttttgctaattgcttggacataagttgcggcacaaggagcatgcaagtgtcgtaacatgcataaaggcattcctagcctattcactggaattataatctctcagagctgaggtcacttttggggagattctagttactttattttcacccggcaagttttaaccttatgtaattcaaattcggctagttcagcagagctacggtactcaaatgctcgaggatttataggatgtgagaaccagacattcaaaagatgtttctattcttgtaaaactggcgctcaaaaggccgttatctgatttgaatgacaaacaggaccactgaagatttgaactactaatatattataatatcgaagatggttcatttgagtacactatgttcgttcaatacatttttttctaaaaaatgcaagactaaggttgtgacctacagtaagaggatgttcctttgagatgtaatcccagaaccggaaatgctgaatcaagcagggatggaaatgacatgctaaatttgcgcattctacagccaatgcctcaacttaagcggacggatacttccaatcaggtgcttgtgcaaagattggctgattaagtttaccaaaactatttaatacccaacaaagcaggtttctataagtagtcctttgtttagatcaacgcaacaagagcaacagctccaacagcaagcaacccattaagtgttaaagcattagcgccgtctgtttggacggactcgattgacgaagttgagtttgcagcagagcttgcagtttcatcgtccacggttgttagattagcacatgcgaaacgggtagaattggcatagtgaaagacaattgatcgaccatctccaatataaagatctgaggtatggtctaaactgatatatgggtccacttcatgtttagtgaaatgagttccattaatcttaccatactttccgctgagatctcctgattcgcaagtgctccagtcactggcaacgcacaataatgcattggcatgagatgggttaaaatgtccacccgttgccgtgcagttcccattttcaggcacaggaaattcatggatatggaactgaaaaggagatcctgaagttggcaagtttttgaagtcagcatttacctccaatccatcgtcggttggcgtgaatgtgattgatccttcaacagcgtaagatccaccagcagggaagttagcaacggcgacagtctctgctgcagcaaggaataacacggggaaaagtgcaacaatactctgaatcataaccactgtattgagcaaattgaattattaagcaaatttgtgggaacggtttgtgcttataagtcaggtctaaatgttgcggaatgtaacgtaaagctgcacgtataagcttttcctctagattcttgtggttgtcgtggaaactaacaatacctaaacctgcaggacattagaatatactttggagaaattccctacaaattgcatagtgttagtgttaaggagaaaggagttgaataaaacagtaaccctctatttcgattttaagtcaaaggatagaattcaagcattgaagttctttgaagtatttaaaaaatacttggcaaaccgcaatgctattcagatttggcaccagattaggtttgatctgtttggaggaatttcgtgcatgaattgttctgaataccttcaggcaaggtgattaaaaagataaaatacctcaatgtatgtgccaacatacaaatattaattgatgctgattatatactagcccttgtggcactggatctctcctcctctttcaactaacgttcaaacagcgagctactcagcaatggaagattcagctactagagtccaatgggccgcaaattcacccttaacggattgaccaagattgattggatcctcgaaattcggatgcgcttagttttcaggggttattgtttactgtgggcaccactaaggaaatatcctgcggctagatagtgttaattagtttaaagcgaagcataccggaaattccaattccctttgaaccttcattcaaccttttgctgcttgaaattcaaagaaagattacaacaactgccaacgctacaatttctgattacaaactttcttttattaactcacctactacgtcaccgatgaatctttgggaaaagttagtccaatgttcccgaaaagacactacttaggcttgggaccccgttttcataaagtctctcccactcatcaacagtgcgctctctgtcattgggcgaccaggtctcatactcctcctttgagccaaccggtctctcagcaagaggggtaattcggaaacagtgacgtgcagcatccttgtcagttaagtcgttaacagctgaatggaacactcttctgttgtcccatgctacaactgtaccaggttcatatgatgcacgcagttgcaaatcttgagcagttgcaataaaattttgaataaagttcaaaaccagatcactttcctcttgctttagtccaatgattcgtgtgccaaaagctttagcataaattgacttctttcctagcacaggatgatacctgactagtggatgaactgtttcagaagtaaacttctttctttgaatcgatcccttagccaatgaatctgctgcttggagacgggcagaatgaatcagacggaggccatccaaaaatttttggaaagttggggataatcgttcataagcttcaatagcatcagcaaacaatgtgtctcctccagcttctggaccttcaattaaaccaaagaaggttaccccagctggctgcagctcatatgtgatatcagagtgccatgctatagatgcaatcttgttgatgaatggcttagatggaccagctcttctgtaagtgatatgaaactcaggaaacccctctggggcacctgatgtttgatggatgtgaagagggccaaagtactggccaaattctttgacctcttgtaggtttttgtctcgcaagtcctggtctctgaacacgactacacctcgttgagcaacatacagagccaagtcatctttttggctaggactcaattgagaaagttgcacgcctctcacttcagaccctaatttcggggtaagattcctgatctcctgacctccatcttctggaaacaatctcttcaaatgagggtcagcaaagaacccacggtcaacgtgactaaaagcaggctcatcttcaaacttgaaactcaacttagggtcccatgttggcaaccattgagggtaaccagaggccttttgagcctctttggaaactgttaaaactccatcctctctgataagatctgttgaaggcgaaaaatggattgcatcagctcctccggttgcatttctcttctcataggtcacagccttactttggttttttaggacaggtttcagtgttgcagacattttcaagtttgtatgatttgaatcgaactctacatgttcttatataataagactatccaaagtcaaaccacccttatgaattcatagcccgaatcttcgtacatgaatctctctatctcttcttatggcgcaactatcgaaaagaatttgggatttgagtgtaaagccacattttttctcgatctttatacgataaaaatagcaggagatagggtgcattgaccccaggtctatactaataaaccagaggccgattctgtgggggaaccctgattaagaataatctgtgaaaggtactgacctaagatcgaaggctgtatcttcgaataacgctacaaaaatttctgggcaatgctaatggtatgataaaactaaaactattgtaaaaaactgaggccctaagatacagcgaataaagtaacctcacaaggtgtatctaaatgcaatgcttgtagacttgatgtcttcctcttcaagatctccggccgcaaatccaacgtggacggttctgccgagatagctattgctgtcattctcattctcaccttccagatcaattgagctcaatttcccgtacaattgatccgccttgcgattcatataaagtaaaagccgataaccaccacaacggctaatatcgaaaacacatccaacatgatcaatgctagaaaccctttgcgataaagtggtttgtcattgtttctaagaatttgccctccagtcacgcctccaatattggcagccatgattaaaactgcgaacgcaatacttcgttctcgtgggtttcgaaaattcatgctcatccaagaacaatttagaacgtggccactgatgcctgcggtgatcagaaaacataatgcagtaaatctttggttaggtgtcgcatcagcaggtaactctcttaacataatctgcgatactagttgccagagcaaagcgaataatatcgacgcaccctttggtttgaaatgcttgctggtatacgtgagaattaacatgagtatcatcgagcaccatttgggaatagaagatcttgcattggcctcaaaaacagtgaagccaaacgattcgataattagagggatgtagcttgataaggcagatccagtttgcagactggatacagtaatcatcaaatgtaaccaaagtacggggttcttaagtgtgtttttcacgtccttatagttggtcttctcggtagatatgatctttgaaggctcatccagtatcactctttggcgcaaaatggacctttcccgctcattgaaataaaaccatctgtgattccaaaatgctgcaggatgctgtgcggactctggtagtagtagtaggaacactatagcatatccaacgcttgctataccttcaatcaaaaagatccattgccatccttcaaggccgccatatccgggaagacggtcaagaatccaagcagcaatcaatccacttaaagcactagctgtgagattgccaaaataatagaatgtatgtctaagcccaagttcagactttttgtaccaagtactaagataatataatcccccagggatgaatccagcttccgcagcacccagtacaaacctcaaaacataaaacgaacgaaggttatccatcctatactgaattgttgcaataataccccaaattaggatctgtgagctcaaaaacaccgaagggctcaaccgctgtagagcgacgttgaatggaacttcaaatataacaatccccgacgaaaacaacgcgcttgcaatattgattctcgtattatccaactgtaacatgttcgtaagacttgtatcagtataagcatttgaaatgtttcctcggtccaactgcagtaagaagaaagcaaaaaaaaggatagggattacgatacagtccagtttgcggacaagcctctgctcttcctcatcagtccagtctttcgtcactaccgtctcctctccagtctcattgttgatgatggcaagtgttggatactgtaagtctgtactggtcagagaatgtacccttgcaacgactccgtcattcttgtgaaagggatctgcgttcatagaacagtccgatctgtggctcttcaacacatccaaagggaagtcattcatatatatgacaataaactgaacctaaatcatttacccccttgaagtaccatctccacagagcaaactcatgatttggatgccacagatactggcgtcattgagagcggtttcatggggttagaagtaccgtggcttcgcaccttcttttcgggttttgagtacagttggaagtaatataccattatgaacctgtgtgctggcaactgaacggcgtgctcgtggcctgagatcatactagagatgacgtatctatggctaaacgagcctcagtggagcctcgaaggaatcttcgctccttacctaataagggccaataaagtttcagactggtagtattcacaggagcaacaccaatttcaagctgaaccaagtctgacttcggatggcagagcgctgggtcagatcttgcttcgatgtcagagattctggagttcctggaccaaacaataagccacacttcctctgttgatactcgaaacgaaacccactacgatatcgtctgtgacatgcggttcttattatcttacaaatcgtcctaagaaccatggattgacggggaatagcccagctacatagtcagtgcacattgagccttagttccccttaagctcactggaatttgcaattcactcgtagcagtatcagcactattttttcaatagtcgctaacctctgaagattcaaagtaaccagtggatcttagggagaaccaaaatgtcgtagcgcatggcggtgatgatgcgcctccaacaaagcatgaggctcaaaacatcaaagttttttctcgaatcacgtgtcatattaataaaaggctgcaatacctgaatttcgcgtatacagccatcccctgcaatatagaacaggttattggcagcgtaactacatttgaacgaacgagatgcgagggctttgttaggtacagccgcaaccatgatgactattctctgttagatttaaccttcaagatggtgtgggttctatttttaacatgtactgataaatactgcgagacgatccaatcgtgctgacattttaagggcccctattacatcattcgcgtgtgcttgaatggcattagattagacagtaatgctaagtcacaacaaaatcctgttaggcattttctgaattgtaggataatgggactgtcatttttcaaacgcaaaaagtattctgataaagaatctttgtcgagccctgaaactttggaagagaaacccaacgatgagttagaccctcgcgttaccgagattctagagcgccagattaaggctgactcctacggtgcatccctagtcgacttatatggcatgcttcaaggatgggaatattgcctcgctgttgctgcttatatttgttccatagttgctggggctgcgttgccattgatgaccttgatatttggagacatggcccaacaatttaccgattattcatctggacttcattcaaataatcaatttgtggacaagatagacgaaaatgctctatactttgtctacttgggtgtcggccttttagtttttaactactttgccacgttattgcatatcgtcgtcagtgaaataatagcgagcagagtcagagagaagttcatatggtctattctgcatcaaaatatggcctacttagactccctgggttccggtgagattacatctagtatcacttctgactctcaacttatccagcaaggtgtgtcagagaagattggactggctgcacaatccatcgcaacagttgtatctgccttaaccgtggcatttgttatttactggaagttggcgctggttcttctgtctgtcatggtagcccttattctaagttctactccaactattttgatgttgatgcaggcatacacggattccatagcaagttatggtaaagcttcttcggttgcggaggaggcgtttgctgcgatcaagactgctactgcttttggcgcccatgaatttcagctgcaaaaatatgacgaattcattttggaatccaaaggttacggcaaaaagaaagctatttccctggcactgatgatgggctccatttggtttattgtatttgctacttatgctctagctttttggcaaggttctagattcatggtttctgataattccggtataggtaagatcttgactgcatgtatggccatgctttttggttccttaatcatcggtaatgctacaattagcttgaagtttgttatggtcggtcttagcgctgcgtctaaactttttgctatgataaacagggagccatactttgactcagcatctgatgctggtgaaaagataaatgagtttgatggtagcatcagttttaggaacgtaacgacaagatacccttcaagaccggacataacagtcctttctgacttcactttggatatcaaaccaggtcaaactattgccctggtaggagagtctggttctggtaagtcaactgttattgcattactggaacggttttacgagtatctggatggtgaaatattattggatggtgtcgacttgaaaagtttgaacattaaatgggtgagacaacagatggcactggttcaacaggagcccgttttgtttgctgcatcaatttatgagaatgtttgctatggactagtaggcagtaagtatgaaaatgtcactgaaaaagttaaaagagagctggttgaaaaggcttgtaaagacgccaatgcgtgggaatttatttctcaaatgagcaacggtcttgataccgaagtcggtgaacgtggtctttctctcagcggagggcaaaaacaaagaattgcaattgcaagggccgttatttcggaacccaagattttgttgcttgacgaggccactagtgctctggatactagatctgaaggaatagttcaagacgccttgaatcgattgagtgaaacaaggactactattgtgattgctcataggctaagtacgatacaaaacgcagatttgatagttgtgttgagtaaagggaaaattgtggagacaggctctcacaaagaattgttgaaaaagaaaggtaagtatcatcaattggtgcaaattcaaaatattcgcaccaaaatcaataactccggtccccaggccccaatatcattgtcgaactctagtgatctggactctgtgagccacaagatagaccgcgttgaatctttgatttatgaacgggcagccgcagataccatcgatgaatcacccgtaaaaaagcaatccattccacagttgtttctcatgttgttacaaatcaacaaaggagattactatttattgattccttgcctcttccttgccttaattgcgggtatgggctttccatcattcgccctgctagctggacgagtaattgaggcctttcaagtaactggcccccaagactttccgcacatgagatcgctgatcaataagtatacaggctttctctttatgatcggatgcgtgctgctgattgtttatctctttttgacatcttttatggttttaagctctgaaagtctagtctataagatgagatacaggtgtttcaagcaatacctcagacaagatatgagcttttttgatcgacctgaaaataaagtgggtactctggtaactactttagctaaagatcctcaggatattgagggcttgtctggaggtactgcagcccaactagcagtttctgtggtaatcgttgttgctggtatcatcctcgctgtggctgtaaattggaggctgggtcttgtttgtactgcgaccgttccaattttactggggtgtgggtttttcagcgtttaccttttaatggtttttgaagaacgaattttgaaagattaccaggagtctgcatcgtatgcctgtgagcaggtttcagctttgaaaactgtcgtttcattaacccgggaagtgggaatctatgaaaagtatagtaactccataaaagaccaggttaagaggtccgcgagatcagtttcccggactactttactgtatgcacttattcaaggaatgaacccctgggtctttgcattgggattttggtatggtagtaggctgctgttagaaggtagggctaccaatagagaatttttcaccgttttaatggccattctttttggttgccaaagtgcaggtgaatttttctcttacgctccgggaatggggaaggcaaagcaagcagcaattaacattagacaagtattggacactcgcccaaagtcaatagacatagagtctgaggatggtttgaaaatagatcgtctcaatttgaagggggggattgaactgagagatgttaccttccgatatccgacaagaccagaggttccagttctcaccgacttgaacctaataatcaaacctgggcaatatgttggattagtgggcgcctctggatgtggaaaaagtacaactgtaggccttattgaaaggttttatgaccctgaatctggtcaggtgttgcttgatggtgtagacattcgtgatctacatttacgaacatatcgtgaagtattagcgttggtccagcaagaacccgtgttgtttagcggctccattagggacaatattatggttggaagcataagtgatggagcagatgatggatcggaggaagatatgattaaagcctgcaaagacgcaaacatttacgatttcatatcctctcttccagagggatttgatacattatgtggaaataagggaaccatgttatctggtggtcagaaacagagagttgccattgccagagctttgatcagaaatcctcgtgttcttctactggacgaggccacatcagctcttgacagtgaaagtgagatggtagtacaggatgccatcgacaaagccagtaaaggacgtacaaccatcactatagcgcatagactgagtactgttcaaaattgtgatgtaatctatgtttttgatgcgggaaggatagttgaaagtggcaagcatgacgaattgttacagcttagaggcaagtattatgatttagtgcaactgcaaggtttaaatgcctgatttttgtgaagaattcaattgtgagattcaggtaggacaattgtctgattactatcagaatcaatttcgtttgtagttcatcagctggtttgatattcatgctatggtaattgttattcagactatttagtaccgttccatacgggaaactacaggagtgtagttcagatttgtaaatagcgtgatgggcaggctttagttgttaattcaaaaactgttcacttctattctgttgatatggtaatcagctttgaagggttctcaaagtcttcgataactctgatgagtattctattccttgaacacttttgtatcgcgccctttcgtttttcgttatgaataaagcgggccagcctgcatggtgcataaagacgaaaagcaagttacgttggagtttctttgtcagcaaatagatacaaaagaaatcacgtacaattttaaacggtctaaaacgccatctgcatccgcagttgatacaaattgctgattaccatggaatcgagtgtttcctactaggatagctcgaactactaaaagaggtccttaattcagccagaaaaatattgaacatggcttggattccaccctgtaaaatatcagacactgatgctgagtgttcctccacactgtcgatttgatatcatcaatccagaaacttgttgaagttaataaaggctccactggatgatttagatagccaaacttcggcgtttgaatttttccggacagcatatcccttagtacctcggtacaatttcaagtaaacttttgactacaagactacaagattactaatgatgcctgaggaaagaaacgcagcctccaaattcaaagagaaccttaattactaagctttctgttcttgcgctcttttttgcatatgcatggaaccgcaaggagaaacttcactcccgcggattattagtgcgtgcaacacctgttcttaagctttattcttatttaatagcttgctttacccctttgttctctgtaatatctaaatacttcttctctttgcaaatggctaatcacgcaattgttatcaaagcagcaggtgacgctcaagtcactgaaacatcagttcccaagctaagaaatgattatatgatcataaaggttaaggctgttgccttgaatcctaccgattggaaacatatcgatttccttgctgaacctggtgcccgtgtaggttgtgactatgccggaattgttgaagaggttggatctgctgtgactaagccattcaagaagggcgacagggttgcaggaggctgccatggtgttaatgcggttcaccacgaggatggtgcctttggagaatatattaccgttaagggtgatctgcaaatacccatccctgagaacttgagcttcgaagaagctgcaacacttggtgttggtatttcaactgttggtcaagccttgtatgagactttgaagatccccttgcctaccaacccttccaaggagaagtttccaattttgatctatggtggaagcacagcaacaggggctctagccatacaatacgctagactttcagggttggaggtcattgtaacggcctctccccgtaactttgactacctcaagagtcttggtgcagatgctacctttgattaccattctaagtcttgtgccgaggatattaagaaacataccaatggaaagctaaagcatgttttcgactgcatttcagagggaagcagtacagagatttgtgtcaaggcaatgagcgatgaaggtggagtgtacaccacactgttgtccgtccctgacgacaaggtaaaatctatcaatgacaaagtcaccaacaatatgacattggcttattttgcttttggggagcctttcaaaaagtttggtcaatcgtttgaggcaaaacctgaagaatttgaatatctaaagaagttttgggagcttagttacgacctcttggctagtggcaagctcaagcctcatcgtctaactgttaacgagggtggtaaaggcctcgagggtgttctaaagggattgcaactaatgcgagagggtaaagttagcggtaacaagctggtttacaccctctagttgcttgttctctggaaggcgatatttcgcagttaagctcttcagaaatgcacaattacataggatttaaggtactgtaaatgaatatggtgttaagaatgtcgtccagtaacttgtagagtttgaaaaaaatggcgaggtggtagatggttcagctatcacatggtaattaatctattacttgccgctttcactaaaatgggtcaggttaatcgtgggtgaccaataaaatatcgacaagttaggagccccaagaatatcaaaggttgagcggatcctaatatcctcgttcagcagcattatcgcgaagtggatctagcttcatctcccgatggaatccctaaaagaaaaaaaggggaaaaaaaaacgaatgctctcctcgtccctacatgccagaacaaatggagtttcgcccttgtagtgatgagtttagttgtttctatcggtaatctcagtttagtgttatcgtagattgtcgaccatcttgtgacctaaataagcagcaccaaaaacggccaagagttatcggctccaggctcacacatttcttttttgtaccagaatcatgaccatggcctaaaggatccaatatgatttttgggtcttctgaaaaaaacctggagtaaaccttgatttataggctcaagaaaactattaatattggcctccattttttgatattcgcatcgtctccttctcaaagacttccaatttttcaaaaatgggcacagagggaaacggtatattcaccgagcacactgaggctaacaaatactcctatcccaagagtgataacgacaaaagtaacgatgaagtttatgagctaaaggaggattcacaacgagacactcctgactataaaattgaaaatggtgacattgaagaaacagaattaaagagaaatttgaaaccaagacacgtcacaatgcttgcactcggtgggactattggtactggtctgttcatcggtattgcaaccccactgcaagttgctggtcctgttaacgctctaattgcgtacattttcattgctacgttggccttttcagtgacacaatcgttaggagagatggcaaccttcactcccatctctgggtccttctgcgtttttaataccaggtatatttccaaagctgttggttttgctaacaattatctgtactggtggagttggtctattacatttgctattgaactttcgattattggacaaacgattcagtattggaccgatgctgttccaatatggggctggattctgctcttctatgtgatattactgggtgccaatttcttttctgtccaatattatggcgaaattgagttttggatagcttccatcaaggtcattgccatcatgggatttattatatatggaatttgcatggtttgcggagcaggcataactggacctgtaggattcaggtactggagaaaccctggtccttggggcccaggtctctatgtatccaacacgaacacgggtcgttttttgggctggttgtcttctttgatcaatgctgcgtttacttatcaaggtattgagttaactggtatagctgcaggcgaggctgccaacccaaggagaaccgttccaaaagcaattaacaaagtcatcttcagaattctcattttttacataacaagtttattcatattgggtttattagtaccttataatgatccagaattcgaatcgaccagctcctacattgcatcctctccatttttgattgccatcaagaattcaggcacgcctgttcttcctgacatatttaatgcgatcgttctttccactgttatctctgcaggtaactcgaatgtttatgtcggcagccgcctcttatatgcgatgtccaattctgggttagctccaaaaatttttgctcggactaatacttatggggtaccatacctatctgtatttgtgacttcactctttggcttgctagctttcctgaatgttagcacagatggtgtaactgtgttcaattggctggttaacattgcagcagtagcaggtttaattgcatgggtatgtatttcggttgcccatatcagatttatgaaggctttagagtggaggaatatgtctagaaatgatctaccgtacaaagcaaaatggatgccatggtacgcatggtattctgcgattgcagttactattatcacatttgttcagggttattctgtcttctttgagttcagcgcttcggagttcttcactgcgtatgtttcgttgatacttttttgtgtaatgtggctaggtgcacatctttactatagagagggcctgtacttgtcagctgaagatattgacttagatacagatagaaaagaaattgatatgctggtttgggaggagccaaagagatcaactgtttggcacaaattttgggcaatagtagcatagagaatgagcattcagcggcatatggatggagaatgcatagtgcttaccaactacttgaagttaagctgaacttttcagatgagttggttgtcatctgctaaatcctatcttatgacgttcggagtttgaattttgagactccactgattctcaatcgttcgtccctcccacgaactagttacgttattataaagaaataagacttactaattgatcaactatgaccatatgtacactcgctatttaagatctattcaaactgacacaagggttcgaaattgaattggttgaacttatcaattccaaaagaaaacagtaagcctcaataaaccttcaattcttgtgtgcggcaaatctcagctagatactggagtagaattatgcaaacttaaacgattactggtcattcgaaggcatgtaaaagaactgttctcaaaaaaaaaaaagagattgcagcacctgagtttcgcgtatggtctcccactacactactcggtcaggctcttagcagcttaactacggttgatcggacgggaaacggtgctttctgctagatatggccgcaaccgattcgtttaatcatagcagctacatgctcaatttagcattcatatttctacatcaaaaatagacgcagtgcaagttaagagagagattaagaatctaatcatctggggcactagtttgattagctgagatacatctttgtagcaagctcgggtgcaaattttattcacttattgagttggtttaaagacatggtctcattattgttagcttttcaggtcattaagaactgtggtgaacgcgtggccgctaaaattgattcagatggattatttgttttgaagaatgcaattgtggccttatttgtttttgactagcgcagaggcataagtttgtctcttaaatcaccgtctaattttctcccggttctgaacggcattagtgaaatatgtcatttctcgtcaacggtttttgccgagcctatggcgatgcttctgccacatctcttattttttgcgtgcgtcaggaacgggtaattacaccccactcagcttatccccgatgtctatcagtttggtttaaactgagttaggcggaaaaaaaaggtattcaaattgccgccaaagggaccatgaacctcgccgcaactcaggctcgttacaaagaagtaattagacgacgaatctcccatgtactcgattcacacctggtatttcatcttacgacttggatccgagttgcatgaaggtgcatcaactctgtattaagtcaaaagccccagttccgaatagtagctaatcactgaaaagtcgaagcggaagcatatttcagaagatcaggagcagctataaacgaatactagaaagggttttcatacagtttctttaagttctccacctagtcagctggtttgcccaaccagagggtattagtgggggtaggagttcctagtttagatcatatttgcatccttgtagtggacttacgtcacgtgcgaattatctcatctatacatctgtttgtactgtggtgaatttggcgatgatagaagtgaaacgtacaggatttcagcattaggcgccagggtgcacataatgcttgtaccacagttcaatttcttatgctgccaacgatttatctggtataaaagctacacaattcatcgatgtgtcagtcagaaacaacggtagaatgaccagctccagtatttttggttcagataaggcagccgctagcgatacaactgtgtatgactataaagagccctcttctgatgctgagaacaagtatgctgtagtattcgaaactggactcccagaggaagttgtcgagtcaaacgttcaacggatcattgataatgcacctgatggtcacgttgacgaagacgcagatatcctactgaagggtgcctttctagctaacgatgaaagtgttttactccctcataaaattgaaaaaggccactacacccaagaggaagtagatttgttggactacgaatctcgccattcaattaagtcacagtctaaatggatgttcctgttggctattaccagttcttttgctgctttgaactttggtatggacgaatctgctgtcggtggtgctcagctccaatatatccaggagttcaatattactgatgccaacgttcaaggtactgtcaatgccattccttaccttgccgctgccgttcttggctctcctgttgttgttcttctggacaaacatatcggaagaaaactgtttttgttgatttcttgtgtcataggagtcgctggatcattgtggcaagcattttctcctaatatggcctctttgttggttgcaagaatttttttgggtgtcggaatgggtattaacagttccgtagttccaatgttgattgctgaatcaagtcctgcaagaagtaggggtgcatttctaatgttatggcaaacttttgtagctaccggtgtcatgttgggttccgtctttaacagagcttttgtcgaccttgatccaaaaatatcctggcgtctgatgatcggatcatccagtgttgctcccctgatctgttttatatttgcactgtttataaccgaatcaccaagatggctcatttctgttggaagacaccatgaagctttagatgttttgttcaaactacgcactcataaactagctggagcaagagatttctatatcatttatgaatccttaagaaaagttggtgaaattgaaaagatcccagtattggagcaagtaaagctaatgatttttgacactagggtcagatttggggctgttgtatctttgttcaacatgtttatgcaacaatactgtggtgtcaacgttctagtgggatacaccccaacgattttagtaaatgcaggcatcagtccaaaaacagctattgctggtagtattggtattggcggtggatgtgctttggctactttggtttcaactcaattgattgacaaccttggaagaaggaaaatgcttttgttcactttccctattttggcaggctgcatgttctggcttggtgccagtctttacattgttgataacgcctcccgtcttggatctggtctcgctgctatgtaccttttcactttgacttttggtttgggtattggacctgttagttggactatgaactctgaggtatatccattacatgttcgttcatttggtgtccccttgggtatgggatggaattggttactagacttcgtattaaccatgacatggccaaagatggccgaaagcatgaccacctctggaggactttatttctacggtggatggaatctctttgccttttttttcactttcctcttcgttcctgagaccatgcgtctttcattggagcagttagacgagctatttagtcaaggaatctcaaggtttgctcgttctagactaagtcaagttaaaaaggcttgaacaaaatcagtgtctttaattgattattgccttttagaccagtaaattatcttcaaaataaagctatctgtattctttgtatttgacagaaataaataatcatctttgtacagttcacgtccaggagcagaaagtagaaacacctgcaaacttaataggttcttttttgtcaataatgaggagacaagttttagtttaagaaaaactgacaaccattaaaaatggacagttgcgtaaccctaaattatcaatagtacttttcttgaatgaatacttcatataccatacttacagcaaacaacgtggatcaaacattgatcgacgttggtgggccatacaacctctcgtgttctgcaattgccggaggttgagcattatctacttgatgccatctttcatgcagtcttccaaacaacttcacgacaactggctcatcacctttcacgttattaacagcattcttaccaaatagtctgcctttgttgtcattccactggtcaaaagtaatcttctcccattctttcggcttgtgatatcctaaacgattaagcttgggagaattaattgtctcagggtcaatgactaatgacctatccgggtctacaaaatagattatttggaatcttgtttcgcccttttgttcttctacaggagaatgaaccctgtgaatagacgatttgaaatagcctccggacaaaaactcaaagccatctcccacgttaacaacgagggagtcaggtttatgactcacaaatttccattcgcctgtttcgtagtctctgatttgaagcgataaaattgggttcgaagtcagaactgtgatgaaggatccatccgaatgacctcgcagccaactttggttagttttgacttcgtcttccggtgaaggattgtaatacctcattaaccttccaaatccgcccccactgtggaaaggatcattatcgatcactctcatgtagttgtcccatagggttccttcggggatctcaagaatgatgtcgcttaaattgcaaatttttctgacaatctcataatgcaaatagttgaaatagtcactaatgtctcgcagatatcctcgcacaatctttggatgcttcaagacaccttcatctgaaaggaaaatgtcatcgtgtaaaaaatctctgaaattgtagtgctcaatgctatctcgcacattgttgttgctccagtatttctttggtttgaagccactgcctctttcgccaccaagtgacttcgatcgatcttcttcgtcagatgttagagctcctgccaagtattggactttttcttcgtctggaatactcattaataattggccaattgatcggacacggttaaaaacttctggtgccaaacccacgttggacaagtggaaaaatccggacgtactcaatgcattttccaattgtttggccagggccttcctcttttccaaaccactgtttccctcttcgtactgggaaagatccaacgataccaagtcgatggtaggatactgggcagcaatttcctcaggtagaggattgggctccttaaactcttgtagaggaacacgctctttcacttctttctcaaaaagatctttattggccatttgcttttattgtttcgctcattctacaagcatagcaccagagggcattgagtaatatataccacattccacattccagacccatgaagtcgaaagaggtggtcttcccaaaaaaaaatatgtggcttgagattcacgtaatattgatagcgaatggttcaccggatatgttgtgatgaatgcatatttcattttcatgattgtttctgcaaaattcaatcgccagtgccgccgtagtaccccttgattcatcgtacgatagatatagcaaacgggtagtactgccataaaatgccatttgtgcctctccactgaataagaatatggtgctaaattgggtcatgacgaatcctgcacccaatttcacaataggagatggggcttttgttttgaacagaaagaagaattgtgtataggcatctgcagcatggagatcggttgcttctaccgtgaataggatgccggtgagccgactttttcttctgggtttccggtttttgattggatctgttgataataaatggcactcattagagtttgtgggacaatccatacgagccacgcaattaacagaaaaagtaatgagccccttgaatcctatctccataggctaatcactgaaccttgcccttctacgaagtcaatttttctgtgcctttagaactactatctgcataacccagtcaaaaaagaaatcaaagttcttccatcagatggatgtgttcttaaatgtaacaaatgatgagataatctaaagtaaccgcagttttggagtaattgatatgaaaaaatacctgtcaagagttttcaggcttaaaaaataagaaaagtccaaagaattggagttaagcgtctgcaattgaggctccattcaattgcaacagaaattacttttccaatgtaatactgctcaagatagttgtgagagggaaactcattgtttcttcgagttgtacttttccagaatgcgtatgtgtatagtcagcggggcaagcttatatacagcacacgaaaggactcttgtaggcaattacacgaggtatccctagcttcaactacatgaaagtaataaatatcacatcagagctttttttgagaagctcagctacaacaaagcgtagttaataggttgtgatttacctaagtaacattgatattccggttcttgaaaacgaagtcttcaagtagatcataaaaagacacattattttcatccatcattccttaactaatttaacaggataactggttactcatgatgaacagtagttaataactggcaacgccgataaccagccggcatttactttccaatgccattaattttgtcaccttgaatcgcgtcactgtaattatgcttcaacggtgcactacacccccagccgcactttatttcttttgctgcagttcatgactgaacgaccaatttatgtcaaatcaacatactgggctgatatggtcagttatttgaccactgcgaggccaaaaatgtagccaatcaaactttcggggggactcaaaattttcacggtcgaagactctcgtcttcaaggttatttcagatagagaaactgaggcaactgtggatgaaattaattaaagagtcggtgtcttggctacctgtaactaactatattctagccaaaaagccgtcgctcattctatggccgccggtatttgcttgagccttggctgcaggaacatatcaaggacatgcctcaattattctgtttcaaccaaccattcactactaaatcggctggccatttcacacacaattttgaatcaaacttcttagccacagtaacagcctatgacccgtcggttttagggtcttgacttggatcccgatgctgcatcatgcaagtaacacccatgatgtaggagttttgtgtcttagctgcattttggcagactgagctttctgtcaccgatatataaacaacgtctggcaagaaaattttgatttttttttcaattgatcgtgtgcaatggctatcagcaagtacttcaagattaacagggcccgcccagaaagctcccctgaaacggaactcaatgactccaaaggcaaaggcatctggagatatattccccacgagagaattattgatgaagatgccatccgtgctagactcaatttgcccactgccgaagaagctttagcgcaggaaagaagtaacgaggagttagacactccttctcttccgattgcttacgaaatcagagatgaagctaataggaaatggtggaaattttttgacgaatacgagtacagggtcaccaagaaaacagctagcgagcacaagtggtaccattggtttgacaagaatgatactcctgctgagaagaagctcattataaagctggatgttattctgtgcttctttgcttttgtcatgtattgggtcaaatatttggatcaaaccaatatcaacaatgcctacgtctctggaatgagagaagatattggaatgagaggcaatgacttggttaatactcagtctatttacaccgtcggtgctattgttttccagctccctttcatgtacatgattcacagatacccttccaactggctcttgcctttgatggacattggttggggtttgttcacgcttgcactctacacgactcaaaacgttggccaacttcaagcataccgttttttcgttggtgtctttgaatctgctttctatcctaccatcaactaccttcttggaagctggtacaccccaactgagtatgcccgccgtggcggtatgttctactggggccagatgctaggagttttgacagcaggtttgcttcaagcggctgcttatgacaatcttcactttgttaatggtttggaaggctggagatggatgttcatcattgatgctatcatcactctccccatcggtatcattgggttttgggcgcttcctggcatcccatccaaatgccactcgcttttcttttcagatgaggagattttccttgcccgtgaaagactcagaagaattaaagttaacgtcgaggacgactctgactcattctttactaaggcgctttggaaggacatgctttctcagtggaagatctacctttttgtcttcctgaacgtccttggctggaataactcaaacgcttcatctggttcctacattctctggcttaggtctctcgaaagattctctgttgtcaaggtcaaccagctctccgccatcacgcccgcattgggtgttctctggatttggctcacttgctctggctcagacttactgcgctccagatttggtgccattgccttctcacaaacgtttaactttttgggtaatttaattttggcaatttgggaagttccagaacctgcgaagtggtttgctttcatgcttcagtactttggctgggccatgattgctgtgggctacggctggatgggtgattcaatgcgctccacgccccagcaaagagccatcaccaccatctgcatgaacatgtttgggcagagttcaactgcttttactgcaatccttgtttggaggactgttgaggccccgcgattcttaaaaggttacaccttttctgcgtgctgtgcgttctctattattattgtgagctttgttattctggctctgtacaagcgcgaggagcgtcaaagagcagcagaaaacggaattattatctacgactcagccaaaggcgaaccggctcctgagctacttcctgacggcaccgtcgttttatcggactctgaaggcaagcacgagtatatcatggccaaccacgagcacacagatatcgaacttaccagcaagaccacttttgtcgttgcacaacgagagatttctgacagtgagtcagagtctgacaaggtagttaatgttgaaccaaagcggaaaatctagggaagcagaagaggaaattagaatttgtttcatacctgaagtttaaccgcattggcgagttcactccattttaagtgttagttaaatgaaatgttcttagcactcaagtcttcggagaagtttggcaggccacgtaatgaaaaaagcgtgtttcaaccgtatagtagtactatttcgttaagtgagagtagctacagataccgtgacatttgtatgtataataatagttcagtgggttttatgaatcgaacaatgaaccgatatcttatctaggtccccatccctctgctattttgacctagtgctatctcaattccctatacaaagggccatgcagatatttagtcactttttgaggttgctagtagaaacaaaatcaaagtcctctttaagcaaccatacgggattagtggtatacagaaaataggagttgattatgaatgacattgataagagtaaaaaaacttttggctattgacgatcattttgatgttacttcataccttactagtatatggcagcaacgtactaaatagacatcttagcaacaagatttgtctgcatgcataactaacacattactcttggagcaatgtcatgtatgtagatgcaataagaagatcttgctcgcgaagacctaatgcctttcttcgtttggatttaaattctttcaacacgaacatgtacaacaacgagattattactagtatatccactgtccctacatgtcaaagcatcattttgtcagctgaaactagatatttcttttgacttttccattgtttcaaattgtgatgtacttaggaggatgtcagtaattatgaggaactttgtgccgttcgcgttacgttttgcatactgtgggggcacatggggatctaaatctctaaattcctgttgttatctaaagtcggccaattctatgattcttttctgggcacttattttttagtattcttttcctagaaagattatttgaccttcttctgacatctataactgtttccctcttgtgatcgattgagtagcaccgatcatgaagttataagaaggtcgcatcttacactccactgatactttcataaagaaggacaattaacaatttcttccagtgattagtttatgctttgaatttgtactcgactaacttttacattgctatgtattacgctttttatttttggttaatgtgtggacaagatacaccgttaagaagttttaaagacgttagtagcctccctcctcaaaggattatttggatcttttttatgtggctatttataaaagcaatctcagtgaaaagggcagacactttatatatgcccgcctagttttgtttattttgcctgaatctctaagtatcgggtagatgaggtgagcttttcagaactttcccgagtctacactagtgatacatttttggtatattacgtatactacaaagtaattgtatatggttattctagactcgaaatattttccatcatcatggccatgtattcttatattcccatctccctactgtttgagcatgaagctgagagttttgttacattagttacagatctaatgttatgatttagaaatacagaattaaaagtccttatccgttcttatcatcatcatatcattctggctttgcacactcttcagtcggtagttgacatatttggaatatcttaacgaattagggtgttcactcttgttcaaaattttgtaccccctataacttgactattttaggcatccatgttactttaatcaacttccttaattatggagtaccataatttcaaggaaacagctttgagcttatgcaattgtgtatctggtaagattgtccgcacacatcttgttttctaggcttaaccaaaacctcatggctagtaaacattcacagtatcaatgtataattcgttggccatcatttggatatgcacaaatctggctcctgatgattagctcaactataacaatctgttcaaggaagaaataggctggggtaacagccaggctctcttgactaaacaatagacgctttccattgcatcatgcagctcggataatcaccatactctaattcgcgcacccatcaccgatcaaccttttcggcccggtctcaatcatgttactctcattcttaccttttggtgttgacaatgctaggaataaagtaccaggaccccttctccagtgaacatgttggatactggggacctgtgacagcaactatagactggtgtgaagaaaactacattgtaagccgatatttcgcagagtttgtgaactccacaacgaacctgtcgttctttattttgtcactatttcatttatattctgccatcaaaaatcgccatggaacactctatattttggtttctatcggtatggggacagttggattgggctcgtggttatttcatatgactttgaggtacgaatttcaattaatggatgaactaccaatgatttacgtcactgcgattccatttggatatatctacagttggcagaaatcaccattttggaaaaattttatccgatatggtactgcctttttcactgtcacactgactttggtatacatttttgtatacaagaaccccattctccatcaaatttcatatgccactttgaactttttgatcatttataaaacgttgaagaccatcaatgaacgtgtcactgaccccgaggtgagatatttagagtacaaaattcttgccttgtcattttcattgtttggatttgggttttttgtttggaacttagacaatatattttgtgatacactgagttatgttcgaaggaattatctgggtcttcctttcgggttcattattgaagggcatggctggtggcatatcttcacttccttgggaatttactatttcattctctacaacgaaattatgggtacttggatgaacgaacagccagaggactacaaattagtttggagactgggttttttgggagaaatggttttgactgatgaagccaaagagagatatcaaaagttggatgaaaagaaaaaaaagtaacaaaaactttcacattagaataaaagtaattgtatatatttcatctcatgtcattttctgtgtcattggcatattgtgtcatcttggccaacaaaaaattaatattattgactagaattggattctttatgacatcatctgtgttggatgctgccaccatttgatcaacaaccttgtttaactctggatgtgtaagaacatagctgttcttgttggcaatcagcatgcttaatactttgactttttcttgaacgtaatagagcggaatctgagaatcttctacggattctaaattcaaaaggagttccgtatagttatcggcaatattagttacattcttctcaatcaacttgaaaattgccagctccaaacttatcctaatgtccttggtttcaggcgaatctgttgcagcggcccacttcattaccaacataggtagctcagctaacttagatgtatcagttattgaagaaaacattcgttgaaaaaatttgacaaccaacaagagtccagttttatagtagttagtcaccggtggaggcaaagtaatgtatccttcaaccaatcgctcaatgctagcttttgattgcaatattgattcagcaaaggtttcgtcagtacagagcttacctattaaaaaccacccctgcaagctaaacagcccagtttgcggatgttcctgttctaaaattcttaagagggatgagctctcgattcctttacttgaaagtaacttcactacatcatttctgtcttcagttgagttgatcgaatttcccagtatgaccatcgccagtatctcaacgtatggattgttcaaattataatcacataccactcgagtagatacattatcgtttttgggatttccagacaagtttcccactgcattaaacaacatattgcacagcaagtatctttgatctgtctccatattctcaccaccataaaccagatctattatcacaaaaaattcatgaaccatagctggataagctgctgatgaaaaatcatagtcatccagcaccgaaagacattccaatatataaaaaagttgggcttgggtatcattatctatctcgccactctccaaacatactttgatcctatgaactaactgagcaagtgtttgtagtgacagaatagaggtgtgagtgtggttcagtgtttgtccaatttcctctagacagctgattaccaactgtgtattctcgaagccatttctcagcaaaatcgataccaaaatttcaacaatatcattgtacttctgtagcattgtattaattaggtcaccgttgtctaaaatcaagttttgcagtagagtagatcctagggaaatgatttttggtgagctatttttcaatgttgaggataatgtgcccacaataccgctttcgaatacaagcagcctgtttgcatcgttctcagcaacaaagttgcatagacagcgaaacagctgaatagcatagggtgtggtttcctggtctgttttcaatgtcatgaactctggtattacgaaattttgaatgatgttctgtgcatcaacatcaagcctattaaattcatttcttagtgaattgcccaccaattcgaatgtagcagtcttttcttccggcgaaagcccttctcgcaaccgggataaagtctgggaggcgtccatgagcgattgacgaagacacttgaattaaggcgggttttgaaggcgcaggtatctagtgaatatgaaacttgagaggatctgcatgttcgcgagatcttatctgactctagtaaaaagtttaaaagtatacatttaaaatagactttgacattgtttgaaatagtcatcggtcacgccgttttagtctcaaagacgtaatgcattgcaagcactgatgttgtcaataatgttccggtgagagtacgccccgattttctcgttcatgacgtaatctttgatggccttgagagtcggtttgattttgagtaatttgcccagcttacgaagatagtaatcaaaggaaacccaacctcgagaaaatcggaacgactcaacaatgcccgaggagtccaaatcttgtagaatgtcaagatactcacgcatcccggagagatagaaatctccggtgctatgaggaatatacacattagccaaataaacttcgtagccagtgtgagagaagacatttcgaaatggaatactcggtatgatatctccatggtgtactattcttacgtgtccttcagttggaaattgtccttcaatcaaatgctcctcgatttcattgaccttggtcatcaaatcatacaaataggctagctcgtgtgagaaaacacgagaagcactagcagtgagggcaaatgacttgatttgaagcaagctgagttcgagctgaagtatttgggcaaatgctcctccttgggaatgcccaccaagtactaactgatacgctggaaattgttctatactttgaaatactaggggaagtatttcgggcaagaccaccttcatcaccgagttgaatcctgagtgaatttcacagttaaagcaaagctcaccgccggtttttctttcaaaggcactattgatctctgctctattggaatcatgcaggagcgtcgctatttcctgatagtacttgattgttggggccctttctgtagtttcatttctccactcattgcaagtgaaactatctacctcgacagccctagatatgtatttctgaatcaaattctcggacactccgtcgtggttgttgatagtttcactaaccactgaactgttccacacattgggacggtaaggtttctccacatagtcgaggttggtcaaccaatcgttggcaaatcttgaccctcggaaaaacacgttaatttttttcaatttatggtccagcaggatatagccgttacctccacctttactaatcatcttgtgtgggggtattcgaaatactttcagcagcctaaacctgcgttgtgagttctctaaggtttcattgcattgaaagggtaaacgaagcttaggaggaagcaagaactctgaattttcatgagttcttaaagctccttgttcattgtcacaataagccacctgcaacaaaggtatgtattgagttgccagctggtagaataggtcgtcattaatttgttcactgctttccagtacataattaagcttggctttggggtctattccaccaaagctcagaaggtctctggcgaatcttccagcagtatacagcgcacttagatctgcatgcctttcttcaaagctttcaaagttttcaacctccgtttgattataagttgggagtcctgcagcatagttgcaaatctccgtaacgaccaccgtcaaaagaatcccccactttgacttcattaacgttgttacaaccaaaagagcaggtgtcccaaataaatttcattgtgccaactatatattctgcatgtctggcagagatatcctgagcaggatttcgaatctaatcattttctgccaacagaccagcagacttggaaatcccgcttagatccatacaacactaggtatgtcgcggatgatgcttgacctcctcaagtagtaaaaatatatcttgagattagatgtatacataaatacaatgcagaaagaatagaaatattatgaggctctctaagctctccaaccaaaggtcatccattattgacatcttgctgccgcacagtatttggagtcttaatttgactctgagtctggtcttgatggtgactatggtggtggctatgatgatgatggctatggtgatgacttgatcgtttggcctttttgtaccaacccggtatgtcttctcctgttgttcctacctccctatcgacataatcgggaacgttacagtcactcaaccaatagtgatttgaaaggcctgccgcatccatccgctgtttgggatccagaactaacattcccgacaaaaagtctgagatttcatgagagtcttcttcacttaatttgtacttttcaagtaacactttttgaagcgaccatgattttaggttctttattcgtctcagctttttcatatcagaatggaaataccttaaggtctctgacccatcctccattagacgctgtggtagagggcctaatagctcaattatctgagcaagatggtcatctgtcttagaaaaagatttaccttcggtgggttcaaataagtactcgcctgtgatgagttcaaagatgatacacccaatggaccatatgtctgctgagcagccccagttagcacccaatatcacttctggagctctgtattgccgtgtttgtatgtcattagtaaaatggttgtacacccaacaagcatttccgaggtctgcaatctttacacgaactctgtcattatcttggatctcttcattgtttggggcatcattttctatgggaggcagagagcccaatgagctaatcattgattccgggtaggtcgttgtattgctgtttgtgtgtgagtctgaattggtgtgtatattgcctaggggagacggcgggcaaaatttgttgttctcatgagtgctgaatgatggattggccgttggatgagaagaattattaacggtgttacctggctggatgtcggctggtgggtggagatcctgagcttgctgttttggttgagcaaactttgacgaaaggctgtgggcagcaacttgaacgggtgagctcatgttgtgaagtactgtcgtgctataagaacgcaaaggagatggtaatggctgggaaccagttatcaatgtatgtcgtctacttcgacgaccatcacgcatggaagaagtctttcgtaaaggtgaaaaattaccacaagattgagaagttttgggagttggtggcatgccgtcagcaggcaactctgctattgttgagggctgtttaaggtttagtgattttttccttatcaacttcttctctctcgcactaatttctaggaactccaggatcttttcaacatcaattatttccattaacacattctccggtttcaaatcagtatgaatgatcccacattgacgatgcaaaaaatcagcggacagaagcaactgcttggctatctgcttgacaaatttcaaaggtaaaccattgtagtcatatcgcttgatcagtccaagtaaattttcgcccagcacttcaaaaaccatgatgatatgcgttccattgggtcccttatggtcgaaaaaatccaaaagcttaatcagatacttgtggcctggatggtcaggatcactttgattcactttaataagaagttttatctcatctatagctgtgtcacgatacacttgagcacttctcaaaatcttgacggcaacatggcgattctccttgagatctttagctaaccatacagtgctgaagtgaccccagccgagcttcctcactagcttgtatcttctattcttatagtactccccaatataagcagggtgatatcctcccgtgcagtagtcttcggtgttttcttcattttttggatcaaggggaggtacttcgtcggaatcttcctcagaatcgtcgccataaagatcaatttctaggtggctagcaccttcagtgcacgattcgtaatcttcatcagaataatcatcttgttttctaggagtaatatttctgctcaatttaagggaagtgccacttttatcggcttcttctggcgtcgcttcatcctcctcaaacttggtctgaatgggtgcaacttcgggtttgggccttctgattatttcttcaggttttacaaaaagcttacgttctaccaattgatggatatgctggtcaatgtcctgttgacctctaatgatgttgtcttcttcggaacactggcattgttgcaatccgagggttagctttgatgccggatgtgccttctttaaatgctccagcttttctttatttgacatactcctttaatccgtgtacgcttgatcctatacgttagatatgattggaaggatatatggcactggaactgatctaaatagagttattctgtagaagaagctaaattcaactcaatataccccgatggatgttcagatttattactaattggtaggtacacggcaaatgatttttccacagtctcgctttttgagattcaatcctgatacaaattgagatataggtataaaggagtcaattaaccaactacatacagacatttcaacctaaatactaacaagtttaatctagctcatcttggttcatagaaacatcaccgtcggcatctttggtgttttcttcattcttctgggcttgttcatttgtagaaccagcagcttcacgagaagcacgctcggcagccatcttttcagcgatagcagaagccttcttagattcttccttttcacggatagcttgtttcttctcctcctctttggcaagataacgacctcggataacatttccaatggaggcaagctcttcgtatttagcaatgtacttagctttagtagaatcataaccttcgtcgtaaagccattcctcagctttctctagcttagctgtaagcttggttttttcctgttcgctagcaaactccttgtactggtcttccaacttacctctaagctcgtaaatgtactcctccagagcgttcttgcgctcctcggtgtctgcaacaagtttgtcttggacctctaaggcagcctctgtctcaagataagagtttaatagctcatctggtaggtggagtgtctgtccagtaatctccaagtcgttctttttgacgagcttctcaactgtcctgtactgaggttctgcatcttcatcagcttctggatcctcgattggctcttgaatagtcttcttctcgactgtgtaagcagattcgacgatatggaaaccagatggatcatttctcagcttaatcttagtctggatagtatcttcaccttcattgacaacaacacccttgatgctccacctgccaatgaactcctgagtgccagctggaagtgcattcttgtccgtgtagcgggcttcaatgttgaaatcttgtgaacggtaaagtgtgatcaccttagttgatgggaaagaaccacccactgggaagacctctaagtggtcatcgtcctcagcggcaggatctttgtcccaataatatgacacagagtaagggttaacgtcctcaaacttgaatggacgaactctaagtgtaggggagtgcattgcacagatgaaagctgcaccacgagcaattgcctcatcttggtttaaagtgaaagataagggctttccaaagacttcagatagagtagctttcaaggttggaacacgagtacaacctccgacaacctcaacagtgtccacatcttcagccttgagacctgccatggccagagcacgctcaacgggaatatgagcacggtctaataatggttgcaccagcttttctaactcctctctagtcagcgaagaagaaacatcaacgtcgttcataacagattcaacattgaatggagctgtagtgttagcggacaaaaccttcttcaacctttcggcagcagtgtaaacacgagaccaagccttaggattttgagtgatatcaatcttgtatttgctcttgaactcctctgcaaagtgcttggtgatggcatagtcgaaatcacgaccaccgaaatgcttgtcagaagcagatcctaacactttcagctcacctttcttgaaagcagcaatcaaaacagaataggtagagtggcctatatcaacgattgcaaccttcttgggttcatcctctggtaggtcagtcttgaagacaccatatccaactgcagcagctgtgatgtcgttgacaattctaactgggttcagaccagcaaccttacaagcatcggaagcagcacttctctgtttctcggtgaaccaaacagggacagcaagacagatatcagtgaactttccctttgtttcctttatggcagtgttcttaatcttgttcaggtacatggcaaccagctgaatgggtgtgaaggtagtcttcttaccttggaagttaacttcagacaggatctcattgtccttctcaatcaggggcgaagtgaagaacttcttctcaatttcatagtcaggagagtctgcaggaagcccgagaatacggaccaaatgttcaacggtattcttcaagttagagttctgttgggtctttcctgattccccgatggctctagacttagcgccaaatccgacaatgctgggggtctgacgattagagacttcattgacaagaatatcaatacctctgttacgggcaacaccgatcacagtgttgttgttacctagatctactccaaatggaacactcatcttaaattggctaaaatattcgtctttccaaaaaaactttgcatggggcgcgccactgaatttaaactaaagaaaaaaattctccatctcgcatcacgtgtttagaattatctagaaggttgcgacttttttaaaaataaagggatccttcccgagcgccatctgacatcccaaaactcccactcagctggtttggataatagttgtcaaagtcttgaatccagagctctctaagagtttataaaatgaggtttctctagtctcctccttccctccaacagtttgaaataacaattgtaattcctctttagaaagtatgcccgtagttgacagatagagcagtagatggaaattggccagactttgccttaaattatgtaaatcatgagtgctgaagtccacagccttcttgatggccttccaatcttgagattcgccaacatgttcacgattctcgatcggaaacctgctggtgtcagaaaataaagagactgattgagactcctcagtaggaaaaccgtgggtcaaggatactaatagatactcagcagggaagtgtggtttggcattcactttaacttgaatgccgtactggttgattctctggaagaaaatatcagggacgtatcgcacttcattagttttgttaacgatagccatgtcgggatgcgtggaagcgcaaataaggtctgcttcaaccaaagcttcaccgctttgactgacttgataactagatatatcaatatctcctttagtattacctgaaaccacgcatgtcacaaatttggatgaaaactttccagaatcagaccatttgcaaatgttgggatacttgagctgcaaacgggcggcaaacttgatctccaatgatgagaggaagaacgaatctttatgtcttttgcagatcactgagccatctccaagtcccgcatctgttaaatccgtaaatacaaccccaacaggctgtaatcccaggttctcagctagttccttgagtgcagcttcattttcttcattcaactctgtgtatgttagaccatcttctaagtccagttgaggcatttcatatatagcctccaccttcgctttcactccaagaggcactttgtcatagacttcgtatgtacccatcagtaatcctatcctttgacatccgttcagtctccaacaattgatgaaatcattgataataccactactgctaaactcaacgtggtctaccaaacgaaatttttgttgttgaagagtaatggctgaaggttggcatttagaacaaatacctttgggccaaggagcatgcccagaagggcaattgctagtaatttggtagttttgctccacaagtggagagatgtaggacccaactgaattttttttgttcttggattcattcatctctttgacatatgcatgaaaggatatatgtttgattccgtgttcttctttgtacttattgtcccaagggggtaagggtgaacaatactcacacattccacgatctgaatggtggcagaattgacctctctttcttgggatcgttccttcttggctgtccaaaaaatcatccacagaaagctgctgaacagattttggtgccgatacaagttttttaatgcctaggctgtcaatgctaataggattagatgtaggaacagaatcctgcgtagaggatgatgcccctccactggtatcgtatttgagataaagaagttgcccattggagaaattcagctcctctattgtagactcaagataaggggctgccgattccgtaacgtcttgtggggttcttcccagataaactctgtcatatctagggcattggggtatcttggaagagagatcgtcaaaaacttgatgtagagtccaggaactttctgctgcaaccctgaacataccatctttggttctaaatcgaattatcttcacgttagtctacactattctgtctcagacggtaaacacacaaaaaaaacttaccatcgccataattattggtaaattaaggtctctgttaatatgcgttatgcgtgaacttatttgccttcagataagatttggaaggtagtggagcccttcaataggcggagcatgtctccctcggggaacaacttggaaagggcccctcggagatgatctttcgcggggtcattcacctcatatctcaaataaatcctttggtccttctctaagaatcatagatagataccttcattagtagtcgcatgctgagaataagcaggaggggttttacatctcttcagttttgttggaatcaatacaaattttatgactgtaagtgcacttaacaagaggcatgggtttccttttttttgttcctaatagctaaccaacaaccatagtggtggcagcatctaaagcacaaacacctgataaaaaaccagaatatctaactttcgacacagtatcatctcctgaagagagaaaattgaggtttgaagaagtttttggggaaaacaagaccaatgtatctagcagaagagatttaagtcatagggatgaggtcaaagtgattggtggagtaagagtgcccagaaagcctatagaaccagataattgctgtatgagtgggtgcataaattgtgtttgggaatcttttagggaagatttgaaggaatggcggacgcaaacaaagcaagcatcgcatagtcttattgctcagggagatgctatcaaatacaagtggccagcaggatttgacccacctccaaagaacttgccccgaaagtacatttctgaagagcttagagctagtaatgtagaaaccactgaagaccctgatgctgaggaccttcctatcagtattcgagtttttgctgagcttgaaaagaaaatgaaaaacaaacacaagaaacttacaaacaaacaaaaaacggaaggagagatgcattatagccgtttagaaaaggagcaatggacccaggatcgtgctggaatgtgatgatggccatgatatttgattatagatgattttaagaagacttggagaccgtattttagtacgctatcgaaagcagaggatactgtcggaatgcgacactttcagtaccaatttagccttttgggttcagtttaatcgtagtactgaataaaaatctggttttgaagtagtagataagtaagatactaagaatgcaacaattgaaatttgtttacaacacaagcctcgaacctgatactgcccagcaagaaaggacaacaagtactgaattatcactgttgaagagaaacgaggtggccaagcgatacgtctctgtgtagttgacggttattcagtactgtgaaagaaaaataaactgcaaaaaaataagtaaatctctttgtaaagcgtgtcatccttatgcaggggccatgctaatcttctctgtattgtttcaaattgaccaaatgtcccgaaggacttgagcttttcgagaaagttgtatatatactgattgggactattttttgggggcgggaaacatcaattcattaccaaatggaacggctagttttgttgccgttagtaggccgctaccaaatcttactcaaagtaaacttattcccagaatcaagagttctttcttggttggttgcataaaatctgacaccacatcaatgtaccactgataagtaccaaccccttcgattaatctacagatgtttgagaataaatctatctctagcctaaagaagttacaaacgactcatatgagcatgtttaccatcaggaagatagcggcactaagtccagctaaagatgcctgatactgattggctccatcctctgaggtagacgatgaagaagaagaagttgccgttgcagatctggtagaagaagcggaagttgagcctgtcgttgatgaagtgagcccagtttgggaattgataaggttagcatcagcaaaggagacaactgcgtcctcaatttcatcaccatcagcgttttttatagtgtaattagaagccctggcttctagattgtcgatcaatttaccaacattggcgtcttcaataccattttcaagtaaatcttcagcgtcctccggaaattctggtaggtcaaagtctgggtcaaattcagagtatagagacttgataccatcagcatcgcaagtggtcaattctggctcttcagcgtccgcttcagagatatcggggatgggagcgttttggtattggtcttgtaggttactaaaatcgtccagatattcaatttctccgctagatgaaatttcgaccactccgtaattgtttgcctcctcagaatactcgtagaccaaccctccagagaaaacgtcagaaaggccgtcaaatagtccatcagaaatctcatcgaaagtacgaggtcttctagtattgcagccatattcggagaaaaaaattggaatggacgtatttttaaacgtatctctggttttggcatatccagatgactgccagttggagataccggaacaccattcatatgagttcagcccaaaaaaatccgattttgaaagatcatcatcctcaccatctatgttacactgaaggtagtcccaggttgctgccctaagctcgatgtcatcagctgcagagtaaccgacaggaatggccctatcactgtgagcttcaatgtatttgtgtaaatccctttgaacagctctgatatatttgggagagacttcagctgaatgggcgtcgtttatgacttcgtttccactgaaaaatccagctacattggggaattccttgaaggcctcgacaacactgaaaatacggtagagataaccagcattgtacgaactagccggatcttctctattgatagattcattacccaaaggagagttgacgtccaggaagacgtatattccggcattgttgaagatggtcatgcactcatcatgatctttggctggatcaaccgtgtaaacacgaatggtgttgatcccaagctgctgtaagacgtaggcatcacgatagcaagcctctggatcactgagaacatcaacgtggttttctacggtgtattcagaagctccaccgggttggtaatcgatacccttgatgaagaatacttctccttcttctcttgcatcttcggcaggtttaataaacctgtgtcccttgatctgaagtggaataagggccttagcaacagcaacgagtgtcaataatggtaagagtagtttcataccttaagtgtgtgggtattgttgaggaggaaaacaaaaatagctgaggataggataccaaacaaatcacgacgatgaatattctgtgcgttgacatagcaacaagcatttcccttacattgtgtggagcgcgaaacgcagatacggatgtcagatgttattgttcttttattccagaacgtggctcaaatactttcctgtaccacctagtgttcgtttgctgagccctagcttctcccagtcctgtacagagttagtgttataaataatgggcttttgaagcattgtttcgctcagttgcgaaagagtcattttccgatatcgttcagggactttaagtcgttcagattgaacggccctataaataagatcggcatcagacgtcttgaaaggacagatgtagatgtcctgcaaataaacagagtctttccctcgtgacaccttgattttaaaattgaggctatgcctcagagagaatagacccccttcaatcgagaagctgcgaatatgagtgctgggtaatcctataggtacgttatctttgattgtggtattgacccttgtcatagaattaagaggagaatatgaatttggcgatagcctttggttcatgatggggcttgccgttgcagtgagtcctgcattgtttatttgtttctctgagggcatgtcgtatcgttccaagttcaattgcaacttgcaggacacaccagaaccttgcagtctaccagcctcgccatcaaactcttttagtgctgtgatcactgtcttttgctttatagggaaccccgtttggtacacctcaacagcttctcttaattctagctggattctgcgaagttttaatttggagctaccagatccaatggcagcgactctaatgtagacaataatttcgtcatctatactgaaagactggtagggaatcgaatactcaacgttgtatttcccatcccaggaagcgaatgatcctactatcggctttgcaaaaactggtaatgctggcagagtatcgtacctttttattggaaccaagaagtcccagtaactcacttcacgagctttattataaaccagtttgaaacttagatagttatctgtccgaaagccccaagcctcgttcttgacgctcgtttgtatagttgatggaagcggaattaggaaaggtacatctaagcctaagatcggtttaaccattgtggagttgttgtaaacaagcctggaaaagacctgagtcgtcttttcagcttctttggaagtgaatatagtttcagagacactaacactttgctttgtattaatctctgcatgtatggaaataattgtgaagggagacccgtctctggttcgaatctccaagacgcccatgatacgcggaagggtatcagacaaccctggataaccatacactaggttctgattcgatgcttttaggtgaacatggaatggttctgacttggacatcggtggttctagtttgaggcccagctctctatatcatggggcaaagcaggaagcaggagtcaggggagatgcccagacaaattcgcgaaggtaatcagacttctctctctccgcctggcgtgttgttgtttgcgccatctgggtgatcgttaataacaacaagattcgcgaaagtaaacaactatgtacattgaagaaattacatcttgcatagttaaaagagatagaaggaatctagaatcctttgaatgcgaatttgattaattttttatgtcagaagaaaaggcctttcagcctatagtgtctctcaagctctctggatcttcagaaagtatcggtaattatccggtttttcccttttcaggaaattaatagcatcccggaataaccctcggaatttttcagcatggttatcatggcaatttaaaatcaccatggcaactgcgtcatcaccagccactactagaaatctcagatctaatttgaaatgtaataatcttattatgcttggcgctgctgataatcgcaccagactgaattcaatcgacattttaaaatacagaaacaaggaaacacaaaatactatctagattgacgccgtggactggattttggacttccaaagagtgagggttgcgtcgtccaaagaggatccaaatgtggtatcatcgtcaagtacaacaatgtcaacgttaccgccgtcgaaaataacggcagccttgagtgaactggaggtaggtcttgcaatgtagtcttgggttcctcctccacctcgggaagagccgtcgttaccttgtccactatgtagatgggagatcagcttgtcagaacccgaagaaagaatctcaaacaaatctagctcaccacatcctgtagaccaacacgaacaagagctgtctccatattgtagagttcttggaattttagcgttcagcaaccaaatagcaggcatgtcgtcgttgataacagctccggaaccagtgtcagaaggcatggtgaactcaaatacaaaaatcttggaggttccaccgaatccgtggtaagctgggataccttttctgtagtatccacagtcaccagtagcagaactgtcaccgcaagcttcgcccgagaaaatcacaaactcggtgttggacttgaaagtcacgtcgttaagtgcctgtggggtgtctgaagcatcgacaccgttagcagcacagtaggataacgagtttccaaaacaactggaccaaactccggaagaggttttacctcccaagctgttcaagaaggtcagattgtccactgaacctggcttgtagtaacccgatctcgaccaagaaccagttgaaggcactgaggacgaagaaggtgcggaagcaccagaagaaacaacagaggaagcaacagaggaagcagcagaagaaccagcaggtgcttgactttgtgccgaagttgcaggctgttgagcggtagtttcctgaccggcaccgtcaccgacagtaacagtggcagtgacctgaaccgtttggacagcggcagctctcttgtgtttatgatggtagtgtttctgggttgcacactcttcttcaacctctctcttcttcttctgagaggaaggatagtagactccaaactgtgaaagacggatggggcctctgaagtgtaccgatagttcctcgtccaaaggagtcaattcgccagatacttggacattttgttgaacacatttgcaggatgattcgtccatggagataacgtccccgtaggagccagaatatccaattccctggtacgagatacctgaaactttgttacagtagtaatttccgcctacaaagtcacaggcagcgtaggcagactggatggaagtgaaaacggagagcagtaaggttgctgataacttcatgatcacgataaacttgccctaaaataaggaatgactaaagttggaaaactataaaggagtggaacggggcaaagttgtagctgaaggaaccagaaaaagaggaggaaggagcgagatgttttatattttgttttgaactgggtgataggaggctggagacgtgttcgcgttgcgatgcagtacttatgcggcaccgtttagaaaccgacgtccttccgagggcagtggtaggagggaaggaagttactcaaatgaaacaacgtcatgtgatacaacattggcggaaaacgactataccttagataagcgaaggacacgaaccaaagaccgggggaggacacaataggggattacataatgcggaagacaaacctacgactgtgttttgatgctcattattgtgcaattttcttaatatacataaattataggaaggatgaccagatcctttactaacctccgaaaccatacaaagtacgtccttgtctcttcagggcatagacaacatccaatgatgtcacggtcttcctcttggcgtgctcagtgtatgtaacagcatctctgatcacgttttccaagaaagtcttcaaaacagctcgaacctcctcataaattaaagcagaaatacgtttaacaccacctcttctggccaatcttctgatagctggctttgtgataccttgaatgttgtctctaagaatctttctgtgacgcttagcgccggattttcctagaccttttccaccttttcctctaccagacatgttttatcgatagtagttgagcaataaaaaaaaggagaaaaagcaggtaggagggaactcgtctatatataccagttgatggctcaccttgttagcagcaacgccactcatttggccacaaaaggtaccgttccttatttgcggccatgctgagttgtacacgtacaattgagaccgggctgatcggttgcgatgatcttattggtcgaaaacgagttcaaaccagggttgtcgctaacgtcacagtttgaaaaaaagcaaaatgtcgcacttgttttctgagtgcaaagcgtttgtaaggctagtagttgctcgggtcgcggggtagcgcgaagtatataagcagactaaaatccctaatttcttgaaacagagattgtgtttccttttttttatttatatccaggtaaagaaaaatggcaagaacaaagcaaaccgcaagaaagtctactggtggtaaggccccaagaaagcagttggcctccaaggctgccagaaaatctgccccatccgctgctggtggtgttaagaagcctcacagatataagccaggtactgtggctctgagagaaattagaagattccaaaagtccaccgagttgctgatcagaaagcttcctttccaaagattagtcagagaaattgctcaagatttcaagactgacttgagattccaatcctctgctatcggtgctttgcaagagtccgttgaagcctacttggtttctctgttcgaagataccaacttgtgtgctattcacgccaagagagttactatccagaagaaagatattctattagccagaagattaagaggtgagagatcctaagtttgatcttagacacccttttcatttggttttacggttctggtagtgaaatggtttttatatctctattgtttttatgtacattagtaattaattaaggattccagcggcccttaagccggtggcaggaatgacgagtagaggcttgtttgagtcaggttccatgcgatgtagtaaactatcacacctagcgcaactttcctttggggggagtcatcaagtatcatctcggctagcatccagcaatttatcggtatgaagttggaaactctgttgatgatttgaacgtgccagcacgtcacgttgaggaaaacaaacactatggtgataagcttcaaatccgtaacaagttttccttggtgttggtatttgtgagaaacactggcaagcaaaaccagcaccgttgggagacctattaagaagtttggaatgttgtttaaagtccagtacctcaaaaacccgttattccagtacgtcgcttgggcgtgcaaggtgaggaatggcaatttggagtgacaccattcaggacgacctagatcataaagatcaatatcaaaatcatctccactactgcgaatatcagcccagtaactaaaatcatgaatgcggcaaaactggtaataaggaacaaattgatttattgccaccaatagccccattgatgctcctgcaaagagcgcaatccgctgtcttctctggaccaggtcgatcaggtacaaaattccgtacaatacagaattagatcttacttggaaggcgataccaaaaaagatcgctgacacaagatagagaagcttcctttcaatgagttccccgtccttgctagcggacttgagtttcagtaacagtcccgtgaagcagaggaatgagttaaacacttcactgtagggcattattacgaatgcgccagccggcaaaacaacgtagattaaggcactcaccagctcaaatttggaagagcttgacgttttaaagtctgctctaattcgaatttcctttgatatctcgtagatcaggagagcgtttgccaaatgcaaaatgttggtaacgattccagcgacaatgaacttcaagatagggtcttctacgggcaactgtctcaccaaagtcgtccaaaacggggaaaagacaaactcatgttcgaaattgggttcgttattgaataatttgtagaagtaaacggcgtcccaattgattagtcggaggacagttacgtgaatcaaagatcgtgagcctgaatcggacgccagagtgggagttgaaacgtcaaaactttcagttatgagagaacccattaggaaggctaattgcagtattttgtaacagctgaaccagttgataataaaagcacgctgtttggaggacattacctgaataaagaagagcgtccagtgatttcgtagcgatgagtgtggaataaaggattacgtaaacccaagatattgaacagctacagaaaatgaagatacccgaaaccaagaggaagggaggaaatggtactaaggccgtatgttattcttgtcattaattacaacaatctaaatgatagtttccatctctctagcataagaaagaacattccgtataagtaatgcatcatccgttggttcttcagtaaagtcaagctgagaaacatcgttgagatgaacgaatccgtttttgatacttaagttcagttcatcttggaaaagagcaataaaactgtcgtagtcatcgttggttcgcaagaacaataggtttttgaagttgtccaaaggtaacttctggtaagcctttaccagattcttgtagatctcaaaccggaccgcatccactaaacttgatttgaacaggttaaactcttgacatgggtacttttcagggtcttggttcagtatttcaaacaatttgttgtaatctccatcaatcagccatttctccaccttgatagggaaatatagaaacttgtccttttccagttcgtcaatagttagtccatctgactgaaaagtctccagctcaatatggaaagtggcaagatctccctgactcaacagaagcaagagatacagggccatcaatttgttttggttatctgagggagataagtctttaagctggtagaagggtcgcaattggtcaatgtagttcttaaactctccgtccttgctcaagtttatgacactcaatgacccaatctccagaattgatcgtgttacttctaagtctttaacgttgatcttattttcgtctatgttgccaagcagaccctgcttcagtagttccaatttcactttaggaatgatgtccagacatttctgatactgcttctggttgaaaaacccagtcagatctttggtcaaagattgtagtgacatatagttggacttgaactgttgccaccagatattgcacatcaaacgggactgttcgagagcgatggtgacaattagggtggtgcacgaatcaacattacgtaaggttaggtgtgatatattactgattatttctctaagtttatggtcgcagacagtcatgtcaagggagactgcttccataggtcaattttattgtcgttctggtatcgtattggcatctggctcattattagtgtattttcaatcatctggcgtgctctgagactcgattactaccacctctccgtcattcgtagatgtagcgttatcaggattatctttaaagcttaacttgtgagttgtgagcttaggattcaatgatccgtcagtaagcttttgtttgaatctttctaaaagttccagagttttgagctccttgattgttttagaggatgattttgtgggttccgattggggtttgggagcactagactttcccctaagattagccttcagttcttcaacctggttcagcgtcttctccactggtgaatttttgggaatttggctgggaatgacggcagcatcaggttgctcctgattttggactaaattctgtttgttttccgaatgcctgtcttctatcttcactttctccctggacaaggtcttgtcctgcaatgtgtcgtgagcacttttcaaccggaactggtcaggatcaattaccgcgtcgtcttcttcgaatagatctagtactacttttcgtctcttctttttttcgggttcagtagccttaacgggcgttggtctcttttgtacgccactaagaaactcagcagacagagtaacttcatctatcttggtgggatacaaagctgttccattcgtacctggtgccagctcactttcgtttatgttgataaccgtgaaaatagtatcgtctccacactttcccacgactgtgaacttgttattaaactcgggcataggtttgaccgtgaaaaatagctcatttgtagtgtgattgaacccaacaatgccacgctgattgaatttcagccttgaatgagcttctaagctcagcttttcgttgataggaagactcaattggataagctctttaggcacaataggctggaacaccaatccttcacagagagccttcataacccggtcagttattattgggacttccttagtccacagacacagcgttattgggcctttagtggtggttaggacaactttgtcggccgttggtggttccaaagacattggagtgtgaattagaaatcgattacacctacatatatacgcgaacactgcataataatgtatattcatcctgttgtgattaacctaaacaccaactatcagagcaaaataactaaataaaaccgatgaaatgcttatagactggatagaatactatggatcaaacaaggaaccctccatttgcttccctacgcagctcctcatcctcaacttcctcaatgtcaattctgcgcttgactttttcatgtgaatctggggttatttttgggataactagttccaacaatccattggagtaagtagctttaatattttcatcctcgactcgaggaagggtggggagcttgattgttctttcaaaggaaccaaatctttgttcagaaatcttcaagtatgactcgtcgtcattcgactcgtggtagtatttattcttcacctcacccttgatcagcaattcatgggaggtaggatggaaatcaatgtgaaatgagctcttgtcggcacctggcagggataccacaaccacatacttctctttcaaatcgtacacattgatggggggtgaaaaaggcttgctcttgcgcaattgaggcttggaaacttgaaaggaatcgagtggaggagaaggagccggcttgtggagattgaaagcagatggcttcctagacacaggtttgggggtttggaaagactgtgattcaggagctggctcttttccagaagaaggttgagattcagaaacactggcatcgccttcagttttgccttcctccttgagtgctttgtttaagagttcctttttaggctcttgtaaaatagctccctttttaacggtttcaactttccctggagcagtaacatcgcctgctcccaaggcactagcgataaggtcacctaaagtgataacaggttcagcttggggctcgggagccaattccttttcctgtggttgttcaggataggcgtaatcgtaaggaactcttttaggcctgtggctgcgatgcctatgtccatggtggtggtgcctggggtgagtgacatagtaaggagcatctccatacaacgagcgataaaggacccctctgggatcatcagattcagcatcggcatcagcatcaaaatcgcttctctcctctgcagtattggaatcttcgtcgttgtagtagtaattttgcggttgacgataccggggggcatattgctgtggctcttcgggatagtagtagttcggccttacagcctggcgctgcggtggtccacgagtttggggagttgccctggaatcttcaaaggcttgaagaatatcatataaagacaatggatggttgtaatagctcatatttctgtgtggggttgaaatagtacgggactacgaaagactaagagtgggtctatatttaagtatactccgtagttgtgatggaacattcgagaaaaaactgattagataagctgaaaatcctttttggtaactaatccccagtttcttgtttcggcaataatgctattaaacctgtatctattggtgttgggtggttcaaattgaaccgcataaaaactttcaaggtgatccgtgatcacaaagtcgaaaatgtgatgcaactactttggtctttcaaaagtacgtgcaagattttcgattgtgttaacgtgacaatacacaattgacgactagcaacgcgatgtatcagattgaaaagcgagccgagacaattaacgagctgcgctcgctactgtaaggtagccgcaaaaaaaatcaagcatcacgcccaaacagtaagttcgaatcgaggtatgctgccttgacacgcttcaggactacaggaatgaaaagaaaaaaaaagcaagggtttcaaggatttttgctagacgtagcagataaattggtggattgaagggacttaaaaagaagactgtaggattatttaggctagcacaatggttacagaaatattctaggccaatggatgtgtctatagcgtgataacgaaacgtctttgaaatattcgttattgtaagtctagcccctgaagtgcatggtagaagaggctcctacctctatcgcgtaaacttacacaagaaacaaacaggcaaaagtttaattaacaatcagcctgacgttaccagacacagtctctttgaaagacctgcattgtttcctaagcgacatgcaatattatgcatatatatgcagtctacaatacaggtagggattacttgtcatcagaaatgacgggagggattcctattgcggtgctttacaaccccaattctgcacagggcctctgttgcaaaaatcatggcatgatcatcaaaaaggttgagtttcattttggtagtgagcatgcaagcgggtaggccttgctcctctggtacactggtttgaagccagtttttagcatttgacagtctgaaaggatgatgtgtaatttgagaatttgaaagtcagacaggcaaaagtcgtcattaattttaaatgggcagattttgtcagtccatcatttcatggttctaagcacattcctcatgtacacagtattcgactgatcgattgatagaatgtttcgcaccatacgtaccccaagggtggagccaagataataggagagagatgaagtgatcttcttacctttctgtggacccatttttggtcaaataaagcccaaattgatactccaagaccctatattactaatcgggaatgcgttaaatatacttcatgtggagtgacttgtagtcttcttctgacacgattttccacaattttcaagttgccaaatttggactctctatgagcaatgatgaaaagcgagttgagtcaacagcatgccaaaccgatatgtgcagatgttttgagtcagttttgggcaattgtggtgttcccgtctagacattgtaagcatgagtgcagtgaaacttatttgtgttgcttctgctttgcattgatggtgctgaaaaaagaccagtccaggtttgagccagagtttagctgattcgtgaatagttttcgtctacgagatggtttatttcgtaattgaatccagtatttgctaacatacagcaacaatcacacatcaaataaagtaaccaagtagcaaccagttgacgcgagtttattcgatgtttctttgatttcttctttttccagacggaataggatacgcccaagctcactttgtttgcgcttatgcattctcagcgctcgctgtatgcccaattcatgctcaatacttgctcttctttaggatatgagggcactgacaattgctttcctatcagagctttcaattaatctactagcgagaagtacgttctagaattattctttgaaaaatcatcatgaatgtccaaatatatcaagtgacgaagtcagatgcatgtagatgcacttatgcatacataaataaacaaagatgcgactgccacaaaagtgaggaacttcaccaaatgaagaaaacaactatccaaattagaagagtgccactctgctgtagctatcataagtaatataaatactaatgtttaaccactatggtgaacccggaatagagatattcttcacctatctgaacttacttctcactatggtgtcactccaaacgttgttcgcagctttcttggttagcacctgcgtagcagctccccagaccctaacatcgccaactggtgagaattctcccgttgccatagcagaatgggaacgaactattcccgcatccggcctcgttgattcgaagatagctgagaacccaacgaaagcagacactgcagctgagaaacgtaccacagttgatttcgtagctgaaaggcaaactggaaggccttctgccaatgcagctgagaatccagatagtaggcctgtgcagccaaatcagccagctcagcctctcgaaccaagtcaagcaagccagctagacgaatcagttcaaacatttcaagcaagtcaatcactatcaagtcaaccaactgaaccaaatcagtcacttcttgcaaacgaacctgcccagaacgcaaatggtggacctactaataacccagttggaaagcctcctggtaaacctactgataaaccaactgatgagccaaccaacaagccaactggtaagccaacggacaaacctaccgacaaaccgacggacaaacctaccgataagccaacggacaaaccaacggacaaaccaactggtaagccaacggacaaacctaccgacaaaccgacggacaaacctaccgacaaacctaccgataagccaacggacaaaccaacggacaaaccaacggacaaaccaacggacaaacctaccgacaaaccgacggacaaacctaccgacaaaccgacggacaaacctaccgataagccaactggtaagcccactggtaagccaacggacaaacctaccgacaaaccgacggacaaacctaccgataagccaacggacaaaccaacggacaaaccaactggtgagccaacggacaaacctaccgataagccaactggtaaacctaccgataagcccactggtaagccaacggacaaaccaacgggaaagccaacggacaaacctacggacaaacctacggacaaacctaccgacaaaccgacgggcaagccaactggtaagccaacggacaaacctactggtaagccaacggacaaacctacggacaaacctacggacaaaccgacggacaaacctacagataagcccactggtaagccaaccgacaaaccaacgggcaagcctactggtaagccaactggtaagccaactggtaaacctaccgataag

(The sequence listing continues in the following parts.)

The invention claimed is:

1. A modified Pichia pastoris cell, which is modified compared to its wildtype cell at least in that it comprises
   a modified ssn6-like gene, and/or
   a modified expression level of SSN6-like protein, or
in that
   a ssn6-like gene is deleted, respectively to the effect that
   the modified Pichia pastoris cell is not able to provide an SSN6-like protein that exerts its wildtype function and/or wildtype activity,
   the amount of SSN6-like protein being present in the modified Pichia pastoris cell differs from the amount of SSN6-like protein being present in its wildtype form, and/or
   essentially no SSN6-like protein is present in the modified Pichia pastoris cell wherein the following definitions apply:
   the SSN6-like gene is defined as comprising SEQ ID NO: 1, and
   the modified Pichia pastoris cell, compared to its unmodified wildtype, is defined as exhibiting reduced or no SSN6-like protein activity and/or function in regulating the expression of genes which are under the control of an LLP promoter, with this LLP promoter comprising SEQ ID NO: 133.

2. The modified Pichia pastoris cell according to claim 1, wherein said modified Pichia pastoris cell exhibits reduced SSN6-like-protein activity and/or reduced function, or no SSN6-like-protein activity and/or function at all.

3. The modified Pichia pastoris cell according to claim 1, wherein said wildtype cell contains a SSN6-like protein, which protein comprises one or both of the consensus amino acid sequences depicted in SEQ ID NO: 63 and 64.

4. The modified Pichia pastoris cell according to claim 1, comprising an expression vector comprising a promoter, wherein said promoter is characterized in that it is repressed in the presence of SSN6-like protein if said expression vector is introduced into a suitable expression system, and wherein said promoter is an LLP promoter comprising SEQ ID NO: 133 or modified versions thereof, said modified versions being characterized in that they still exhibit the promoter function, wherein an LLP protein, which is encoded by the nucleotide sequence depicted in SEQ ID NO: 16, is not encoded by the polynucleotide sequence of this expression vector.

5. An expression system, comprising
   a) the modified Pichia pastoris cell as defined in claim 1;
   b) an expression vector comprising a promoter, wherein said promoter is characterized in that it is repressed in the presence of SSN6-like protein if said expression vector is introduced into a suitable expression system, wherein said expression vector can also be present in linearized form and/or at least parts of the vector being integrated into the genome of the modified eukaryotic cell, and wherein said promoter is an LLP promoter comprising SEQ ID NO: 133 or modified versions thereof, said modified versions being characterized in that they still exhibit the promoter function, wherein an LLP protein, which is encoded by the nucleotide sequence depicted in SEQ ID NO: 16, is not encoded by the polynucleotide sequence of this expression vector.

6. The modified Pichia pastoris cell according to claim 1, further comprising a promoter that it is repressed in the presence of SSN6-like protein if an expression vector comprising the promotor is introduced into a suitable expression system, and wherein said promoter is an LLP promoter comprising SEQ ID NO: 133 or modified versions thereof, said modified versions being characterized in that they still exhibit the promoter function, wherein an LLP protein, which is encoded by the nucleotide sequence depicted in SEQ ID NO: 16, is not encoded by the polynucleotide sequence of this expression vector, and/or
further comprising (a) gene(s) of interest being under control of the promoter, and/or wherein the gene(s) of interest is (are) selected from the group consisting of genes encoding enzymes, antibodies or fragments thereof, hormones, structural proteins, and protein-antigens being present in vaccines.

7. Method for determining the purity of a composition comprising the expression product of a gene of interest, i.e. a protein(s) of interest, comprising the following steps:
   (a) expressing gene(s) of interest by using the modified Pichia pastoris cell according to claim 1 and by using an expression vector comprising a the LLP promoter, wherein sad promoter is characterized in that it is repressed in the presence of SSN6-like protein if sad expression vector is introduced into a suitable expression system, and wherein LLP protein is not encoded by the polynucleotide sequence of the expression vector, wherein
   (a1) the modified Pichia pastoris cell comprises a gene encoding the LLP protein under control of the LLP promoter, and wherein
   (a2) the expression vector comprises one or more gene(s) of interest under control of the LLP promoter, wherein sad gene(s) of interest does (do) not encode the LLP protein,
   thereby obtaining a composition comprising the expression product of the gene(s) of interest, i.e. the protein(s) of interest, and the LLP protein, which is an expression product of the gene encoding the LLP protein which gene is comprised in the modified Pichia pastoris cell of (a1);
   (b) determining the amount of the expression product of the gene(s) of interest, i.e. the amount of the protein(s)

of interest, and the amount of LLP protein being present in the composition obtained in step (a), wherein the amount of LLP protein compared to the amount of expression product of the gene(s) of interest, i.e. of the protein(s) of interest, is indicative for the purity of the composition obtained in step (a); and, optionally, (c) subjecting the composition of step (a) to one or more downstream purification step(s), followed by step (b) for determining the amount of the expression product of the gene(s) of interest, i.e. the protein(s) of interest, and the amount of LLP protein being present in the composition obtained after having carried out sad downstream purification step, wherein sad LLP promoter being present in the Pichia pastoris cell and being present in the expression vector is the LLP promoter respectively comprising SEQ ID NO: 133 or modified versions thereof, sad modified versions being characterized in that they still exhibit the promoter function, wherein the LLP protein, which is encoded by the nucleotide sequence depicted in SEQ ID NO: 16, is not encoded by the polynucleotide sequence of the expression vector of (a).

8. The modified Pichia pastoris cell according to claim 1, wherein
A) the nucleotide sequence of the SSN6-like gene is modified by introduction of a point mutation, a partial or complete deletion, or a replacement by a different nucleotide sequence; and/or
B) the expression level of the SSN6-like protein is modified by impairing the transcription or translation of the gene encoding SSN6-like protein.

9. A method for expressing a gene of interest, comprising the steps of: expressing a gene of interest by using the modified Pichia pastoris cell according to claim 1, thus obtaining a recombinant protein expressed by the gene of interest; and
purifying the thus-obtained recombinant protein.

10. The method according to claim 9, wherein the modified Pichia pastoris cell exhibits reduced SSN6-like-protein activity and/or reduced function, or no SSN6-like-protein activity and/or function at all.

11. The method according to claim 9, wherein the wildtype cell, compared to which the modified Pichia pastoris cell is modified, contains a SSN6-like protein, which protein comprises one or both of the consensus amino acid sequences depicted in SEQ ID NO: 63 and 64.

12. The method according to claim 9, wherein the modified Pichia pastoris cell comprises
a modified ssn6-like gene, wherein said gene has inserted a foreign nucleotide sequence, to the effect that
(i) the Pichia pastoris cell is not able to provide an SSN6-like protein that exerts its wildtype function and/or wildtype activity,
(ii) the amount of SSN6-like protein being present in the eukaryotic cell differs from the amount of SSN6-like protein being present in its wildtype form, and/or
(iii) essentially no SSN6-like protein is present in the Pichia pastoris cell, and
a gene of interest that replaces a part or all of the coding region of the gene of the Pichia
pastoris cell encoding the LLP protein, and that is under control of the LLP promoter,
wherein
said promoter is an LLP promoter comprising SEQ ID NO: 133 or modified versions thereof, said modified versions being characterized in that they still exhibit the promoter function.

13. The method according to claim 9, wherein the modified Pichia pastoris cell comprises
a modified ssn6-like gene, wherein said gene has inserted a foreign nucleotide sequence, to the effect that
(i) the Pichia pastoris cell is not able to provide an SSN6-like protein that exerts its wildtype function and/or wildtype activity,
(ii) the amount of SSN6-like protein being present in the Pichia pastoris cell differs from the amount of SSN6-like protein being present in its wildtype form, and/or
(iii) essentially no SSN6-like protein is present in the Pichia pastoris cell,
a gene of interest under control of the LLP promoter, and an llp gene,
wherein
said promoter is an LLP promoter comprising SEQ ID NO: 133 or modified versions thereof, said modified versions being characterized in that they still exhibit the promoter function.

14. The method according to claim 9, wherein the modified Pichia pastoris cell comprises a SSN6-like gene, wherein the nucleotide sequence of said SSN6-like gene is modified by introduction of a point mutation, a partial or complete deletion, or a replacement by a different nucleotide sequence; and/or wherein the modified Pichia pastoris cell expresses a SSN6-like protein, wherein the expression level of said SSN6-like protein is modified by impairing the transcription or translation of the gene encoding SSN6-like protein.

15. A Pichia pastoris cell comprising
a modified ssn6-like gene, wherein said gene has inserted a foreign nucleotide sequence, to the effect that
(i) the Pichia pastoris cell is not able to provide an SSN6-like protein that exerts its wildtype function and/or wildtype activity,
(ii) the amount of SSN6-like protein being present in the eukaryotic cell differs from the amount of SSN6-like protein being present in its wildtype form, and/or
(iii) essentially no SSN6-like protein is present in the Pichia pastoris cell, and
a gene of interest that replaces a part or all of the coding region of the gene of the Pichia pastoris cell encoding a LLP protein, and that is under control of a LLP promoter,
wherein
said LLP promoter is an LLP promoter comprising SEQ ID NO: 133 or modified versions thereof, said modified versions being characterized in that they still exhibit the promoter function.

16. A Pichia pastoris cell comprising
a modified ssn6-like gene, wherein said gene has inserted a foreign nucleotide sequence, to the effect that
(i) the Pichia pastoris cell is not able to provide an SSN6-like protein that exerts its wildtype function and/or wildtype activity,
(ii) the amount of SSN6-like protein being present in the Pichia pastoris cell differs from the amount of SSN6-like protein being present in its wildtype form, and/or
(iii) essentially no SSN6-like protein is present in the Pichia pastoris cell,
a gene of interest under control of the LLP promoter, and an llp gene,
wherein
said promoter is an LLP promoter comprising SEQ ID NO: 133 or modified versions thereof,
said modified versions being characterized in that they still exhibit the promoter function.

* * * * *